United States Patent 9,328,346 (POLYCOMB-ASSOCIATED NON-CODING RNAS) - sequence listing, part 146

SEQ ID NO: 192352 - RNA, 899468 nt, Homo sapiens
uuagcaaaucauuguuuuauuuuaacaucacuguuuacuguucuuccuaacuggcaguuacuccuuuguagauaguacaaaucacaauguaauucccaucauuauguguauaauauguguuccuucuuguucuaccuuaacagcaagugacaaauacaucauuuuuauugaauauuaauuuucaauuuauuucagcagcaagcaccaaaaucaaaacccaacaaucaauauaauaaguauauguaacaaauaaucugaaauucagccccauuaagacaugugggugcaauauuuuuauauucccaaaggucugcauauuuugggggcauuaaacaacagggaacuaaaauuuaacacaaaaucaggugccauuuaauacuguuuaacauuugaaaauuauuuauuuaauaauacagaucguuuuaaugugcuguaaauauuucucgcacagcaucauauugucagaaguuuuucccuuuuggaggcuucuuuuuuccauuccuuuccaguaacuggccucccaaugccagcaacucagguagauucaugcagucauuccucuucucucuguacugguaagcgcucuggaggaagaacagauuccaauuucugccagcgcucugggggccacaggauauguguggcaugggcaugcagaaguccuagggaaaccuuaauucaugagaaacagaaagaaagcaauaaagagaucauuuuauaagaaucauuauuaauagcuugaaagcagaauuuaauccagguuuaacaucccagggagaagugaugaugaauaaaaaaaauaguaaacaccuuuuguagccauugaaauacaaagaaaaauacaguaagcacuuauauagcauuuuucuaggugcuauuguauauaaacuccuuuaauccucacaaaaaccauuugaaguagguucuguuaguauuucccuuuuagaaaugagaaagcaaagcucaaagagguuaaaaaauuugccaaaauucauacagcuaccaagcgguuagucuguguuuagaaccaagcaguuugacucgaguccaccaucuuaaccauuagccucaagagccuauuugcauagacccaggaagcauaaaucuggcguauauucucagaguuucccgcagagucauugguauccuagagagacuuucuuuauggaaaaaucacagaguccuaaaaaauauauauauuuugugaaaaacauugucccaccuacuagaugagcagcaggaguuaggugugagacugggugggcugucuccauggagaguacacugaguaacacggaucuaguacucauggagagagguggaaaacaaagagaaagcaaacaaggugggauggguagcaaggaaaaauaauaaaguauacagaucauggcagaugguaaagaauccccaucagcagaggagagcagagauuggcgaggauggaagaggaggugagggggaggacuuaaggcugagcccaaagacaggaagggagcccuuaaacaucuuaaaucuuaaagacaucaauuucggugaacaggagaacauagcaaacuuguuuaaaaggcagaucagggucuuaucuuaagagauuacccuucaacaggucugaaggagggccuggaaaucuguguuuuuaaaaaaauuguuguuguuauaguuacuaucaggugauauuuuaaugguauuuagaagcuuacaaaauacacucauauuuagcacauauuuacugagugccgguuauaaaguaauacuauauguccacuuuauuuaccauuuuauuuucaaauguuuuuccuauaaacuggacuuccacagagauuaacauaaaacauuccuuucacugaagcucuucuauuugcuaucacaugaauucaggaaaucucuucuauuugcuaucguauguauucaaaaaaaucacauugucuagggacucgaagacggaacuggaugucagggaaggcuuccaaaaagauaaucaaaaacacauuguuuacacagaagaagaagaagaaaaaucuuuuaacaacaacuugaaauacaaacuaaauauucacgaaggguagcaagaagcccuugggcucaauaaaggguucuuuuuuuucuucuacuuguuauuuugaaaaucagaccuguaaaaaauuugaaagugugguacaaaaaacagcuccaucaaaaguaagcauuuacauuuugcugcauucauuuuuuucucauuuuauguguauguacauauaugagacauguacacagcuacuucuucuaaacuguuugauaguuguugacaucaugcuaaauuuaucccugaaaacuucaacauauaucuccugagaaugaagaccguuucauauaugaacaugauaccauuauuauacacaagauauuuaauguagauacaauauuacuuauuacauaguucauauucaaaauuuuccaauugucccacugaugucuucuauagccauuauuuuaaaaauucaaggucuaaucaagagucacauauugcauuugguggucauuauuuugcuucgguuuacauuuaauuucuuuuaaucuggagucccagcaagcugccuuguaaaaugucauauaucuggaauugcuugauuuuuuuucccucaugacuagagucaaguuccaucaaaucaggaggcacaaaauaucggugcaucucauuguugugaugccaaguuugaucacuuaaggcaauauugacuagauuucuccaucauaaauaaaucuuuuuccuucuguaauuaauaacugugagauauuuuguaauaauguaaauauccuauaugccagcuauauuucaucuaauuguguuaacauucauugaugauccuguccgaaucacuuauuacauuagggauuacaaaaauaaugauuuuccaaaucuauuccuucuuuugcauuuauuaguuggcauuguucucuuaaaaaaaaagugcuuucccuuucacccuaacugccucuauuguaauaucaagaaguccuuuuuuuaagucaaaaucugugacuacuuuuuauuuauccguuugaugcucaaaugucuuaaguuuggccagugggagcucuauguguccuuuggauacaucuccaucaguauuuuagcgcuaccuuacuuuuuggcacuauuaguuguuacaggcuuaccuugcaccuaauaccugcucccccugagaucagacauuucuuuaaagugccuugguuucuuguuuguuuguuuguuuguuugcuuuugagacagagucucacucugucgcccaggcuggagugcaguggcgcaaucucagcucacugcaagcuccaccuccuggggucacgccauucuccugccucagccuccugaguagcugggacuacaggcgcccgccaccaugcccggcuaauuuuuuguauuuuuaguagagaugggguuucaccauguuggccaggauggucuugaucucuugaccucgugauccaccagccucagccucccaaagugcugggauuacaggugugagccaccgugccuggccauuauuuagaaaccaagguuuaguacuaggugugcucagugcuccuggggugucaauauucuaugccauuucagggaauacacauaaaaaauccaauaccaaaaaguucucccucaccuuccgcacuccauauuuuaucucccuucuuccacagugauuacccuggcuccccacaacauuaacacauuuauucauuuauacuuuccuaaaauauacucaaaauaguuucaaggugacuacacuacaaccauuaccaacaauaaaucugcugaguacaaauuaagaugucuguguaauuauuuuaguccuuaaaauauaucucaguuuaaggguguacuuguaggccggagugcaguggcaugaucuuggcucacugcaagguccgccucccagguucaugccauucuccugccucagccuccugaguagcugggacuacgggcaccagccaccacgcccagcuaauuuuuuguauuuuuaguagagagggguuucaccguguuagccaagauggucucgaucuucugaccuagugauccaucugccuuggccucccaaagugcugggauuacaggcgugagccacugcgcccggccuggaauaaauucuuuuuuuucuccccaguauaguuauguuaccauuugauauagagguaggcuuauuuguuucuauuuauacucaauuuuagaguuugcuuugauuacccauuuuugauuccauuuuauuuuugaauauauauaaauuuacaucauucaaaaguuaagauuauuuuuuaaagaugugguaggcagaaugaugccgccccaccaccguccuggcaaaagauguccacaucuuaauugccagaagcugugaauauguuagagaauaaagaagaauuaagaugcuaaccaguugaccuuaagauaacaagaauauucucuauuauuuuaugggccugaauguaaucacaaggguccuaaacagugaaagcaggaggcagaagggucagauucaaagagauuugaaaaugcagugcugcuggcuuugaaggugcagaaaaggaccaugagccaaggaaugcaggcagccucucgaagccagagaaaggaaggagaugaauuauccucuagaacuuucagaaggaaugcagcccugcugacaucuuaacuuuagcccagugagacccauauuggacuuuugacauccagaacuguaaaauaguauauuugugcuguuguaaggagauacauuuaugggaauuuauuagaucagcaauaggaaacugaaacaaaaaguauacaaagagaaaucccauucccaucuuccaccccauccgcaauagguaacuaauuuuauuaguuucugguuuguuguuucuguguuuccuuuuugaagcaggaaaaaagcaaauaaggauacauacauauuccuuuuucccuuuuagacuuauaccaaagguaacaugcuauauucucuugugcaccuugcuuuuacucucaacaauauauccuguaagcuaccucuauuacuucauagaaaugaagucuguguuuuuuuuuuaaagucuccucaccccaccuaacccuagugauucugcugauuacucaguuggggaaucuaaaucuguaguuuccacuuuguuucacgucuggaaaagguaaaccuaaucaaccuuaaagaaucccuugaauguauuccagaacauccuaaaaaaccauuccaucuauguuaacuuccaggaaauacuucccuagaccuaagugaucugucauauugcaguuuuuauccaguuuuguucuuaucugagcucagcagaguuggaaaacagcuggucuccaucucuucuacaauaacccuuuuuaaaauuugauagcugcuacucagauguaccucaagccuuuauuugcucuucaagauguuuaacuuuguuucauaagggugauuugccagucuucuaacuuggcugaacucuugccaauauaucugcucgcuugcuuagcuuuggacucaguuuugggcauagugauucaauuuuuuuuaaaucaacacucauuuuaccaaaaccaaucuuagaauucuuuuauuuuaaacauuuauuaaggcuacuacucuugcuuccugaaaaaaauaauucaucuucacaaugaugaaugaugagaauucuaucagauaacaucaauauugcuucaaaacaugguaugggaaugcaaaauucaggguuucuuuuuuuuaauauugagaauaauagagagagagagagugucuguucauccuccauagugucuugucauggaucuucauuuuuuaaaauugauaugucuauaggcaggcaaagaguauagugaauauagaaagauaaaaauccagaaauauaugaacuuuguaaaaauuaaaaauuauccuucagguacaguuuugacuugcauacuggcuguauuaguuagguucuccagagaaacugaaccaacaguaugugugugugugugugugugugugcguguguguguguguguguguguguguguguguguguguauauguauauauauauauagagagagagagagagaaagagagauuuaucuuuaaggaauuagcacaugugauuauggaggcuuggcaaguccaaaaucugacaagggaggucagccgacuggagacccaggaaaaaguugcaguucguugcaguucgaguccaaaggcagacugcuggugaaccaggaagagucaauguugcaggugaggucugaagacgaucugcugguguguuccuucuuacucaggggaagucauccuguuguucuauucaggccuucaacugauugaagaggcuuacccacauuacagacaguaaucugcuuuacugaaagucgaucaauuuaaauguaaaucucauucaaaagcacacucaaagaaacauccggaauaaugcucgaccaaagaucugagcacacuggcacagccaagcugacacauaaaauucaccaucacacuugacauauacaauccuccugcucuuugcuuacucaguguuacacucagugcuuacucuauggagggcaguguucugaaugacuuacacauacugacucauuuaauucuuaaaauaagccaugggguaaguacuguuacugccucuauuucguagccgagguaguguaggugcagcaauguauuuuuugagcugagacucaaaugcaugaacucugguucuagaagcuuucuaucaggaucaccauaucauucaucauccaaaugaaacacuucuggcaguccaagggggugcuauuuuuauuaagucaggauaauaaaaauaaaucaggacuguccuugacaaauaagaauauaguugcccuaauauaauugcuucucaauacugcuaggucccacguucuuuccugaaaaaauagacucaucaauaaguaaguacacauuguuaugugcuaaauuguguucccucaacuuuauauguugaagucuuaacuccuaauaccucagaaugugacuguauuuggauauggaaacuuuaaagggaugauuaaguuaaaaugaggccugaaggcaaccggauuagugaccuuacgagaagaggagauuaugacacacagagaaacaccagaagcacaugugcacacagagaaguucaugugagaacauagcaagaagguggcaucaacagccaaggagggggacuauagaaaaaaaccaaacauauacugaacccuugaucuuggacuucuaguuccagaauugucagaaaauaaauuucuguuguuuaagccacaaucugcgguauuuuguuaugagaguccuagcaagcuaauacacacaugaauuuaaaaaacgcuacgcagccgggugugguggcucaagccuguaaucccagcacuuugggaggccgagguggacagaucacuugaggucaggaguucgagaccagccuggccaacauggcaaaacccugucucuacuaaaaauacaaaaauuagccagaugcaguggcgccugccuguaaucccagcuacucgccaggcugaggcagaagaauugcuugaacccaggagucagagguugcagugagcugagaucaugccacugcacuccagccuuggugacagagcaagacuccgucucaaaaaaaaaaaaaaacaaaaaaaacaaaaaaaaccccuaaacaacacagugcuagaagucagguccaugaaauguccuaauacugacuccucaaaauaggggaacaaagaaauauguugagagaaaaacaaaacaauuuuugcuuugaagaaaaagagagagaugcuaaaguauaaauaacucuuccaauagguuaaauacuuugaacaaccaaccuaacaucuuauuggaacuugauucuccccuuuccuuacuuauuugugucccauguguaacugugucuccuucaauggauucacauuuuucagguauaagaaaguuacuuuuacaguaaauuucaaaacacaauagcaaaagcauauuaaaugaacccugcaaccuugagcagaucauugcauuuucaguaucuauugaaugugaagauaaguucaccuaugugucuuaauagaacucuuguaauaacuugccccuaugguagagugggagggcacugagcccacagauuggaaauucauaaucuagaauaguagucaccaaacuguuuugauuaugcaucagcagaaaauuugaggauucaucccuauuauuuauguuaaaauuacauauaugcuauuaacaauccauaaaaucaaauguuaauauggcuuagauucuuauuuuagauacaaauagaaguucuaauuuuuuuucuugccucccauggaucauuguauucacuacuugaauauuccugcuucccacuuuagcaaucucuguuuuaggaaacaccaaaauuacuggcuggaaagugauccaggauaucagucaauggguuuguuuugcccacacaaugccaacgaaccacauggacuaaauuugcacugaauugccugucuuugauugaguuggcuccacugagaaguuauuuuggcaucugguagacacagucuucaugagcccagccuuuccuucagaugccagggggacagauguguguggcuuuuguucccuccccucccuuuccacaaaccuauagucuaccuaacacucuuucauuucuuggcuucagguaguuucacccucucuugagggaaaggcuugcaaggacaagauaaggacaagcaaaugcaaaagagccuugaguugggauagaggaaaaaacacaggaaagaaaaucaggaagaacaagacuguuagcgggaggaaagacauuuuuuaaaaagauguucaggcacuucuaccaugugaggggcccucaccagaugcugaauuugcuagccccuuaaucuuggauuuccuaaccuccagaacugugagcaauacauuucuguuuagaagcugaaaaaaacaaaacaaaaacaaaaacaaaaaaagauuuucagaacuuguauuauuccauuaucaugcugcuaauaacuaauaaagacauacccaagacuggguaauuuauaaaagaaagagguuuaauugacucacaguuacugugaggaaacuuacaaucauagcagaaggggaagcaaacauguccuucuucacaugguggcagcaagcagaagugcugagcaaaagggggaaaagcccuuuauaaaaccaucagaucucaugagacucacgcacuaucacaacaaaagcaugagggugauugaccccaugauucaauuaccuccuacuaggucccucccaugacauguggggauugugggaauuacaauucaggaugagauuuaaguggggacacaaccaaaccauaucauuccacacccagccccucccaaaucucauguccucucauuucaaaacacaaucgugucuuuccaacagucccccaaagucuuaacucauuccaccauuaacccaaaagucuaaguccaaagucucaucugagacaaggcaagucccuuccgccuaugagccuguaaaaucauaagcaaguuaguuacguccuagaugcaaugaggguacaggcauuggguaaauacacccauuccaaugggagaaacuggacaauacaaagggacuacaggccccaugcaagucugaaauccaguaggguagucauuaaaccuuacaguuccaaaaugauucuccuuugacuccaugucucauauccaggucacgcugaugcaagaggugagcuccaauggccuugggcagcuccgucccuguggcuuugcagggaacaccuccccuucuggcugcuuucauggggugguguugagugucugcagcuuuuccaggugcacaaugcaagcugucaguggaucuaccauuuuggggucuggaggaugguggcccucuucucacaguuccacuaggcagugccccaguggggacucugugugagggcuccaaccccacauuucccuuccacacugcccuagcagaggcucuucaugagagcuccccaucugcagcagacuccuuccuggacauccaggcauuuccauauauccucugaagucuagauggagguucccaaaccucaauucuugacuucuaugcaucugcaggcccaaccacaugguagcugccaaggcuuggggcuuguacccuccgaagcaauggucugagcuguaccuuggcccuuuuagccauggcugaauccaaagcaucugggacucagggcaccauguccugaggcugcuuagagcagguagguccugggcccagcccaugaaaccauuuuucccuccuaggccuccaggccugugaugggaggggcugccaugauggucucugacaugcccuggagacauuuuccucauuguuuuggcaauuaacacugggcuccucauuacuuaugcaaauuucugcagcuggguugaauuuuucccaagaaaaugaguuuuucuuuucuacugcaucaucaggcugcaaauucuccaaacuuucuacucuguuaccucuugaaugcuuugcugcuuagaaauuucuuccggcagauauccuaaaucaucucucucacguuuaaaguuccacagaucucuagggcagggggaaaaugccaccagucucuuugcuaaagcauaacaaaagucaucuuugcuccaguucccaacaaguuccucaucuccaucugagaccaccucagccuagauuuuauuguccauaucacuaacaguauuuugcucaaagcuauuaaacaagucucuaggaaguuccaaacuuccccauaucuuccugucuucugagcccuccaagucucuaggaaguuccaaacuuucucacacuuuccugucuuuuucugaucccuccaaacuguuccaaccuuugccuguuacccaguuccaaaguugcuucuacuuuuugggguaucuuuaagcagaaccccacucccaguaccaacuuacuguauuaguccauucucaugcugcuaauaaagaccuacuugagacuguauuuacaaaggauagagguuuaauugacucacaguucagcauggcuggagaggccucaggaaacuuacaaucauggcagaaggggaagcaagcauguccuucuccacauggcagcagcaaggagaaaugucaagcaaaagggggaaagcccuuuauaaaaccaccagaucccaugagaacucagucacuaucaugagaauagcaugagggaaacugccuccaugauucaaauaccucccaccaggucccucccaugacacauggggauuaugggaacuauaauucaagauaugauuuggguggggacacagccaaaccaugucagaacuagagccagggucagaagaugaucaaugucaggugugaggaaugaggugaagcacaacacuuuuaaauccauuugauuaaaauauuuuguaagcaggagaaacaaccugcacuuuuagcaaauaaaauauuuugaugaauuuuacuuagcagcguaagaagagagagaaauuuccaaauaaacaaagcagcagucagaugauauuuauucuacaauauuaaauuaccuacaauuauguuugaaagucaaaacgaacugaaacaauauccaaaauuugaaauguuguucuaaaauaaguacugauuucucaaugcuuaaagaaaugucagcucuccaaucugauaucaaagguccuucacagucacauccuuccaaacucaucuucaugauuucucaguacaaguacucuacucucagggccucuccagagcaccuacaacaggacauaccauaucuaucugccugcuucugauuacuguuguccuuccaguuuguaauccucuuccuuagaucccuggaucucucuuguaagacccaauucaguccugacucuuccacggagucccucccagccaguccaauucauauccauuuguuccugaccaaggaaucaaggccugguauagggucuccccaauauccaguucuacccaauauaaagaucaauauauuugaguuaaauauauuuuuuauaaaguagcacaacucuuauuuucuugaccucccaccuuuggauccagaggauuacacagcuaucauccaguguuuucucuuagaauguauaaggcuaguggugaguauaaggcuagugagguaucaucaaaaguggugaccccuuuuggaccauaacuuaucugccagugaucccuaccuucagguccuuguuuaaaggggaaaccaauggugcaggccccaacuuaauucaaaugaacaaaaugagcacaguaguggcuacauccuuugucaggcucaaaaaaaaacaggcucaguucucccauaguuuuucuccccccaaaugcaaccguauuucaucaaaggcagaacccacuccuccugggccucuuacugcaagguugucgcaucagaaaaccaauuuucuucucacugguuuaguuauuucuaagucuccguaaugagauuuugaaaacauuacuauuggguuaauaaauguuucuugcuuaaaggaacaaaguuuaauaauauaggaaccaaaacguuugugugguuaggucagcaaugaccaauacaaaguaauuuacuuucuuaucauaguacuuacagcuuuaaaauaaguuuuaaauaaaacuuacaguuuuaaaauaaauuugguuccucaucaaaauaagauaaucacaaaugaaacuuuaagaaauucccuaagcauagugugaccaugcaaucuauuacccaaauuaggacacuuaagagugaaggggguuauuaauaauuaaacugggacagcagguguaaaccaagguggcucuaggauauauagucauccuacuuaugugucauccuauuauuuugacaagugaacauuuauugacuauuguuauacucugagggccuuacauauaaauaaccucuccuacuacuaaaauuaaaccugcaguauagauauuacuaauugcauuuugcaaaagaaaaaaauaaagcucagaauuacuaaguaacaugaugaaggcuguaaggcuaguaaaugauagaagcaagauuugaaauaggcaugguucaaaauucaugcugcucccaccauaagguacuguuucuucugugauguuauguaauaauuuauguuuccaucucuauagcaagggucagcaaacauuuccucuaaaggaucagacaguaaauaguuuaggcuuacaggccauaugaucucuguugcaacuauucaacucuguacuugcagcacaaaacaggcauggacaauauguuagcgaauauaacauuuguuccaaugaaacuugauuuacaaaaacaggcagcgagcuguauuuggccugagggccauuguucagcaaccccugaucuauacucuagacccuauaaugucucugauuggacaggcagagguucuagcucaccuuuucuauauuauaaauuagcacgguguuuugaacaagauugggaacuaccugucagcaauaagcauuuacugaaugagugaauuaaggaggaaagcuuguuuggaaaugcuguauuuuauuaucugggaaucaaggaaauuccuuaaccuacauuaauggaaacaucuacaguucuucagaaaacaguauuaaguaacaggaggguuuccauaaucacugaugauauaccacaauggauugacagcaaucuaucccuacaaagaacugugagacagucucaaaaguauuuuuaaaagguagaauauggaauucccuaguacacuuccugguacugcacugacaacaugccccaauucuuucuggauuggguaccacaaaggaggauguugcccuuauaaucacugcugagaccagaucugugagugccaaagagagagcaaggucacuaacaagaagcacaggacuucacuugcagcuucuacugugacgucacgcauucaacaugaugcaacaaguggagggaugucuugacaguacagagacacugcuuuccugaucccaccucucugguaaccauuuuuugcucaugucaauauuacacaugaacaauaacaaccauaauaaaggcacaacuuuaaaagcaaucuaagagacuaagaaaaagugagaagaacaaaaugauuccuuuaauaaauagcauaacauugagauuucuuguggaugccagcgaaacagaugcaugguuuaaguaaaucaaacagaauuagaaauaaaggcagguaaaaccaaauaucacauggaaaaaugagcaauugcacuguuaaaaauuaucaaaaagauauuuuuuaaaaagauuaaagcauauaaaugaugcucccuacuuuauuuuuaaacauguauuaacauauccauauuugaauuuuuucaccaacauuuuuggauacaggagacuagguucguacagagaacaguauuagccuauuaucuacuuacacauucccacgaugcuuaucuacacagcauacagaacggauaaacacaacuccuaauaaaacaaaggcaugcacacagaaugcuuccauuccacguaagcacugacugauaugcacucaaagacaaccugauaagagcaaagcuuugcuuguuuaggugaaugagguaugugagcaucacgugccaaagaacuaugcugaaggcaaacaagaagagccucaaaacuccuaagaucuaagcuuuggugaggcaaaaaggauaaaagaaaaaaaaaauagauagaaagcaauggaggaguggagaagggaggcucuggaaaaaaauggauagauagguuaguacagggaggaaggagcagcagauaagcuaaaaggcacagagucagggguggcacaaugggugagcuuucuuugugggaaaugagcuacugagauugcccccucugguaucaccauccugugagacccuagcaguagugauaguucuggaagcaugcuacucugcagaaagacccagcaucauuuucuucauccucccugaacucacaagaguaauggcccuugcaccuaggaauauuuccuguagacaagaacucuuuccuuccugaagauauaauacagguccacaguaccuuacuagcaauucuaaaaucgaaagaguuccaaaaauaugaaguuuucuguaacccucugguagcaaaaucugaccugaccugagcugcuauaaaauuguagucuauuuaucccacagaguaugccaauucauacuucuggcugcagaaauauuaaugugcuugauucuagaagcugccccagucucugcuggggguauuauguuacauauggcauagacauaguuuaaauaugcuguuuauagauacugauaucaccuuuccaacagcuaaaaagucugaauuguguacuauaaguuuccuaguuucagaugugauauuaacaucuuuaaauauaagaaaaggugaauauuuaccaaagagaauaaauguaaucagagacauaggcucaauccuagguggcauuggcacccuacuagaugcuggaaauauacagaagguaauggacaugaucccugucccuuaggaccucaugaucuggugggaaagacagauguuuaaacaaaguuuugaacuacaaccuggcaugcuagacauacaaaggagccaaguaccccgagagcagagguuguggucaagccuuggaaaggcuccacugagcagauucaucaaaguuagcucuaaaggaugcugcugacuucacucuccuaagggcagaucuucacccaugauaucccuugccagauuuuuaucuagaacauucuccuaaucuuucauuaauuucaaaggugagauaaugugauagguugauacaaugcaauauuuugcaauuugaaagcaaagcccuaugguuuggaagagauucgaaaugagacucucucuuucaaaggccucauucuaggacaaguguuuuccuucauuaccaacaauuuuaacuuuaaucauuucaaagcaauuuuccuguucaagacucagcuuuaaucagaaugcauuuucaggucacuccauagccucuucaugcuucucucuagauaacuacagaaucaugcauaaucauucuaguccccccaagacacccucaguaaguucaacauuuuaugcaaaaauagauacaaaacaggccuccggggguaucuccagcuaauuuucaugaauuaauuucccaggauugauguuuaugcaccagucucuuuaccacauaaucaaaucacuggaguugaaguggucuaacuccuuauuuugcagcuugauuaagcaggugaugaaauacuugaauauaauuuggauaguuaacagcucacacuauucaacaauaauccaagguggauggaugacauuaccaaccgaugucucauuguuugcuuguuuuccuucuaguagcugacgucccacauguuauuuuuauguuggagauaaaacaguucauauauauacaugaguggagaggugugaaaggcuuuaauauugaugauguuguuuuaaaccacauuuagaccaacugggcaggcagccaccgagacagacuagauugccauugguuaagagaggauuugggaugacaacguaucugguacccacugccaaucccgcugcuguggugaaugcagcuauuccucugcugggguuaccucuguucaucuggguggcuaucuggcuuccagccucuaucuaaacaucucccucuacuucccuuuccucuuuugucucuacuuucaaaauaaaaggagagaggcuuagaaaauaaacaaccagaaaugaaagaagauaaauaaaaguaacaacuacaaagaccaagauaguugcugugacuagcaccauaucuggugcuaugugaagaagacaacaggcugacuuacacagcucucauaugagaggacacuucacauuuuuaaagagagacuaacauuuucucugauuuaauuuuugcaauacaauucuaacauagggucuaguacaggacacucuaaguaucauaacgaacaauauucacacauuacguuuccccaaaaaaggcagaaacagaguucaaguugcuggcaauuuggugaauauuauuuugcaugagacuaaggugacuuggucuucuauguaaucuucuagucaccuaauuuauuccaaugauaagaacuuagauuacacagaaguuuagauagguaggacgcccuuaacauuaucuuuguucauuauaauuuuucucaaccguguuuuucauauauaagaucuguucuaaguuguuuguggccagagacaauuccugauuccaaacuauugcuacaugucugcaagugaaugaugagcuagaugagugauccacuccacucugccugucuccucacccuagaaugacacuucgaguggucagagcuauaacugccguucuuaauuuacaccagaaaauccagaaaauuguguuguugaagacaaaauaaagcauaauaaaagguaauggaaaaaguggucuaaacccgagaaaaacugacuucucaagaagaaacagaucuagcaugugcuugaaguuuuaaaugugcacauggugaaggaagauuuaccucacugagaucauuacaggugugggcauggcacaauuggcaacaccagucuuaauaauggcugccugucuguccaagugucugugaaaauaaaugucuucuucuauugccuacuccuccagcaaaaugauccagauauuccuuuucuccacucccagcagcuaggcggaagcaccugaccugggcccagccaaucagaugcccacaccuaggaccaugaacaugaaaggagugaugugaagacacagaaacagagauuacuggcagagacaugagugccagaaaguguccagaaacaccaaucgccauccucccugccuugcucuuguggaguggcauaggggugugcuguguuccuagcugugaaauucccaagccuaguuuucguugcaauuuuucuguaagcuggccaauauucuucuaauugcaucuuuucuucuaaaauuaguaaggauuaaaaaaaaaaacacaaaacaaagugagaauggguuuggguugguaggcugauguggaaauacuggugaaagaauaauguuuauaaggagauuagaaauuaacucuaauuccuaauuccacaggugggaaaacugaggcccagaaaugcuacccagaucacucaguuagcuagagauggaacuucaaaaccuauuacuggcucuuaauuugaagcccuuuucacuauaccgaucagugaaaugagguauagaacccuagaaauuguaauuuuguuaagggcccugaauccaugcuuucuacaccugcuuuuacccuagggaaaagugaggucuuucauuuucugcagaaaaaaacaaacauugcacaugaagguuuguacacagccaugccacucuguuuuggaauuguucugacuuguagcagcagggcaugucacaagccacugggcuguaaggaacacuugcugagggcaacaagaaaacuagugauuauuacaguaacuuggcuacaucaaugugcauaaaaggcccugaaaaauaaagaaaugugguuacucuuuuuacucaacacaacagauaugcaaaggccuacuacaugcaaagcacacugcaagguguucuauuucauaaauguaccaagcugugugagacacagaaucaggccuuaaaaggcuuauaauucacagaggaggaugguugucauaagcuugacccaugcaauguguuuggcagaaguggagaagagguuguaggaauugagaguaaucuagugaguaauucaagccauugaaggaucaggaagagagacagguucucauuggggaaacgaccucugaccucaaucugaagaaaaaaaaauggcaagagaguggucagcaagagaacagucaggaguucuugugauguugcugacaaaagauauaaucaugcauaggaaaagaagaaagaaaaauguguugagauugaaauccaacuuuccuaguguggcauccaggcccuucauaaauguuccucuguucuguuucauuucucagcacucaucagcuuguaguccgaaucacucuuaugccuccuugaaaacucucagaucucucacagcacacucugaucucucacagcucuggacauuuguacauacuuuuguuucugccuccuggaaggcuuucucuugcucuuuaccuugauaacuccucuugaccuuuccacacagugccuacaugccaccuccuucuggaaggcuuccaugaccucuucccaguuucaacagcuugugaauaauucuaacuaauaauuaucauacugggcagugauggucuauuuaguucuuucucucuaccacuugugagcuucuugaagcaggcacugucucguauuccaaauacaugauauaaaauggaaagaugcucaaaaaaguuugucaguugauuagaugaauaaaugaaacuggagaaaauguagauuggacacaacucagcaacugauuggauaugggagcugagaaaagaacaaggugauggggggaugaucauugcuucucacccgccuggaaagaugguaaugccaugaacagucacgggaucacaguacaaggagcagauaugggaaaugaugaauucaguuuuguauuauugaaucugagaguccuauugaaugccacagaagauaccuugcaugugguugaaaauucugugcaagaguucaggcaagggugugaaguagaacuuagagauucaggaguuacccaguugcacccaugggaacacagugcucacagagggaaagagaagaaagcaagagcacuaagggcagauaccugggggaacacagcauuucggaggcaaugcuagaaagcuacugacuauaugcaagaaucaauaaacuugcuugaguaacacauccacccuuaaaccagagcucaugagacuuauguacaaguagagaagcauugcucugcuuauaaaaagggggccauugagauuagugcacaacaaaauacaucagauaagaugagugggggaaauacuucuaacaucaccuuuaaaacugcagcuauuuggguuuuuuuauugcugaauuuauagaacauauaaaguucuagauaauaccucuuaaaauccugaaacuuauguucagguagugcaguuauacaucuguuuauaugcauaugacucauauacauuaaauauauaauguaaaaccucucaguagcuuaauuaaaauaucuccucuaauggaaauaaacguuguuacuuuaugaacauuuugcuuucagaaggguaaaugcaauacuuuauauaauuuuuagcugacuuuuaaaugaauuucacaagcuuuuaauaccacuuuggucagaaaaaaacuuuuguuuagugaaacaaagaugcuaccaaaaguggcuaauauguaucauuucugauaaauaauuguaaagcuuuuacuuuaaauauuaugaucuaucuguucacuuuuuaucaggucaacuaauaagcgaauuaaagcaaaagacaagaaauuuaaacuaucauacagauuuuugcuacuuuuauuuuuuguaaagacucaaucuguccucuucagaaaucaucuuguuaauaaagcauaguuugaaugacuaaaaaguaauguuacugugaucauguuaaaggcauauugguccaaugucaguccuaguauugacauuuagucccugaauauauagacuucauuguuguuacauuaggaaaaguuaaguuaauggagucauuccagcuuuguauacuuucuauugacucugugauuuuuuucuuuuucagauuugaguuccuacaaauaauaguuauuuugcuuuucuacuuugauuacaguaguuaauucagagaaaucuguuuagggucauucaacauucaaucaauaaacaugguggcagaaggccauggcugggaugcuuuguaagacauuugaauuuccauauacugaaauugcuaagaguaaauaacauggagucuuuugauuuugaaugugcacaguuauugucugaaaguuaauaguagauuauuuaaaguugaaauuuauaaaaugacagaugagccaugucaaauauaacauaguagcaauaaaauaaaacugguagagcuaccauaaaccagaagaaauuccucauggcuaacuauggacugacuacuugagagcaguuuauuuacaaaaauuuuuauauuccaagcuguuauuuccuaaaguagacugaacagcaauaagucuuaauucuuuuucguauguugauuauguauaugccagagaaaagguugaucauuuuaaugguagccuaaggcaaguauaaugacagagacaaauuaauuuuuuagagcaauguuauaaauuaccuugagauuacccucugguauggauuauauauaacuuuacuccacugacucagauaguucagugcuagcucuaauuuguaaauuuucuuaauuuacaauauaucacacaauuccauugugugauaaauuuugauugaucuuggucaggcaagcagaugagguugacuguuaaaacucuugaugcuuuauacaccuagggaucauguuaaauugucaaggguucagucugaagagugagguguguuagccccuguguaaaugaaaugcucacugcccuguggaaauuugggcugaugaugaagguuucacuuuauuuggcacugcuguccucgugcauguucugugcccucucccggugcuaagaaacugucaccaauccauuucccuaccaaaguggaauggaacaagauaugcgugcagcaacaggaguagaaccugcccugccuauggaugaagucuuuucacaaacacuucuggccacgcucaaccuacuguauccagugcuaccuggcauuugaaacaacaguuccaaauuuuccuuuuccuucaagugauuuuuaauuuuuuuuccaguuugcuuuucuacaucuccuuaaagcugaaaagacaacuucuucauuaucuuaaauaaauuuucauuaaggguugggggggaaggggaugucucaacucaaacuaauccaucggucaaauagagaauauugucucuaaucauaaaaaaauccugauaguucagcaucaauagugcagcauccaugcuccuggagcaccauaauguaaagacaguccaagaaacaggaguggagugagcaucagucacagaccacaaagagcgcaagcuuuggagucagaaaaccagguuuacuuugguaaguaacuuaacuucuuucauucuuccuuuucucauuguccaaugggaauaacaauaucaacucugcaagacugccacaagaauuaaaugguauaauuugcaaaucacuagcucagugcucugcuacauacuaacugcuauggcagccccauagaaagucagguacagauuaagccugauguacugcacaacaauaauaacaaggaauaagguguugaaaauagcugcauuauaucauaucccauuauuaacaguuaauggugcugaacuaggaguuaugcccuugagaaaaauuguauuugguuagcuggugauacuaguuuaugaugguuuauuguaaguauaaaaugauugcaaaauuuugucccaaccaauuuucuucuuagaaaaucuaucucuaauagcaauaaaaugugguugcuguuauguuucauuuuuuuuucugacacaaagcugggcuuugaaggagcuuuucuauauacuaagaugagcucaauaaaaauaaaauccuuuggauuaagguaacaucccuaugagaccuuugccucugguagaggcauuugcaguaaugaacaaaagaagaauggaagacuuccauuguugcuuuaaauuacaugugugacagaucacaaagaaauggcuuuuaguuaaaugagcaauauuuucuugguuuucucucagcucuucaauagcaguuaaaagguccauuggaaguaugaauuuuccuagcaaaauaacacugcauuauaaauguugccaguuucugaucacugacucauuccuuaaaccuugcuggcuucuguuuucacuaugugacagaacugcauucuuaaaagucaccaacaccuuccauggcuugucuuuagucuccaucucccucugcaaucuuuaacccugcugaucaguaccugcuaaaaagucuucucugcaaaagauaaguagcuacccuauuuaucuuccuagcacucugagcacauuauacaauuuugcugauuuauaauaaucccccuguuuccugaauguaccuauuucuugagguuugucuccucuguuuuuuugcucucuuuauauucuuucucuugguaaacucauccacaccauaguuucaacaccuaccacacugccaauaacccucaaauucguauuuccaguccuauccuuucuccugaucuccagaccugauuaucuucucaguggccagcuggacaaucccaacaggguaucccccucaguauacaaacaaaaugcagguaucacaccagaucauauucaguugucucaacugaguaucaugcccuggugucucgauuuugggaucucccuauugccugcuucaacuguaaccucagagccauaauuagaguucugucuuugcuucaccacccucauuucuaauuaguuuacagauuuuuucuugcuugaauccaucugcuccuuccauccucacugcccucaucaaggaacagguucugauuuccucuucccugaacgaacacaguaaccucaauacaaaacucuccaauuucaaccuuguuuuuccccaacugcuauacacacugguaccagauuaauuuucuaaaauuuggcuucaaucagaucauucccacgauuaacacacuucaaucauucuucacuuucuacuaauauaaagaaaagacgcauagccuggcauucaggaaccaucacaguauuaugcccaucuguccacuuuuucuuucuucucucuugauauuccucuaccacauacccugaacaaguuccauacaaguucuucagggugaauucagugcccaucaaaucuugagaacuucuucgcuaaaauacaaacaaacugaaauggucacaguguaaccagcaugguuacucuguauucauaacauuuugcccccuauuccuguuaaguauuauucuucaucaccaccuccaccaccucauucuacccaucucucaacauccaggaacauuguccguaaagcuuuuucauaaagcuuuuaaaaaaugacucucuucuacccccacuucuaucuaugucucucucaucagcuuauuuaucguuauuuauaugugcuaucuucugagaugucuauaagggccucaaaugcagaauccaugucuaagucaucuuuuuuguuuuuuaaaguacucaacauaacauauuauccauaguagacacucaaugaauacuuuauucauaaacaaauaaaagguuauaaauaaugacauucccuuagacaauacuuaggaaguucaggagggaacuucaaaaugugcauggcugacaaaagggaccuaugaauuaauuuuggcauuacauauauuuuauaacaaauuaguuuaaaauuuagaucuuaaugauuagaaauacacuuuuaaaagaauaaauuaaaaauguuacacuuuuugaugaaauagccaaagcauguguacguaaauaauucuacuuauuucuuuaugucaauaagcuaucuguggcagauuacauuuuucaaagagggccacaaaaauauaucccuacucacacacuuuucugugauguaaucuuuccacccacucaucucaagagguggagucuauuucuucaucugcuuguaucuggcuggggaugggucggugugacugcuuuguccaauucugggcauaauacuuaacuggccugguagcuuuugcucuuuggcucuuggaaaagagccaucauauaagaaguaugucuaugaaaucaucauacugugagaagcccaagccacacugacagucccuggagaagaaaugucacauggaaaucgagagacggaaaggugaaagaacaccgugguaccaaacaucugagugaagaagccauguuggaaguggauccucuaucaugagccacuccaguuuaugccaugugaauuggacacaaaccgcccagcugagcccuucugaaauuccugauuuguaaaauuguaagcaaaauaaaaguguugcuuuauaccacuaaguuugguguagcuuguuacuuagaaauagcucguggaaacacuacucaucaccaauuugaaccuguacaacuauguucacacaaaaacaaaaaugguaugacuacaaaacagacagcuaggaacaacaaacugcuauguuugugauuuaaauguucuaaacaaaaccaaauacuggccaauuuacuaauuccuuuaguccuuuccuuagcaaaaaauuaaucaauauaaaaauggauuaaauauauuuaauauuuuccaagucaagccuccaccacaaacgcauaagacuaaguuauaaaauaggcugaaaacuaccaaagaaacauaaguuaaaaaaaaacuaggacaaguuugcaaaaauguauucuggcaauguccauuauuaguuuacauaaauuaugauguauucuaauacugaaauucuacguagccaugaaaaaugaugauguagcuauacugacaauaaagauauauauaguauauuaaauguaaggagccaauuacaaaacugugaauagugaaaucuuauuugggacugcuuuuaaaaggauauguauuuguccuuucucucugucucucucuguauguauguauguauauacacauacauauaacauguguacauauguauacacacacacuuuuuuucuaucaaaaagaggucugaaaagauguacauaaacauuucauuaucuuuaggggguggaauuacaggucaucucuguuuucuucuuaagacuuuaaggcagugauucucaaaguguuguccugcaaccaacaaaaucaacaucaucugacaacuugcuagaaaugcaaauuugugggugucauccugggccuacugaucagaaacgcuggguguggaacuccgcauucugugguucaaacaggccuccaaggcaacacugauguaugcuaaagcuugcaaacaauggcuucaccacugaauuuuguaauuuuuaaaaaggaaauaugguauuuucucaguuaaaaaagugaguguguuuccuuuauaaagauuuuuaaugggaauuuuuuaaaaggagcaaagagaugauuagaguaguaugcacauguuauuuuuuccaucuauuuuccauuuuuuuauucuauucuccauauguuuuagcugcuauuagauauuuuuaaacucuuuaucucucuguaccuauucccaguuuguagacugucuuuuuacuucugucuaaucugccuguuuaaacuguccauugaguuuuaauuucaaacugcuauauuuuucauuucuaaaagucagcuuuuuucuuuuucaaauuuacuuuauuuucauaguuaccucuuuuuacuguaggguguauaccuucuccuuaauaauuguaaaggcacuuuuuaauuaguaucuuugagaucauccucaaaccccaaguuuucuguauccuaauuguuaugcuugucuuaucugcugccccuguuuuaugauauauguuuucaucauuuuguuugcaguguuuuauuuuaaacugcucuucagagaauuguuuuaucuguagaugucucaagagaggcuguggaaguauuucaacauagcagauuuguacuuauuuuugccagguaacaggaguuucucuggucuagaccaguuugugcucuaauuucucgguuuagaacuucaaccacaaugcauguaguguaaauucacaguauauaucuuuucucaugggaggcuuuuguauuauugucauucaaaguccugagacgaaaaaacuaguuuuguuguacauaggauaaaguuuccuuguaucuuggggaaaguuugcugcuuagccuuucacugaggggucaggacuuucagaguccaggccaggcuucuaucguggcacccacucaccccccaccucagacaaugccacaauuccuguccuaugacgcugggaccuguauccagucuaagaaucucccaaacugugacagcuucacauuuugagugcaucguucuuagcuucacgucuucuuuuuguuuccuccagaugaacuuucuuuucccucagguucaucuuuguauuuuguucagcauuuuuaagagcuuauggaaggaggaaauuucacuuuaguucagucugccauacugauggaaccuccacauuuccuuuaauguuguuaucuugcucuugcaauuaauuuuuuuaaaaaccucgguuguuggaaguuccagcuagagcaaucaggcaagagaaagagauaaagggcauccgaauugaaaaagggaaagucagacuaucucuauuugccgaugauaugaucauauaccuagaaaauccuaaagacuccuccaaaagacuccuacauuugauaaauaaauucgggaaagucucagguuacaaaaucaauauacacaaauugguaucacuguuauauaccaacagugaccuagcugagaaucaaaugaagaacucaaucacuuuuauaauugcuguaaaaacaaaccaauaaacgaauuuuaaaaaucuaggaauauacuuuaccaagaaggugaaagaucucuacaaggagaacuauaaaacacugcuaaaaaaaaaauagauaacacaaacaaauggaaauacauuucaugcucauggauuggaagaaucaauauggugaaagugaccauacugcccaaagcaaucuacagauugaaugcaauccacaucaaaauaccaacaucauuuuucacagaauuagaaaaaacaguccccaaauuaauauggaaccaaaaaagagcccaaauagccauaacaauccuaaacaaaaagaauaaaucuggaggcaucacauuacccaacuucaaauuauacuacaaggcuauaguaaccuuguaguagguacuuguauaaaaguagauacauagaccaauggaucagaauagagaacccagaaauaaagccaaaugcacccaucaaacugguccuugacaaagcauagaaaaacauaaauuggggaaaggacacccuaugucauaaguggugcuaagaaaacuguacagucaccuguagaagaaugaaacuggaucccuaucucuuaccauacacaaaaauaaacucaagauggacuaaagacuuagucuaagaccuacaacaauaaaaauucuagaagaaaacccaggaaaaacucucuggacauuggccuaggcaaagaauuuaugacuaagacaccuaaaggagauaaaacaaacauaaauaaaugaaaccuaauuaaacuaaacagcuucugcacagcaaaagaaauaaucauuagacuaaacagacaaaccacagaauaagaaaauauuugcgaacuacacaucugauaaaggacuaauauccauaaucuacaagaaacucaaacaaauuagcaagaaaaaaauaaaaaauccuauccaaaaagugggcaaaggacauggauagacauaucucaaaaaaagauaaacaaauggcugacaaacaugaaaaaaugcacaucacuaaucaucagggaaaugaaaauuaaaaccacaaugagauaucaccuuaccccagccaagauggccauuauuaaaaagucaaaaaacaauaaauguuggcauagaugugguaaaagagaaugcuuaucaacugauagugggaauguaaauuagugcaaccucuguggaaagcaguaugaagauuucucaaagaaauuaaaaguagauuuaccauucaauccagcagccccauuacuggguaucuauucgaaggaaaagaagucauuauaucaaaaagacaucugcauacaaauguuuaccacaacacaauucacaauugcaaagaaauggaaccaaccuaaaugcucauucaacacugaguggauaaagaaaaugcgguguguguaaacauacacacuccccccacaacacacacaccauggaauacuacucagccauaaaaaggaacaaaauaauaucuuuugcagcaacuuggaugaagcugaaggucauuaugugaagugaaguaacucuguaucucaggaauggaaaaccaaauaccauacguucucauucauaagugagagcuaagcuauggguaugcaaaggcauauagagugguauaauggaugcuggagacucaggagggggaauaaaugggaggagggugauggauaaaaaacugcauguuagguacaauauauacuacgcgggugacaguacacuaaaaucucagacuucacaacuacauaauucauucauguaaucaaaagccacuuguaccccuaaagcuauugaaauaaaaaaaaagcuuugcuugguaaaaaugggcucugcuaaauauaauaucucagauucaaaucuacacauuguuaaccauaacaguugcauuugauuucacugaaaauaaucuuuuacuaaagaaaauaaguuucaaacuucgccgauuauuuacaauuuguuauuuauuuauuuuugguauagauuauagcuguggggaaaaauagcucuuucuaggaggaauuacuauucagagcagucugaaccagugugaaaacugcuagaagcaggaaaucaaaauauuguuuauucucaugaaaggcaggagauuguauuagauacugcuaggcccaaugugacugcuaacuagaacacuaguaaucacucuauuagcugcaaaaaaucuucaacuguucagcaaugugguacagaggaaccagcccaguuuaagaagagggcuaagugcaguguuugugaaaaugcagcccaagccaucugcacaugaaucucccagggugcuccuuugaaucuucauuuuaaacaauucuuccuggugaugcaucuccauauucaaguuugagaucaacugguuaagugcauaaaagcaagcauuuugguaacaaaauacaaaucauauaacaaagaacugaaguuccguuugagacaaagaaugaaaaucaaguacaucuuacaugaguuacaugauauauacuaaauugucuacuucuuaagaagggcagagguuuuguguacucuaaugcugagugaucucccagcucuaagagaacaaccauauaggaaaaucgcaucugucucaaccacucuggucugagacacuaucaucuuauaccaggacuauuucauuagcccccuaaaugguuucaaaugucacaauggaaaagccuucuauguccuccacauuuaaaauagugccaucuagucuuuauagcacuuuucuccaggugacacauuacacaauauagacuuauucauuuguucucuaucuguauuuacucacuaggcuaugaaacuaugggaacaggacuuugcuuuguuaauugcuguauccugagugccuagaggacugucuuccaccuguaaaggcucaacaaacacuuccugaauaaauaagugaaagugcuuaaggaaggccucuccuccuucuggauuauuagagaggaugaagcuuuccuagagggaacaggaaaaaaauccauagacaccagaaaauaagauguguucugaguacagggcaaaccaaaccagugucaugaguuugauguagggaagaaccucacacaaagagaaagaaagaauuucaaagccccuggaacucuugcacugaaaucaguuuuguuuuguuguuguuguuguuaauaaaaggucaagcuagucuuucugggguacuugugguagcaauaaugcaagggaggcuauagagacccucgcaagugggaggccauguguuggugauggaugcuucccuucuuggggaacagaggggaccuucaucuuagagguucuauguuucccaccuggaaugaguaucccaaauacaagagauugcagauacuaccauuucugaugacuuggaagaaugauaaagucguaaaaaauaaagcaaucuuccugugaaauagacuugugaaacucugggauacauaaggauuaagucuuuuuauuucuuuuuccaauucaaguuuuuaccuuugaacaaagaaaaaaaaauaacauacaagugaauaguuggcuaaaaaagaauagacuagaauuuauuguucugggugaugacuuaugaucuuagaacaauuggauccugacagggagagagcacaaucuuaaagagaugaggaagaaaguguuuggcaucugugcccaccagaugaagauguuguaaaccuaaaugaaaucagauacaaaaaaagaacaauauacaugauacagaaaaagaacucuaauagaguccaguaagucucaggggaaaauuaaggaaaagaaaaaguaauauuuagguccuuaauugccuuugagacacagucuaaguucugacacaaaggaguaaaugugauuucuuggcaauuauuaaggcuuucugagaagguacucaggucugaagaugcaauugacugaggcauagugaaacagagagagcgagagaaagaggaggagagagagagagauagagcgaauuuggugguuccucaaaaaguuaaacauagaauuuauauaugaucgagcaauuucacuccuagguauauaucaagaauugaaaacagacucaaacaaauacuugaaccugcauguucauaguagcacuguuuacaauaguuaaaagugacuggauggguggauaacugaaaugugauauauaucuaucuauaucuauauaugcaaaagauuauucaucuauaaaaaaaaugaaauacugauaaaugaacauggauaaaccuugaaagcgucguguuaagugaaagagcuggacacaaaaggucauauauuguaugauuccauugauaugaaauauccauaauagggaaauccacagagauagaauguacauuggucauugccagggggugugaggauagggaaauggggaguaauuuguuaacagauaagagguuuccuuugggguaaugaaaauauuuuggaaguagacauagugguuguaccgcaucauaaaaauguuugaugacacagaauuguucacuuuuuauuguuugucuguuuauugagacagggucuugcucuguugcccaggcuguaguacaguggcacaauuguggcucacugcagucucaaccuucuggguucaagcuguccccccgccuuagccucccaaguggcugggaucauaugugaaugccaccacccccagcuaauuuuuaaauuuuuuguagagacagggucuugccauguuucccaggcuagucucggacuccugggcucaagcaauccucccaccucagccucccaaagugcugggauuacaggcauguaauccacugugcccagccagaaauguucacuuaaaguggauaauuuuauguuauuugaauuuccccucaauaaugagaauaauaaagauagucucaaagguuaaaaaaauuaauugaauuuuuaaaaagauagaagcgggagggcagggaaggggagaguagaggagggagcggcagucccugauagaaaaggauaugcuucuagaacagcccaaaccucagggcagcagcauaauguagggugcuuccugagacuaauaguguagagagacaccaaagcaacagaauucugaaaggaagacucagacagccuaguccgacagaccauuaagaaugauagucuccaauuaaggaggcagagcacagagacaaaagaugaaugacagauuccacagaggacauaugcugugggaacugcacagguuaauaaacugaagucuuugucuccaaaagcuaacacucuaauacagcugugacuuucagaggacggccuuuugccaugauagagguaaauguacaugucaggaucauucagaagaaagagaaaccacuuuucaaaaguggaaacaguaaaagcuccauaaacauuugcaccaucucuuacugagugauugcagaguagggugaaugaaaagagggaaaagcacaugaagacacagggcaugucacaugcaugaagggguuccauaagcaguaaggcuggcaaggaggacucuguccagacugguaccugaaugccaggcuaacaaaucuggacuguauuuaucagcuaauagagaagcauggagguuucuaaguagugagugacaugagauuugcuuugggaaaauuauucuggcagguauguguaagaagaaaaauggacuaccagcagggagagcacuuagaaauagacucaguauuccagguaagagggaauaaguaucugcacugagacauuccuuuuucucuuuuuuuuuuuuuuuuuuugagacagagucuugcucuguugcccaggcuggaauguaaugguacgaucucggcccaccgcaaucucggccucccagguucaagcgauucuccugccucagccuccugaguaggugggauuacaggcaccugccaccaugcccggcugauuuuuguauuuuuaguagagacggguuucaccauguuggccaggcuggucucaaacuccugaccucagguaauccgcaaaccucagccucccagaaugcuaggauuauaggcgugagccacugcacccaggcuugcauugagacauuucugugguaugagaguaaagggacagauaaaauggguaucggaaagcucacuggaaguagaagacaaagagaauaagaauuugauuggggggacggauggguaauuaugucauuaguuaaaaaaaguagcacagaugaguuccauuugacauauauuguguuucaaaugggcaggaagauccagguggagggcucaauaaacagcaauaaagccugaggagagauaagaagugcaggagacauccuuaaagguaugagggucgaaauucgauucaaguuuguuaugcagauggucugugagcacuuggggaaaugaagagaaaucaaccagaagcaaaccugaguuugcugccaacuaguuaugccaaauuaaccucaauuccuuugugaugagguaccuagacucacaaucagggaagcguuuugacauggcauaucuugauuucagcuaaacaugugacaguaucucaugauauccuuaugacuaaaauggaagcaugcuggguacaaaaacagauauagauggauucagaguuaauugacuaaucauagcugaaacacauugauuaccacagcauugcugaccugaacacaaauacaggagaaccuaaaaaauauuaacuuuauacucaaauguuuauacccuuaaaaagaauggcuaauuuaccucacugaguaguugaaggaaucuccaauagaaucacaacaaauuauuuuguugguuuacaguguuauucaugguuuggaauuuuaacuaacagugaccacagaaagaauucuuggcuugucaugguggcacacgccuguuaucccagcacuuugggaggcugaggugggaggauuacuugagccaggaguuugagaccagccugcacaacauagugagauccugucucuacaaaaaauuagcuggcugugguggugcgggcuguagucccaguuauuugggaggcugauuugggaagaucacuuaagcccagaaguucaaggcagcaguuagcugugaucaugccacugcaccccagccuuggcaacagagugagacccuaucucuaagaaauaaaaauaaaaaaauaauucuuaagacauuaucucaaaagaauaagcuagaauuacuugugcacauuauuuggaaggaaauggcuaaagauggcauguugucuuuguguaauguauacauguaagauucccuauuuaauaguuugagagacuuaaauauuuuauugcuaaaauacuaugguuaaauauacaugucacuaaaugcuaauaucugucaaaacauucauuauaaaaaauugucuuuugacauuuuaagguaucaccaauuuccauuugaagaauuuaucauuaaaauuucauggggaggcagcagggccugggaauuaaauaugguacaagaugccacagacugaguuucuacccaaacucuccaccauagucacugacuauguacuagcagaaagagucuauauggaauuguaaaauacacugaaauuacaguguuugaaaagugccuaagauaauguguucucugaaaagagaaaucaaucauguauaacuguuaccuacuggaauaaauaggcuuagucacuacucagaccuuaauguuaucucaguauacaauguaauuuaauauuaucccuuaauaauaauacuuaaguagcugcccgugaauauaugagccuuauuauuucauuguaauucaaccaguagcauccagaauuguaaaaggacagguggauggaugaauggagcgaugagagaauacccuccccucuaccuaccacugccuuccucuuucauccuuucuagaauucagaagugauggcuggagcucagcagcagccauagaaacugacauauaaacuuuagaagccuuuaggacuaaaaguucaugcuccaaggauggcagggcuggaagacaggaggagcucugggccucuuaagagugggagaaagccaaauggauuucguuacaugcaguuaaauuuagccccaaccaauacacacuauguguccaguauucaccuuaucuuuccaccacaucauuugagucaucacuugcaagucuuucaaaaguuuucauaaauauuaaaguacagaaagacaucaacacaugccuugauagucuauggccuuguguccaucuggaugcuuuaagaaauauuuugaauucuuauuuuuuaaguaaaugcuaacgacaugguaaucguuuuuauagauuuccaaugaagggugaggugcuuugacagcugucagcggagugucaaacagacuguggcagugaaagaugaggagauuuaaaagccuuuauucuuaguggccuuaauuucaucugauacuaaguagcuaaaacuuggcauccacugaggaaaaguguuauucuuccccauaacuccucuaccuauucuuucuucccugccucagauuucccaagcuucucucaguuguguucagaguuggccccaguuuaagauaugaugcugcccuagacuaugugacaaccucaacugaaucucuaaguaccuauccuuucuaauaucucauuuaaugguacccagaauauuaagucauauuaggacaaagagccuaugaugccuaggaaguuacugggcuugcucggugugguugaaggaauucugagauggucccugugauuuccacccacugaauauagcuccccucuccuugaguacagguagaaccugugacuugauucuaaccaauagaagacagaaauggugaaggaggccaggagcaguggcucgcgccuuaauuccagcacuuugggaggccgaggcgggcggaucaucugaggucaggaguucgagaccagccuggucaacauggagaaaccucaucucuacuaaaaauacaaaaauuagcugggcaugguggugcgcaccuguaaucccagcuggggaggcugaggcaggagaaucacuugaacccaggaggcgaagguugcagugagcugagauugcaccacugcacuucagucugggugacugagacucuaccucaaaaaaaaaaaaaaaauaaggugaaagaauaucccucucaugauuauauuguuacauuacgugagucugucuuagcagucugagugugagggccuugaagaagaaaaaaaccauguuauaagcagccuacagaaagcaucucaugguaaagaccuaaaggcagucucuaaguccccagacuguaaaaagccagggcccucucuuauacaguccauagccccaaagaaaugaauucuuccaauaaccuaaauaagcuuggaaauggauucuucccuggucaagccucuggauaacaacacagcccaguugacacuuugauuauagccuugugagacacggagcagaggacccaacuaagucagccaugauuccugacccacagaauugugagauaguaaauacggcucguuucaagccacuacguuugugguaauuugugaggcaucacaaaaaaacuaacaccccguaagccucccuugcuuucaccugaucugggacccauugccccaguguugguuuuuucacuuaauugaagccauucugaaucucaggagcucuaguccacagcacugaaguuucagcuuuggucauuuuucuuucaaagcaccacuacuugccaccaucccaaacccgcauauacugccuuguagauuuuaccuugcuuuggugaaucucauuuuuccaaauauucaggccguaacuacugcaauccccguaguccucacaaagauuggcacaaauacuguuugaccaguagucagauauuacccauagccaggucuccuggucaauaaccuccugccagccuagauuccccaaaauauuuccccaacacucuggcaucuccagugcuuugcaucacuaccucucaccuuaucagaagcucuccaguguucauggguuuaccugaacucuaacuugagguuagcaucuguuggauauuggacuuucuuaccuggucauuuccuucaauuuugccuuucuuauacauuucaaaaccaaaacagaacuccacucauuaauucuaagaaauaaaagcaaauucaguauuaaaugcuuauuaauguggccaugauacuaguauuccuauguacugauauaguauguauaauuuaauuuuguauguguucaauuuuggggaaacuggaaugcacuauaacaucaaaugaauauuugcaguauauuuauauccauuuuauagauuuugcaacagcuuuuucaaaaacagauauaaauuauuuuuaacagaccuaaauuauuaugaaggguuacaguuaaggaaucuguuuuguuuuaugacauguuguacacauauuuuacacauaucacacuucuguuauacaugaggcgaucuugaauaggccauucugaaaugaccauuuauuacaaaauucauacagaaaaaauauuauucacccuaaccuaucauaguguaguuuuuagaaaugaacugcagugaaaauggaauauuuacuauaucauauauaaugcaguauauauuauagcauuuacugccccuaauagcaaauuacuaucacuuuuagcaauaauagcuagcaucuaccaacuauuuagugcuuacuaagugucaagcauuauuuuaaaugcuuuacauauauuaucucauuaaaucuugggaaacaugacaaaagaauuuuuuuuuuaauuuuuguuuuuuuagauggaguuucuuguugcccaggcuggaguacaaugacgcaaucucggcucacuacaaucucugccucccagguucgagcgauucuccugccucagccuccugaguagcugggauuauaggugugcaccaccaagcccagcuaauuuuuuuauauuuuauugguagagacaggguuucgccauguuggccaggcuggucucaaacuccugaccucaggugauccgccugccuuggccucccaaaaugcuggaacuacaggugugagccaccgugcccagacgacaaaagaauuauuaaucccauuuuaaagaugagaaacuagauuaaagacacuagauaaauuuuuaaagaucacaaaauugcaaaccaggauuuaaacucaggcugcucuaacaccagauuuccuauccuauuacgguauauuagcucuaauuugauuucuauauguguauagucaaauaaauuguguugcugaaugguuuccuuuuuuuuauuuuuauuuuuuuucuugagacagugucucacucugucaucuagacuggagugcagugacaugcucacugcagccucgaccucccaggcucaagcaauccuucuaccucagccucccuagcugguaggacuacaggugcaugccucuaucccagcuaauuuuuuuuuuuguauguuuuguagagacggauuuucaccguguugcccaggcugaucucgaacuccuggacucaagugauccaccugcuuaggccucccaaagugcugggauuauaagugugggccacuacacuuggccccugaaugguuucuaaaaucuuguugaacggucgcacuugugacaaauuuggaauacaaauuuggauuuuauuuuggcucauauauuauuuggcuuuaauguauauacauauacauguucacagaaauuuuugaauaagugguuacuuaugaacaaaaagaaaaacuaaauauaaaauagacaauacuuucagggcaauggcuaacauuaaccaugaauauuaauauuaagaucuuagugccugcaauuacacugaauuuguaaaccaaaucauggauaacugacaucuuaacaauauggagcuuugcuauccaagaacacgguauauuuuccaauuuauuuaggucuuuaauuucuuucaacaauguuuuguaguucucagaauguauugcacauauuuuguuaaauucaucccuuaguuuuucaagguuuuaaugcuauuauaaauaauaugauuuaacauuuucaauuuucaauuguuuauugcuaguauagagaaacaaauuaauuuuuuuguauauugaccuguacucuucaacuuuacuaaacuuacauauuaguucuaguauuuuuuaaauaaauuccuuaauauuuucuacauguacaaucauguuuuuaaaacuuuuacuuuucacuuccuaaucuguauucucucucauuucuuuuucuuguuguacuguacggucuaaaaccuucaguacaacacugaauuaaaguaaugagaucagauagcuuuaccugguuuucuguuucagaaagaaaucauuuaugaugcuuuauagccaugaaguccuuuauaauuuaugaaagcaucaugauuaacuauaauguugcuguagguuuuuauagguaccuuuuucagaaugcggaaguucccuuauaugcccaguuuucucagaauuuuuauuaugaauagauauugaguuuuuucaaaugcuuuuucugcaucaguugaaauuaucuuaugguuuugcuuucucauuauguuaauauaaguuacacugacuuuugaaaguuaaacacccuugcauuccagagauaauccccauuugguaacaacauauuauccuuuuuuuuaauguauuguuggaaucaaucugcuaauauuuucauaaggaucuuugugucuaccuucacuggaguauugguauguaguuuuuuuuucuuguauugcuuuuguuuaguucagaugucaagccaauucuuggcuuaucaaaugaguuagggaguucuccacaauuucuacuuuauuucccuacauacucaucucucagagauaauuccuuuuacucaguuuuucgaaaccucaguuuguagcucauuuauauuuuaaaauagauaaauauacaaaaucaguuugccuuguagaaauaauguuguagaaguaugagcuaugaaaagcaauggggaacaaagaaauucacaguaucauuggaagcagaauacuguguucagaaaacaaaacauugauguuugcaaauaggucucugugugaugaagaauacugcuuauauaaugacuagguuucaaaauaaaaugugcaacauauucaaaaucuuacggaauuguaaucauguagaaaauaauaguuuucuaauugcucuuaagagaauaauuuuuuuuuuuuuugagauggagucuugcucuaucgcccaggcuggagugcaguggugugaucugggcucacugcaagcuccaccucccggguucaugccauucuucugccucagccucccgaguagcugggacuacaggagccugccaccacacccggcuaauuuuuuuuguauuuuuaguagagacaggguuucaccguguuagccaggauggucuugaucuccugaccucaugauccacccgccuuggccucccaaagugcuggcaagaggggauuuuuaaggcuuuaugaguuacuuaccaaauuccuaauauucucaauugauuuuauaauuucuaaggaaaauugucaacauaacuauauuuguuaaccaugcacaguggggaaaaaucgccaauuuaaugugugaauaacaaccuccagauugcugaauaagaaaaauugagccuaaguuacuuuagguugaauaauuucccuuaggaauaucacuccuuccuaacauuuccaaauuucucuuacaauacugucacaccuauuaaacaaugcaacuuuccaaugcaugauguaacuauaagcuauucugagcaauauuuguaguucucuugucuuaauugcugagacucuaucguaaccauuuuguuauguggugaauucugcaucaaggagaagcacuucuguggcagugcugccucaaacugcccuaccagaagucaggugacaauauggaacauuagacugcaugguaagcuauucauuagacuguuaacuuugucugacccaguuugucaaguguuuguguucuaaaugucaauuccuacucaccugguuuugcuagacuaauaagaaauuaccuuuuccaaagaaaagagaagaaaguaagacuaucaggaaaaguaaacucagaagucucuugggggaagaauuaaguacuggugagaaucaucuuaauuacccaguugggagguuagugagacucuuucuucauccuguuugucuaauacuaccccucauuuuaaacuuggcuacuuacccucaucccacagcauaugccaaaucuaagaaaacuuuccagcaaagcauuuucuuagaccagaugaaaucaccucuguuugaaaaaagucaauucauauuauauaacugaaugauaaaaaguuagucaucauuuuuauauaugaucagcucauuauuauuauuuccaccagaaauaaucauagaaaauuaaaaggagauuaaacuggaagcuuacuaucaaugucauaagagauuagugauggaggaauuuacagcuacuaagaagagaguuuaaaaugaucuauaaaugucuuucauucaugaugauccauuaccaaagauaaucaagaguuggcuaaaauaccuccaaaaccucaucaaacaguuauauuagaggaaagagacugauaguuucuaguauacuagaauguuuuaggugaacaaagaguaaacacaugauuaugucucagaccaaaaaacaaugugcaacuuuaaauguacugcauagcacuuuccuuauuuacuaugaaacauaucugcuugcugugaacugauuuguccaaccccuaagagguaguuccccagguaaugaauuuugccaacauaauaaaagauuauaugaaacgucuugaaauuaauccaaaggaugaagcaggucaaaauauuucaucucauaaguuuuaacuuuuaugucagugcagucauuuuuuuaaauaauuucaacuuuuauuuuagauucaggugguacauauaaaugcuucuuacauggguguauugcaugaugcugagguuugggauaugaaugaccugucacccagauaacacuaucugggugcauaguacccaaaaguuaguuuuucaacccuuccuuccccucccuuucccccuucuauuaguccccagugucuauucuugccaucuuuaugucacuuauaagugagaacaggcgauauuugguuuucuguuccuguauuaauuugcuuagaauaauggccuccagcugcauccauguugcugcaaaggacaugauuucauucuuuuuauggcugcguaguauuccaugguguauauguacuacauuuucuuuauccuaugcaucauugaugggcaccuagguugauuccuucucuuugcuauugugaauagcacugugaugaauauacaagugcacaugucuuuuugguagaaugauuuauuuucuucuagauauauacccaguaauaggauuacugggucaaaugguaguacuguauuuuagagauggggucuuacucugucauuuaagcuggagugcaguggugcaauccuggcucacugcagcuuugaaccccugggcucaagggauccuucugccucagccucccaaguagcugggacuaugagcaugugccaccaugcccagcuaauuuccuuauuauguuguagagaugaggucuagccaucuugccaaggcuggucuugaacuccagggccccagcaauccuuccaccuugguuucccaaagugcugggauuacaggcaugagccacuauguccagcaguaguucuaaguucuuugagaaauauccaaacugcuuuccacagcagcugaacucauuuacauuaccaccaacaguguauaagcauugccuuuacucugcagccucaccagcaucuguuguuugacuucacaauaauaaccauuuugacuggugugagaugauaucucacugugguuuugaugugcauuucucugaugacuggugaugcugagcauuuuuucaugcuuguuggcuacuuguaugucuucuuucaagaaguguccaugucuuuugcccacuuuuuaaugggguuguuuuugcuuguugauuuccuuaaguuccuuauagauucugaauauuagaucuuugucaggugcauagguugugaauauuuucucuuauucuguagguugccugcuuacucuauugauaguuucuuuugcugugcagaugcuccuuaguuuaauuaggucccacucgucaauuuuuguuuuugcuguaauuuuuuugaggacuuggucauaaauucuuucccaagguugauacccagaaugauguuuccuuggcuuucuucuaggauuuuuacaguuugagguguuacacuuaaauuuuuuuuuuuaauuuuuuuuuuuuuauuauacucuaaguuuuaggguacaugugcacauugugcagguuaguuacguauguauacaugugccaugcuggugcgcugcacccacuaacgagucaucuagcauuagguauaucucccaaugcuaucccuccccccucccccgaccccaccacaguccccagagugugauauuccccuuccuguguccaugugaucucauuguucaauucccaccuaugagugagaauaugcgguguuugguuuuuuguucuugcgauaguuuacugagaaugaugguuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauagugccgcaauaaacauacgugugcaugugucuuuauagcagcaugauuuauaguccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagaugauaucucauagugguuuugauuugcauuucucugauggccagugaugaugagcauuucuucauguguuuuuuggcugcauaaaugucuucuuuugagaagugucuguucauguccuucgcccacuuuuugaugggguuguuuguuuuuuucuuguaaauuuguuugaguucauuguagauucuggauauuagcccuuugucagaugaguagguugcgaaaauuuucucccauguuguagguugccuguucacucugaugguaguuucuuuugcugugcagaagcucuuuaguuuaauuagaucccauuugucaauuuuggcuuuuguugccauugcuuuugguguuuuggacaugaaguccuugcccacgccuauguccugaaugguaaugccuagguuuucuucuaggguuuuuaugguuuuaggucuaacguuuaaaucuuuaauccaucuugaauugauuuuuguauaagguguaaggaagggauccaguuucagcuuucuacauauggcuagccaguuuucccagcaccauuuauuaaauagggaauccuuuccccauugcuuguuuuucucagguuugucaaagaucagauaguuguagauaugcgucauuauuucugagggcucuguucuguuccauugaucuauaucucuguuuugguaccaguaccaugcuguuuugguuacuguagccuuguaguauaguuugaagucagguagugugaugccuccagcuuuguucuuuuggcuuaggauugacuuggcaaugcgggcucuuuuuugguuccauaugaacuuuaaaguaguuuuuuccaauucugugaagaaagucauugguagcuugauggggauggcauugaaucuguaaauuaccuugggcaguauggccauuuucacgauauugauucuuccuacccaugagcauggaauguucuuccauuuguuuguguccucuuuuauuuccuugagcagugguuuguaguucuccuugaagagguccuucacaucccuuguaaguuggauuccuagguauuuuauucucuuugaagcaauugugaaugggaguucacucaugauuuggcucucuguuugucuguuguugguguauaagaaugcuugugauuuuuguacauugauuuuguauccugagacuuugcugaaguugcuuaucagcuuaaggagauuuugggcugagacgaugggguuuucuagauaaacaaucauguugucugcaaacagggacaauuugacuucuucuuuuccuaauugaauacccuuuauuuccuucuccugccugauugcccuggccagaacuuccaacacuauguugaauaggagcggugagagagggcaucccugucuugugccgguuuucaaagggaaugcuuccaguuuuugcccauucaguaugauauuggcuguggguuugucauagauagcucuuauuauuuugaaauacgucccaucaauaccuaauuuauugagaguuuuuagcaugaaggguuguugaauuuugucaaaggcuuuuucugcaucuauugagauaaucaugugguuuuugucuuuggcucuguuuauaugcuggauuacauuuauugauuugcguauauugaaccagccuugcaucccagggaugaagcccacuugaucaugguggauaagcuuuuugaugugcugcuggauucgguuugccaguauuuuauugaggauuuuugcaucaauguucaucaaggauauuggucuaaaauucucuuuuuugguugugucucugcccggcuuugguaucagaaugaugcuggccucauaaaaugaguuagggaggauucccucuuuuucuauugauuggaauaguuucagaaggaaugguaccaguuccuccuuguaccucugguagaauucggcugugaauccaucugguccuggacucuuuuugguugguaaacuauugauuauugccacaauuucagagccuguuauuggucuauucagagauucaacuucuuccugguuuagucuugggagaguguaugugucgaggaauguauccauuucuucuggauuuucuaguuuauuugcguagagguguuuguaguauucucugaugguaguuuguauuucugugggaucgguggugauauccccuuuaucauuuuuuauugugucuauuugauucuucucucuuuuuuucuuuauuagucuugcuagcggucuaucaauuuuguugauccuuucaaaaaaccagcuccuggauucauugauuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuuguaggcauuuagugcuauaaauuucccucuacacacugcuuugaaugcgucccagagauucugguauguggugucuuuguucucguugguuucaaagaacaucuuuauuucugccuucauuucguuauguacccaguagucauucaggagcagguuguucaguuuccauguaguugagcggcuuugagugagauucuuaauccugaguucuaguuugauugcacuguggucugagagauaguuuguuauaauuucuguucuuuuacauuugcugaggagagcuuuacuuccaacuauguggucaauuuuggaauaggugugguguggugcugaaaaaaauguauauuuuguugauuugggguggagaguucuguagaugucuauuaggucugcuuggugcagagcugaguucaauuccuggguauccuuguugacuuucugucucguugaucugucuaauguugacagugggguguuaaagucucccauuauuaaugugugggagucuaagucucuuuguaggucacucaggacuugcuuuaugaaucugggugcuccuguauugggugcauauauauuuaggauaguuagcucuucuuguugaauugaucccuuuaccauuauguaauggccuucuuugucucuuuugaucuuuguugguuuaaagucuguuuuaucagagacuaggauugcaaccccugccuuuuuuuguuuuccauuggcuugguagaucuuccuccauccuuuuauuuugagccuaugugugucucugcacgugagauggguuuccugaauacaacacacugaugggucuugacucuuuauccaacuugccagucugugucuuuuaauugcagaauuuaguccauuuauauuuaaaguuaauauuguuaugugugaauuugauccugucauuaugauguuagcuggugauuuugcucauuaguugaugcaguuucuuccuagucucgauggucuuuacauuuuggcaugauuuugcagcggcugguaccgguuguuccuuuccauguuuagcgcuuccuucaggagcucuuuuagggcaggccugguggugacaaaaucucucagcauuugcuugucuguaaaguauuuuauuucuccuucacuuaugaagcuuaguuuggcuggauaugaaauucuggguugaaaauucuuuucuuuaagaauguugaauauuggcccccacucucuucuggcuuguaggguuucugccgagagauccgcuguuagucugaugggcuuuccuuugaggguaacccgaccuuucucucuggcugcccuuaacauuuuuuccuucauuucaacuuuggugaaucugacaauuaugugucuuggaguugcucuucucgaggaguaucuuuguggcguucucuguauuuccugaaucugaacguuggccugccuugcuagauuggggaaguucuccuggauaauauccugcagaguguuuuccaacuugguuccauucuccacaucacuuucagguacaccaaucagacguagauuuggucuuuucacauagucccauauuucuuggaggcuuugcucauuucuuuuuauucuuuuuucucuaaacuucccuucucgcuucauuucauucauuucaucuuccauugcugauacccuuucuuccaguugaucgcaucggcuccugaggcuucugcauucuucacguaguucucgagccuugguuuucagcuccaucagcuccuuuaagcacuucucuguauugguuauccuaguuauacauucuucuaaauuuuuuucaaaguuuucaacuucuuugccuuugguuugaauguccucccguagcucagaguauuuugaucgucugaagccuucuucucucagcucgucaaaaucauucuccauccagcuuuguucuguugcuggugaggaacugcguuccuuuggaggaggagaggcgcucugcguuuuagaguuuccaguuuuucuguuccguuuuuuccccaucuuugugguuuuaucuacuuuuggucuuugaugauggugaugaacagauggguuuucgguguagauguccuuucugguuguuaguuuuccuucuaagagacaggacccucagcugcaggucuguuggaauacccugcugugugaggugucagugugccccugcuggggggugccucccaguuaggcugcuugggggucaggggucagggacccacuugaggaggcagucugcccguucucagaucuccagcugcgugcugggagaaccacugcucucuucaaagcugucagacagggacacuuaagucugcagagguuacugcugucuuuuuguuugucugugcccugcccccagagguggagccuacagaggcaggcaggccuccuugagcuguggugggcuccacccaguucgagcuucccggcugcuuuguuuaccuaagcaagccugggcaacggcgggcgccccucccccagccucguugccgccuugcaguuugaucucagacugcugugcuagcaaucagugagauuccgugggcguaggacccuccgagccaggugugggauauagucucguggugcgccguuucuuaagccggucugaaaagcgcaauauucgggugggagugacccgauuuuccaggugcguccgucaccccuuucuuugacucggaaaggggacucccugaccccuugcgcuucccaggugaggcaaugccucacccugcuucggcucgcgcacagugcgcacacacacuggccugcgcacacugucuggcacucccuggugagaugaacccgguaccucagauggaaaugcagaaaucacccgucuucugcgucacucacgcugggagcuguagaccggagcuguuccuauucggccaucuucguaugacucuuguagauaaccuacacuuaaauuuuuaauccaucuugaguugauuuuguauauggugaaagguaaggguucaguuucuuucuuuugcauaugucuagccaguuaccccagcaccauuuauuuaauagggaguccuuuccccauugcuuauuuuuguuggguuugucaaagaucagauggcuguagguauacaguuugauuucuggguucucuauucuguuccauuggucuacaugucuguuuuuguacuaguaccaugcucuuuugguuacuguggacuuacauuacuaguuugaagucagguaaugugaugcgucugacuuuguucuuacagcuugggauuguuuuggcuauucgggcucuuuuucuguuuccauacgaauuuuaaaauagauuuuucugauucugugaaaaaugauauugguaguuugauaggaauaauacugaaucuguaaauugcuuugggcaguacgguauuuucaggauauuaauucuuccaaucaaugagcauaggauguuuuuccauuuguuugugucaucucucauuucuuuuagcaguguuuuauaguucuccuuguagagaucuucuaucgccuugguuggguguauuuuuagguguuuuuuuuuuuuuuuaguuuuuguuuguuuuuguuuugguguguggcuauuguaaaugggauuguguucuugcuugggcccucagcuugaauauuacuggugcacagaaauguuacugauuuuuggacauugauuuuguacucugaaacuuuauggaagucauuuaucaguuccaggaggcuuuaggguuuucuagguauacaaucauaucaucagugaaaagagaaguucgacuucuucuuuuccuauuuuggaugacuuuuauuucuuucuuuugccugauggcucuggcuaggaauuccaguacaauguugaacaggaguagugagaaugggcauccuugucuuguuccauuucucaaggggaaugccuccuguuuuuacucauucaguaugaugcugucugugggucugucauagauggcucauauuauuuugauguauuuuccuuuaaugccuaguuucuucaggguuuuucucaugaagagauguuggauuuuauugaaggcuuuuuccaaaucuauugagaugaucacaugguucuuuuuaauucuguugauguggugaaucacauuuauugacuugcguauguugaaccaaacuugcauccuaggaaugaagccuacuugauuguggugaauuaacuuuuugauacacuguuggauuuuguuugcuaguauuuuguugaggauuuuccaccuuaacauagauaagcauaggcaaugaguuucucagggauaauggccuaaaguuuucuuuuuucauugggucuuuaccagguuuugguaucaggaugaugcugguuucauagaaugaguuagggaagaauuccuccuccucaacuuccuuuuuuuaauaguuucaguacaauugguaccaggucuuacuuguaugacugauagaauuuggcugugaguccaucugguacagagcuuuguuuguuuguuuguuugcuuguuuguuuaggcagagucuugcucugucacccaggcuggagugcaguggugcgaucucggcucacuguaaccuccaccucccaggcucaagcgauucuccugccucagucucccacauagcugggauuacagguaccugccaccaugcccagcuaauuuuuguauuuuuaguagggacaggguuuugccauguuggucaggcaggucucgaacucgaccuuaagugaucugccugccucagccucccaaagugcugggauuacaggcgugaaccacugcauccagccucuggggcuuuuuuuaauuggccaauuuuuuguuacugauucaauuuuggaacuugauauuggucuguucaggguuucaauuucuuccuguuuucaauuucgggagguuguguguuuccaggaauuuauauacuuccuacagauuuucuaguuugugugcauauagguguucauauuugucucugaggaugcuuuauguuucugugggauguguuguaauggcacuuuuguuguuuccgauugugcuuauuuggaucuucucucuuuuuuucuuuguuaauuuagcuaacaguguauugcucuuguucauccuuuuaaagaaccaacuuuugguuuugugaauucuuuggauuuggggguuucaauugcuuucacuuucacgcugauuuuaguuauuucuuuucuuuugcuagcuuugggguucguuuguucuuauuuuucuaguuccuguaggugugauguuauaucauuaauuugaaauuauuuuuuacuuucugagguaggcauuuagugcuauaaacuuuccucuuaacacugcuuuugauacaucccagagauuuugguauguuguaucugguuuucauuuauuucaaauaauauuuugauuucugccuuaauuucauucuuuucccaaaaaucauucaggagcaaauuguuuaauuuccagguaauuuugucauuuugggagaucuucuugguacugauuucuauuuguauuccacuacggucugagaguauguucauaugauuucagcuuuuuugaauuuauuaagacuuuuuuguggucugucuuugagcauguucgggguguagaugaggagaauguguaggcugcgauugauggguugagcgcucuguagauguuuguuagguccaauuggucaaguaucaaacuuaaguuuaaaguuucuugguuaguuuucuaaccuaaccucaaugaucugucuaauacugucaaugggauguuaaagucucccacuauuacugaguagcuaucuaaguauuuuccuaagucuagaaguaguuguuuuaugaaucugggugcuccaauguugggugcuuauauauuuaggauagugaagucuucuugcugaauugaacccuucaucauuauguaaugcccuucuuuuuccuuuuuuccuguuguucauuuaaagucuguuuuaucugauacaagaauagugaccccugcuuuuuuuuguuuuccauuugcaugacagaucuuuucccaacccccaaaauaaaggguugggaaaagaucugucugucgugcaaauggaaggacuauggauauccuuagaggugagaugggucucuugaagagaggggauggaugguuuuucuuuucuaauucaaccuugcaacucugugccuuuuaaguggggugcauaaacuguuuacauucaagguuaauauugauaugugagguuuugauccuauaaugaaguuuguugguugguugcuuuguaguugcuauugugugguugcuuuauagggucugagggcuauguacguaaguguguuuuugugguagcagguaucuuucuuuuuguuuccaaguuuagaaccugcugaagggucucuuguaagacuugguguaauaguaacuaauucccuugcacuugcuuuucugaaaaagauuuuauuucuucuucacuuaugaagcuuaguuuggcaggauaugaaauucuuguuuggaauuucuuuucuuuaagaaugcugaaaauaggcaccuaaucucucuugucuuguaagauuucugcugagaaguuugcuguuagccugaugagguucucuuugcaugugaucagauagucacugcuuaaucccaguauuucugguaaagaaaggaauggugaacucugaaaagagugaaggguugucagaaauauuauggauaaaggauauauaaucugucaaagguuuugacuaauuaaauauggacuuccuauaugugauugaaagugagaaggaaaaauaaagucaaagcaauucucagguuucuaauaaaaaaugauaguguuagucacugaaacuggaaaccuaaaagaagaaguaagcauuuagaaauguggaauuacauuucaugauagaugucuggaaugaagaaauaucugaauguuauaagaauaugaggaauaagauaauuagaggauuuggguaagucuaccuaggagacaacuuggaaugaagaagaagguagcggauagagcauuacugucuggcaucaacuaaggguuuauuuuaacaaucaagagcauccaaguagacuauaaaggcucaguuuaaaacacaacucaagccgggcgugguggcacauggcuguaaucccagcacuuugggaggccgaggcgggcggaucaugaggucaggagauggagaccauccuggcuaauacggugaaaccccaucucuacuaaaaauacaaaaaaaauuagcgggugucuguagucccagcuacuugggaggcugaggcaggagaaaggcaugaacccaggaggcggagcuugcagugagcugagauugcgccacugcgcuccagccuggacaacagagcaagacuacgucucaaaacaaaacaaaacaaaacaaaaacaaaaacaacucaaaguguaagcacccaaagggaagguacuuguauugcuugccauuguauauauccauagcaccuauuacucuacuuggaacacaguacauggccauuuguuaaauaaaugaacaaacaaaccaagauagugauguuaugaaaaccaaaugcaaagggaguuucaagaagaaggaaucacuuauaguggcauuaagauguccuuggauuaggcaauuagaaagucauuaaaaaccucaugaugaauagcugcuguggaguuuuguugguagaacccagauugagauggauagaggagcaaauggauaaugaagcaguggagauguugaaaaccgcuuucaccuucaaaaauacugucaaagagcaggaauuauuaauagauaaaacuagaggaggaaguauuauugagaacacuuuuuguaaguuaggagagauguaagcagguuuauauguagggaaggaagccaaaggaaggaagaaauucaagaagcaaaaaagggcaugacugauaagguauggucccugggacauggaggagaugaguucuaaaccagaaauggaggaauuaguuuaggaccaaaaaugggacuucucuaucuauagaauguuaaauuggggcagugaaaguaaaugaagagaugaugauaacccccagauuuaugauauaagguggugaucucucucuuuuacauuuguaaggagguaagaauaagaggaaauacaggcaugauuucugguguaaaaguagaaaguuugagaacacuuauucucaauauguagcaaugcugcuaucuuuuuaaaaggguuagaagugaaguaggaauucugaagagagugguagauauuuggagcaaacccuggcacuagauuauggaguuuaacaagaauaugugaaaagagcuacugcuauccaauggaagaguaaauaauaaauucuaguugcuugcacuaaucuucucaaugauugaguuuucuucgguggcauucaguguuuuuaguauaaaaaccaaaaaauaaagagcagacuuagucuaaggcuagcuguuggcagagaaguaugauagaauggauaaaaaccagggaguuaaaagcacuuggaagcuagccugggaggagguuggcaaucguuuaaguugguggagauaacugaagcgcuuuagcauuugaacagcaaggggaaucagagggacaaaaggaguaugggagccucaaggauaagagaucaugguuuugaaucauaaaaggcagauuuagcugggugugguuccaaacugaggugggagccucagaugcagauagagguuggcucaggugcuuaccugaaauagccagaagcagcaagagcuagaagauaccuuugagcacucagggcacaaauuaaaaaugcuaauauuugucuggcacacuggaauacacaaaugaggcuggcugaagcugcaaaugacuagaucaagggguccuccugcuggaaugacauaauauucuagacaugcauguaacccccuccaaccuauucccugccugugcuccagaacacacaacuuaggaaaacucugccuuuaggaaacacugaagguugaaauaaggaaaaucgggugauuaaugauguagcucagaaaguuaaggugagagauucaaaacaaagauaaucagaucugaauccagacaaacacuggacugaacaugagugaaaacagaaaugauaggaauaaaggaaaagucaaugacuguuguuacaaauuggucucaugcaccaucugacauaggccuugugguacauggaugagucaaugcagaagcaaacaugaagguaaaauuuagaguccauaauuacaggaaaagguauuucaaggugaaaagaaaaaaggccuuucucacuaauuuuaauuuuaguuacucauguaauacacaaccaaggguaccauagaaaauugaucaggauuuuuuuuuaacagguaauuaaaaagcuguagagucaaaugaaguuauugugcucuggaaaaaaaccccauuauuaaaauacaaaaauguacuucucaaaauauauccuaauauuuuccuguuuagcacuguacaaauuggaaguucucuuaaguuugaaauguuuauaaaauaacagcuuugugucucaauagaauuuuagaugcuuuauucuucuugaacaucuuugaaggaaucaucaaagaagcaaaaugucaucugcauugucaaaugaccuugcucugugaucuucgcagaaaauaaacagcuuuaaaugagaagaagcugucaauucaggcccuguuacaauaaugagaguucaucacaugcuuuauccugugguucugaauuauagcacucuuuuauguaguuacauuguaaaucaccacccacuauuuauaacauuucuguacuucuagccaaaauaucaaguaaaucaaauuggagaugaaauauuuuuggcuuaaaccgauccaauauguucuugcuccugacagcuguaaaacucaagaguuauuuuacaucuuaguguuugaagucuaaaaaccacaauuugggaugaccugauguauuccaacuaaaauccuggaaaucucauaaugucgggaaauuagcugagaggagcauggacagaucaucguuacuggaugaaacuuacaggagaaucacuguaaggggccauuaacuacaaagccaaaagcaagagaucacgaacaacaaaauuuaagagguacccaaauuggaauuaagguguggcuguuaagaggcuuauaacacguagagguauaauucuauuuauucuagaaagucagcuaaaggauaaagagucagagccccugguugagccugguaauuauucuaacaaaacauuuauguagaaaguaaucgcucuucuucaaggcuguuguaacaauuagcgaaagaaauaaaagaggacuaaagggaugagcugaagcaacaauauaaacaaaaaugaaacuguucaccaccccaggggaauauugucauaacuuugugagguuuguaaguaaaaacggcuaugucaguauuauuaucuuaaaauaauuuaaugaagccacaggaugucucacguacauacaauaaaacaauuuaaauuuuggaaaauaacauguaaucuagucuuugcucuacuacuaauugcuggggaauaugauacuggcuggggcccuucuguucuuauauuagcugucucuauucauuggaauauaacccuuggagacucaguauucuaugucgaauauuucugaaaucguuuaagugcacuucucuuagcgguucugccuaugcuuuuaaaauaccaaggaaacacuuugggauucuugccaaccuguuuuuccaguauaggcagaauuuaaaagugaauuuucauucacagguaucuaggaacacauauuucuccuccauaccucuggauugauagcaacugcaguaccaaguggugcuuugggaaggcuuaaccuuccaucuuucuuucagcuucuccccacccccuccccagucagcaucaagauuaauauucaauauauaaaaauaguauaugccuguuauacaaaaauaagcuucaggaagaguuaucuugcuucccuuccaaggaaauuaccauccuacacccauccuacaucuaguaucaucacugagaguagcuucguacacugaccaaaugcauggacagacacugacccauuccagggacaagcuggaagggacagauaccaucuuuauguguaagacucugggaaacuuuuaaccuucccaagucucacauuguucaggguuguugcaaggacuaaaaugaaauaaugcauugcgaaguguuuggccaguauauggcaaauaguaagagcucaauuaaggccggacauuuuuaauauuauuguuauuguucuuauuacuguuuauugcaauuuucccuugcaaaugguuuauccaaugaaaacaucuaagcuaagaaccauggagauguauaggaaaugaaaauaucauauagguuuucuuggaugacaaaaagcaaaagaacagacuaugacaaacaagcaaacaaacaaacaaacaaaaaacaaaaaaacacacaaacaaaaaaacacaauucuaaaauaugcugacucugauuugauuauuuagagaacauuucagucucuucaauuaccucagaacuaucaguauaaccauuaauuuucauuuuucuagcaaagaauggaaaucuuugcuacuaaacaaugcugaaugacaauguuaauucaacaaguauuaacagaauggugaucauauagaaaacucgugugcuuaccggaagggacuguauguagggggacuggauaaagauaaguaagaaaguguuucaaauacuuugcaauauaaggaagagggauaagaacaagagagagaagaaagagagagaaagaggaacaaaguuguaaacaaucauaagauaagacagaauugaagugcuguaauaaaggugaaaaucuaaggauuugaaagcacagcugugggaaggauugauuuuaacuggcaagacugaugaagguuuagugagaggguucauuugagcuggcauuuaaaagaugaauaggaugucaauaggugugaaagaagacauuuccaggaugaacuauaggaucaaaauauuuuggaauauuuggaaaacauaaggacaacagucaaaaaagcagaauaggguggggauggagcgaugaaaaaccugaaggguguugaguaaugggauguaauaauaacaauauuaauaguaauagcagugggaacaguacugaggguuauauuacuaauaguagaauucauuaaguaguuaauacauacuuaguacuuuuaucucauucaauucucgaaaaccaccacucuuuaagagauguaccaucucugccuuuuuuagaggcacagggaaguuaaaaaaguugccagugcacaccuagguaguaagagacaaagucaggauucaaaacccaucuaaugucuagagcuaaaagucacugucacacuagcuaauauuacuaugaauauuauuucuuucauaugaaaacuaagaaauaauacaaucuauuuucuccacauaaaaguuggauccaauguauuuccuuuuuagcaaauagauagcauacauuguacucaaugugaaaauauaugccgauuuuuguuucuaugguaaauguuauuacgaguuuaaaugacauccuugaaacauaacauauaccauuauuuccagugaggaaaucaaacccugguuuagaggcccuucuuguaauaacaagggauuauaacucagccccaccauuccuauaauuaccagagaauacagaugcuagaaggaugggguaggggugugaagcagagaaaugugugugugaagcaaguuugugaaaauaaaagcucuuuauucuucauuuucaugcuucucagaccaugaggaucuggaguugguuacaauuugugcagggaaaaacucaagcugugaagcaggcaaccacggcaaacuugucuucaguucuauguaccaaucaucaagucuuccuuaauaggcagauucccuuguaccuaagauauugcagugcauuucauaaaacacagacauaccaaccauaagaugaaaaacacucuuguguaaguaauaaagaauaaugaaauggccaucaagcuauagucuaaaacuuuggucacuggaccauaaauggggaugccaaauuguauuaugauugggauuuugaagucuucuccaauagggacagaaguuaugcauguguguaaacauuccccuccaagcaaagaugacgacuagaagucacugccacaccagcuaacagaauaaacuaccaccaguuugaugcaaaauccugacccaagcuuuugauccuccaguugagaugcagcugccacauggcaaucuugcucacaagcaaacagaaaccuacaugccugcuagugucugguuuuuaauuuuuugaaaucaauauaauuuucuccuacuaaagggaauaaaagguagcuaacugauagugauccauucuuuaggcuugauuuuuuuaauccucuaaauaaaucuucacugauuagcaauuguaguaguucuaaaaauugauugauggaaaaaagacacaggccauaugugugguaagauaucuuaauaaaaugcuguuuguaaagaaaauaaaaacauccacaguuucaagagauauuuacuggaaccuuuauuuuauauccucugguuauggccauggagccaaaugaauuagaaaacagagguaaugauauagauaugccauguaaccuucaacuacagucucaaaugauacccacacuuaagaauagauauuuugcucugguugacuuaccuagagggaaagggaaaaaaaaaaaaaaaagaacagaugucucggaacaguaaucaaaaggaacuuagaagggaaauauugcuaagaaaauauuuagcagaaccauuuguaaaugcuuaauagaaagagcuuauaaguaauuuauaugaauuauaaaaguaaagguuuaugcuaaauuuuguuauguugcuucaauaucauuucuaguuauuuucuguuccuuaaguaauucugcuuaccaacaaccucucaaaauauuguagaacauuugggacauuugaaccaaguuguggcuguugucaaaauaucauuucaucuuuuaagcacggauaauuaauauuucaagauuuauuuauaaguauaaaacagauuucaagugaucaccauuuaucugguuggcaauuaaguuaguguggcuuucuaccugaaauaagauuaugcuuuugaguuaaggacaauuauuagcuagauccugcccuauauaugacucuaccaaacuaagcuuagauggggcaaaaguaaugucagagccaaugccuuaacuuccaaacuggguaucuucaaugacaucuuuugugaagcacuccuaucaagaaauuuuacuguguuauauucaggaacauucuggaaccaaaguuucuguuugcuacauuguaggaaagcaacaauaguaugcacugcuguaacuucuuuuaaaguaauguugcagcuucucugaggaauguugcagguggauucuccaagguugcuaaggauaagagaaaaugucuucagcauuuuuuuuuuuugcaucaggaaagagauauuuuaaaaaucagauuuaguaaagaaaauggcauuccaauaauuccaauaguuuuguaaauuuguuuuuauaaauaugguucuuagcuccucagcuccucaguuuaaaacaaaaaugacuauuuaaguucacaagaacuaaacuaaaccuccccucaucaauaaucaccugucaacuccuuuucauccaagaaucacugcuauuaaggguaucauacaccugugaguggcguaucaagaauuggcugugagauguuaaaaccugcacgaccuugacuaaaguaaaaacauuuccaaguacaauucauuuaacuacgccauuauacuggaugacagggcugagacugagggaguauagaauagcaaagcuuuaagucgcuugggauagacagauaaaaugaagcgguaccugucuaaacaacagauuuguuauaacuagucaugguauccucaaagucuuuacucugggaacuacacugauuaugccagaguucaccuuaucacugacaccacaaaggcauuucagacacggaucacacuugcccaucuugauuuuacagacaggaaaccagaaacgacaauuuguaugaaaaguggaauccaggcuuucauuuggcauuaauaugauuuuaguuacuaaagaaauucuuguucuaaauauuuugcuuuuuacuuaaauaaaucaguauuuugguaaauuuuggcuuuuguuacaagcuguacaaaaugaaauauguuuucuuggccuccuauccuuuggaaauagaugaaagauuuuauuaauaauuaauuuaaaauucuuuuaauuuccaugguauuuuccuucgacauccaaauuuuuaaaagaauauucuuauuuuauaauauuguaaaaauacuauauauucauuuuuagauuugaagaguuagauucaaccauucaacaaaaauaagaggggaaagaacuaacauuugcugaucaugucuacuauguuuaagcacuguguucagcaagaaauacaauagccuugaaauaaucacuugcuaauggagaagguagauagcuaacacuaaccuugguccccugugacaaggguggcaguagaccauucauucauucugaguccauggauuagaggcugguuuauucugauugggagaauugcaaaaggcuucacaaacuacguaauauuuaaacugaaacuuaaagaaugaauaccagugguauuaguaaucacaaguacugcuacugcugcuacuacuuacauagcacuugcuauauaccaagcauuguucuaaaagucuuauauauauuaacucaucuaauucucacaacucugagaggcaaguacuauuacucccauucuacagauaagaaaauugagguucauagagauuaaauaacuugcccaaagacacacaacuaauaaauuguggagcuggaauuugauccaaauggucuaaccccggacucugugcauaacuccuauaucaaacugccucucauauggaaauucaccaaggaagaccauuaacaggccaacccaaauggagggaauaauagcauaucaagaguuaugagauaaaugauugugcuaucuucaaacacugggcuccuugaacaucucccucaccaucuaaauagguaugugaaauauauaacacuccuuucuucccaccauauggcuccaauucaguuguucugauaggagagaaagagaagaaaauaaagugcacaaaagcauggaaaucgauuuuauccagaaguaauaauuauauauaauggaauauuaaaauggaaguuuuggcuguagccccaagacaauaauuagcacauucccaaagagguguaaggccauauguugaauuuccaaaggaggauucugagaaaccaguuacacaauucuaaaaugcuauaccuacaucaaaguccuaguaucugaaauuaaaaaggggaacuuauuuggaaaaaguuauugauaagcugugauuuuugcucugaagaauaggagaucucuuuccucaccucagcguggggaaagaaacuucaacagaaccucuuuagaaucccuaauauguguccccugcauuuugaugugcguauagacuggugucugacccauguauaugagaaaccuaaaguccaagugacugucuagcucuacuuaugcuggagcaaagagaaauuugcugaguggggaaucaccaaugcccaaauuacucugggguucauaauaugugaguguuucccuacggaccaguugugggcauuuuguaagaaggagucagaauggggucacaucuggucaugucaaagaagaucaucuggaaagggucaagaucucaacaaaaaacacaggagggaccauuggcuuuauuagcaagaauggaaaugcuuccuuaggcauuaaauaauugcagacggcagagucaauaaaagcauucagaagucagugagcuuuaaaauccuccaaguccaggcugggugcaauggcucacgccuauaauuccagaacuuugagaggcugagguggguggaucaccugaggucaggaguuugagaccugccugaccaacauggugaaaccacgucucuacuaaaaauacaaaaaaauguaguugggcaggguggugcaugccugaaaucccagcuacucaggaggcuggggcaggagaagcacuugaacccaggagguggaaguugcagugagccgagacucugccacagcacuccagccuggaugacagagugagacucugucucuaaauaaauaaauaaauaaauaaauaaauauuaaaaauccuccaaguucagacagcaccaaugcuagacuaacauuauggaacuuaucaaggaagaacuuuccuaucacuguuuccuccucucccucccagugcuccaaaccaguaagagucagaaacugauguuagcaaauugaagguagaggagaagacaagguagggaaagagagaggagaccaaguauccuuuccccacugcagguuuccugccucaaggagagaagcuuuaacuuuaaaaaauauuagaauauuaaauauaacaugagcuagauauuuaaauuauuaaauugaauccguauucuuaccuccgaagcuacuguagagaguauuauuaucuaagagagucugggaaagucaugggacuuaccugaacuuauaucaaggcguaagaaaagaauugcuucaccgaguggauuuaaacagauaugagguaaauuuuuacaaauaauuacaucuaacaaguugugcuaagucaacauaacagcuacauaccuaacaagcucugcauugcauacccacacacauguaauucugcucacuucuguuaacauuguaaaaggcagcacaggaagcuugagucuggcuuuggagccaguuuaccugagcuugccucaauuucuucuucugaagaacagggguaccaacaauauauacuucauaauguugaugggaagauuaaauaauaugcaaaggcauuuaauuuaaugcuuggccaauaguaagcauucauacauaauaucugccaugcuuguuguuguuguuaucaauauuauuaauaaucuuaaaggcgacugggaguggugguucacgccuguaaucccagcagguugggaagccaaggcaggcagauggcuugagcucaggaguuugaaaccagccugggcaacauggcaaaacccuguaucuauaaaauauauaaaaauuagcugggcauaguggugugugccuguaaacccagcuacucgggaggcugaggcacgagaaucgcuugaaccugggaggcagagguugcagugagccauuaucacaucacuguacuccagccugggcaacagagugagacuccgucucaaaaaaauaaauaaaauaaaauaaaauaacaauauuaaaggccccuuuugacccaccuuaccugcaaagaauaaucagggcagaaggcucaccauuaucacauuuuaucuaaucaccuccuaacuacuuucaaaccaacaaacccaaauauugccacugaucccccuccuaugcaaaggacaguaauaaguccagucucaaaaaaguauuguuuguacugaaugccuaucuccaugcacuguacuauggguucugugcauauuaccucauuuguuucucaccauauucgugagguggcuacaaucauuacccccauuaaaugaugaaaaacuaggacuuaagguccuuguccaugguaauacaaauaguauaugguagaagugggauaaacaguuguauuagucuguuuuguuuuguuuuguuuuguuuucacccaggcuggacugcaauggcgcgaucucagcucacagcaaccuccgucucccagguucaagagauucuccagccucagcccccugagugauuacaggcacaugccacuaugccuggcuaauuuuugcauuuuuaguauagaugggguuucaccauguuggucaggcuugucucgaacuccugaccucgugaucugcccgccucagccucccaaagugcugggauuacaugcaugagccacugugcccagccguauuagucuguuuuuacacugccauaaagauacuacuggagacuggguaauuuauaaaauaaaagaagucuaauugacucacaguucugcauggcuggggaggccucaagaaacuuauaauccugguggaaggugaaggagaaucaaagcauaucuuagaugguggcaggagacagacagcgcauggagaaacugccaaacacuuuuuaaaaccaucagaucucaggagaacucacucacuaucacgagaauagcaugggggaaacugcccccauaauucagucaccucccacugggucccucccucaacacauggagauuggaauuggagaugagauuugggugggacacagaaccaaaccauacuaacagucauugucaacauuucugcuaauuuaugauaaucaaaguuauuuucauuuuggggugaagucuuuaauguacuuucugucauagggacuucacuaaaggucacuaguaacucaaagcaauguaucuguucucacuuauaacugggagcugaaugaugaaaacacauggacacauggguggggggaacaacccacacuggggccuaucagugguuccgggggagggagagcaucaggaagaacagcuaaugggugcugggcuuaauaccugggugauggguugaucugugcaacaaaccaccauggcacacaucuaccuauguaacaaaccugcacauccugcacauguacuccagaacuuaaaauaaaaguugauuuuuuuuuuuuuuuaaaaagcaacgcaucuuuuaugaagaagcaauucuucuuuaguuuugggaaucuauugaacauuaugagguaaaaucaaagagguuggcuuuuaauuucaaaaagauuaaacaugaaaacaugaaagauuaaacaugaaagauuuucauguuaagaguauugugauggcuaauauccagugucaacuugauuggauugaaggaugcaaauuauuguuccugggugcgucuaugagggugcugccaaaggaaauuaacauuugagucaguggacugggagaagaagacccacccucaaucugggugggcaccagcuaaucagcugccaacguggcuagaauaaagcaggcagaagacaauggaaagagcagacucgcugagucucccggccuucaucuuccucccgugguggauguuuccugcccucgaacaucagacuccacauucuucagcuuuuggacccuuggacuuacaccagugguuugccagggacucucaggcuuucagccacagacugaaggcugcacugucagcuucccgacuuuugagguuuugggaguuggacuggcuuucuuuccuuuucuuuuucuuuuuuuuuuuuuugagacggagucucgcucuguugcccaggcuggagugcaugccaucucggcucacugcaagcuccgccucccggguucaggccauucuccugcuucagccuccccagcagcugggauuacaggcgccagccaccacgcccagcuaauuuuuuuguauuuucaguagagacgggguuucaccguuuuagccaggauguucuugaucuccugaccucgugauccacccgccucagccucccaaagugcugggauuacaggcgugagccgccgcgcccggccgggacuggcuuucuuacuccucaguuugcagacacccucuuaugggacuucaccuugugaucgugugagucaauacuccuuaauaaacuccccuuuaaauuuacauguauccuauuaguucugucccuccagagaacccugacuaauaugaguauauacaaaacuaaaucauaauuaaacacauguugcagcugaugggcgugacuagaaagagguaucaauuuaaguaaauuuaaaacacaauauccaaucagcugaacucuuugaaugucauauuuuacuuuauaucuucauuuaacuucuccuagacucaggucccuaguaucuaaaauaaauauuugccaugagaauuaagggaaauuacauauacauauguaaaaacuacuuuuuuaaucuagagaaaccuauaaaauguuaacacuuauuauguuuauaagaaaucuuacuguauuuuaguauauagaauaucauaaaaaauauaaauaucuagcugcccaaguguguauagugcuugaucuauagaaggugcucaauaaauguuaaaugaaugaauacagaugcucugaguaccuugcuaacagcaagaauguauuuaguauuuauuauuguuauuauuccccccaucauaauaauaguggaggauagugcccuuaucuguuugucauugcaauaaugaacucuaccagcagucucuguaauuugggggugacacaggagagggagcucacaaagacacacuauacacgcaaugguccugaauccugaauucaaacuggugucucuguuuuuguagcuuuucuucccccaaauauguaggcaaacauacuaauacaaccaugaaaaaaugccauuaaauauaauaccuugcaauaauuaggugaagaauucuugacaugcucaaauuuuauaguaauuauuuauaucauaaguaugagauuauaaagccuguuuucuccguugacuucaggaugaagucgauaaaagggacuuaacuaauuauuauaaucuauuaaucauuccauacuuacugagcaccuacuaggugccagcuacugaacuaggugcugaacaaaaaaaguagucucuuuguagaguucuuagacuaguuagagacacaaacagcucaccagcaauuagaaaacagcaugucugcuacaaauggggaauuaaugaagacuauaagagcauacaagagggauuuuucagaagaguucuccaggcauagugaugucaaagcugagacuggguggggcgggguuggagaaacuguacugggagaacauguaugacggugaaguucaaggggcuggagagcaugaagaauucaguauccuggggaaggggguaguggguagagagggagcugaagaggcaacaagggacaauucauaaaaggacuuaugagcuaauacuccucagguaauaacacugaaugaaaauauuucccuauaugucaagcauauucauuuuauuucuuccauugauuauuaguaauagcuagcugcuuucaaagaagcuuucagaauuuaaucaaaacaggaagaauacaaagaccuaaaacaagucucuauaaucuuuuucuaauuacaaacaaagaggucuuuggaacugccucucccuaauuuggcaugugaauuaugauuugagagcuugaaauagauaugguacugaauucauuugcucugaggaagaauagacacagauagaaagaagucuuuuccucuaggcuuauaccaguuugcuuuuauaaggauuuugcaccuuguccacaaacauuuggaacucaugggaaaauuaauacucccuaagcaaaauaacugguuuuuuuaggaaaaugucuucaauuuuucugauagaaaguuauuuccuaggugcagaacaagcuacuacauaugcuucguaaaugaucuugauaugugguaaaaguugaugaauggaaaagaugaaggcucaagcacaaugaauuucuuuuuuuuuuuuuuugagauagggucucugucacucaggcugggguguaguggcauguucacaguucaccgcagccucaaacuucagggcucaagagauccuccucccucagcuucccaaacagcuaggacuauaggcaccuaccaccacaucuggcuaauuuuuaaaaauauucuguagagagggggucucacuaugauucccaggcugaucucaaacuccuggccucaagugauauuuagccuuugaacgugcuaagauuacaggugugagccacugcaccuggccuucaauugcuuugauaccuuaucaguuaagauuggauuaguugcaaaaaauagagaauccuaaaacagugauuuaaacaagauacaagucauaguuaugcugucuggugcuaguacgacagcucuacaggguugucagggacuggucuccuucuaucuuaacuuucuacuaugaugguuauuauucccaagcuagcuauguaagugucaguuaucacauguagaauuuaugcaguaagauggaugaagaauugaggaaagcaugcccucucccugucaagggaaccucugcgagucuguacauaguucugcuuacauuuuauuagccaaaauuuaguugcaacacucuacuucacugacaagagagccaaggaguguuuuuuuuuuuuuuagauagguugcaaagagcccagcuaaaaauguguguauuucuaagaaaagaggaaggaagagaaagagagaaggacagauuuuagaagccaauucccaaucucugccauaaacauauauucauauaaacuuaaaaaugugaaugugugcugugguuuguauguuuguguaccuccaaauuucauguugaaacuuaaucuccaaugcaacaguauuaagagguaaggccuuuaguaugugauuaaauuguaagggcucuauacauuaaggggauuaguguacuuagaaaugggccaaacaaggcuguuuggcccuucuucccccucuggcccuuccuccauuauaugagggcaaugcauucauccauuccaucaugugaggauacagcauccagguaccaucuaugaagcagagggcaagcuuucaucagacacugacucugccagcacccugaccuuuaacuucccagccuccugaacagugagaauuaaauuucuacuauguagaaauuacccaaucuaaaguauuuuguuacaguagcaugaauagacugagacaaaaauuugcaccagaaauggggugcugcugcagcaaauaccuaaaaauguggaagcagcuuuggaacuggguaaugaguagaagcuggaagaauuuuaaagugcauugccaugaacagaggggcauugagggcaauacuggugagagcucaaagaagaagagagcuguaaacagaguguugaucuucuuagagauuaucuaagugcuuuuuaacagaaugcugguagaaauagacaguaaaggccauccugaugacaucuuagacagaaaugagaaacaacuuauuggaaacuggagaaacagccauucuugugauagcaugcaaagaccuuggcugaacuguuugucuccuaguguuucauucaaguaagaacuuaacagcaaugaaauaggguauuuggcagaagaaaucucuaaucaaaguuuugagaauguggcauggcuucuuuugacugcuuauaguaaaaugcaggaagggauaauaaauuaaagaugcaauuuauaaucuaaagggaagcagaacuuaaagguuuggaaaauucucagaagaaaaaagcauguucagaagaaaacaccaagaguguggccaaaugaccauuuaauuagaaaaucaggauggauaaaagugaaagaggagaaaggaagaaaccagucaggcagacaguuaggguggguccucaguuaauuuguuucaaacaaacaaacaaacaaacaaacaaaaaaccagccuaaaaaaucaaguugcuggcacaaauaagggaacuugcccagguggcuugccuaagacaugcccucagcugcauagguaagaaaggcuauagagaagacugggcuguuugcaacuauauaaacaaaaauacuccuuggcucucuugucaguuaaguagaguguugugacuaaauuuuggcuaauaauauguaagcagaacuauguacagacuugcagagguucccuugacagggagagggcauguuuuccucaacucuucauccgucuuacugcauaaauuccacaugugauaacugacacuuacauagccagcucgggaauaauaaccaucaugccugcaauggaaauaaccgacaugccugcaacagaaaauuccaucuccugacacgugcgcaguaaggggaacaaagcaaaauggaguaacucaagcugagccugcaugugcacuaggaauaugcgguggaacuaccaaaaaugcacaccuuaugcaaaagagaugcccagccccuuaucaguuucuuauaaaaaccucuguauccaaacugugaaucagcaaccauuuuuccaggaccccucucuguagcagagagcuauucucuuucuuucaccaauuaaacuuccacucuuaaccucauucuuuguguguccacauccuugaucucuguggcccugaaacaaccaacuucagguguuaccccagacaaugaggccacuucaaaaggaagccagaugcuauucaucaagacaaugaaugaggcugggugugguggcuugugccuuuaaucccagcaauuugugaggcugagguggguggauuguuugagcugaggaguucaaggacagccugggcaacauggcaaaacucugugucuacaaauauauauauauuagacaaauauauauauauauauauaguagacaaauacacacacacacacacacacacacacacacacacacacacgaaaauuaggcagacaugguaacgugugccuguagucccagcuugagccuggcagaugaagguugcaaugagccaagauuguaccacugcacuccagccugggugacagagucucacucugccucaaaaaaaaaaaaaaaaaaaaaaaaggaaugaaauaaugaccccaaaagcauuucagagauuguuggggcugccacucucaucauaggcccaaacugccagggccuugagggcagaaaaguuucaaaaaacagcccagggcuccugugugaaaaauuucaaaaagcgcucagggguuccuucccagcaccaccucaagucucugcucccaaaauucaggugcggugcuccucagcugcaccagcuguggcucaaguaggcccaggugcagcuugggccacccugcuggaacauagugacaacucugcaggcaugcagaguacaagagcuaugggggcuuggcuaccuccaccuagauuucagaggauaaccccaaaagccucaggguccaggcacaggcagggcuaucacagaaagccccuaguaagguaacacccagcagauccauggggucaggcucagggucacugcagaguccccauuggggcaaugcucaggggagcuauagggcuggggaugccgaaaagaacuuccacuagggcaaauauccaguaaagcugugugggcaggacuacuuccaagacccuggaccagcagagccaccagcauguaauuucagcccaggagagcugcaggaguaccacugcaaugccaugaaagcugcugugugggcugugcccagcaaagcuagggggcaggacuguucugagcuuugcggacccaacuuccaccccaguauauccagaaagcagacauagagucaaagaucauucucaagccucaagauuuaauguucuuugccuuggugagauuuguacuuacuugccaccuguuuccauuucuuccuuccuauuucucccuuuugaaaugggaacaucuauucuaugccuguccuaccguugcauuuuggaagcaaaaacuuguuugauuucacagauucacagguggaaagcaauuugucucaggauaaaucauaccuugagucucauccauaucugauuuaaaugauauuuagaugagacucuggacuucaaacuucugaguuggugcugaaauaagucaaaaauuugggggauuuuggaauggaaugaauguauucguaugugagaaggucaugaauuuugggggaucaggggcggaaugcuacgguuugaauguuuguggcaguccaaaauucauauugagaaauugaggguuuaagauggcagauaggaggcaggacuagcuugcagcugccacuuggauggacagaacagccuguagagacucacaucgugaacuuuugcuccaggaacuacagcaggaacacaccagaaagccaagauaauccacagacccuuugaaggaacuggaucaccauggcaggcucccugagaugccaaaaaaacugugagucugcuuaauuucucaauggggagguuuguggucuggggcaaguuuucagcccuggucacuggcugccuggaaacagacucagugccauugguggggcacagugggaaugagaccagccuuuaggacuaugggcuuuaugggagcagggugaggccugugacugcuggcuuuccuccacuucccuggcaacucagcagaggaaaccuuaauccuucugggaauauaacugcauuggacugggaaccauacccccaucugccacagcagucgcagcaagcccaccccaagaagagguugagcucagacaugccugucucugcucccaccugguggucuuucucuaccugcccugguagcugaagaaaaaggucauaaucccuugggaacucuauggcccugcccaccacuugagaaaccugaauacuuaaccaguugucccuagagcaaguuugcauccuccauauaggaccacagcugaugugcucuucagcuccuggcugaaggccaaccaacaaaaaccagcgcacuaaacaaaaacacagccaaggacccucacagaguccacuccauuccccugcuaacuccccgagagcaggugcugguauccacagcugcaagaccugaagacagauuacaucacaggagucuuuguagacccucgcuaguaccagccuggaaccugguagcucugcugcguggcuagacccagaagagcagaaauagucacuacaguucagcuuucaggaauccccauucauaggggaagggggagaacaccccaucaaugaagcacccugugggacaaaaaaucugcacagcagccccugagucccagaucuucccucugauguagucuacccaaaugagaagaaagcagaaaaacaauucugcuaauaugauaaaacaagguucuuuaacaugcccaaaagaucacaccagcucaccagcaauggauacaaaccaagacaaaaaucuccgaauuguuagaaaaagaauucaaaagguugauuauuaagcuaaucaaggaggcaccagagaaaguugaaguccaaauuaaagaaaucaaacacauuauacaggauaugaaaguaaaauucuucagugaaauagauagcauaaauaaaaaacaaucacaacuucugaaaaucaagggcacacuuagagaaaugcaaaaugcacuggaaagucucagcaauagucucauccaucaaacaagcagaaagaaagaacuugagaacucaaaaacaagacuuucgaauuuacccaauaugucaaauacgaagaaaaaagaauuuuaaaaaaugaacaaagcauccaagaaguucgggacuauguuaaacguccaaaccuaagaauaauugguguuuccacagaagaagagaagucuaaaaguuuggaaaacacauuugaggaaauagucgaagaaaacuuccccagccuugcuagagaucuagacauccaaauacaagaagcucaaagaacaccugggaaauucaucacaaaaagauccuugccuaggcacauagucaucagguuaucuaaagacaaaggaaagaaucugaagaucugugagccaaaagcaucagguucuguaauggaaaaccuaucagauuaacagcagauuucucagcagaaacucuacaaacuagaagggauugagguccuauuuuaagccucguuaaacaaaacaauuaucgccaagaauuuuguaucuagugaaacuaagcuucauaaaugaaggaaagauagucuuuuccagacaaauaaaugcugagagaauucgccacuaccaagccagcacuacaagaacugcuaaaaggagcucuaaaucuugaaacaaauccuugaaauacaccaaaauugaaacuucuuaaagcauaaaucucacaggaucuauagaacaauaagacaaugaaaaauaucaagguguucaggcaacaaauagcacaaugaguagaauaguaccucacaucucaauacuaacauuuaauguaaauggccuaaauguucuacuuaaaagauacagaauggcagaauguauaagaauucaccaaccaaguuucugcugucuucaggagacuuaccuaacacacaaggauucacauaaacuuaagguaaaggggcggaaaaagacauuccaugcaaauggacacccaaagcaagcaggaguagcuauucuuauaucaaacaaaacaaauuuuaaagcaacagcaguuaaaaaagacaaaggacauuacauaaugauaaaagaacuagucccauaggaaaauaucacaguucuaaauauauaugcaccuaauacuggagcucccaaauuuauaaaacaauuacuacuagaccuagaaaugagauagauggcaacacaguaauugugggggucuuuaauacuccacugacagcacuagacaggucaucaagacagaaagucaacagagaaacaguggacuuaaacuauucccuacgaaaaaugaacuuaacagauauuuacagaacauucuacccaacaacugcagaauauacauucuauucaucagcaaaugaaacauucuccaggauagaccauaucacaggccacagaacaagucucauuaaauuuaagaaaaucaaaauuauaucaaguacucucugagaccacaguggaauaacauuggaaauccacuccaaaaggaacccucaaaaucaugcaaacacaaagaaauuaaauaaccugcuccagaaugauuguuggguuaacaaugaaaucaagauggaaauuuaaaaguucuuugaacugaacgauaauagugacacaaccuaucaaaaccucugggauacagcaaaagcaaugcuaagaggaaaguucauagcauuaaaucccuacaucaaaaagucugacagagcacaaauagacaaucuaaggucacaccucacaaaacuguagaaacaaaaacaauccaaacccaaacccaucagaagaagaaacauaacaaagaucugagcagaacuaaaugaaauugaaacaaacaaaaaacaaacaaaacccacaaaagauaaaugaaacaaaaagcugguucuuugaaaugauaaauaaaauugauagaccauuagcgagauuaaccaagaagacagagauccaaauaagcccaauuagaaacaaaaucagagauauuacaacugaugcuacagaaauacaaaagauuauucaaggcuacugugaacacguuuaugugcauaaacuagaaaaccuagaggagacagauaaauuccuggaaauauacaacccuccuagauuaaaccaggaaagcauaaaaucugaacagaccaauaauaagcagugagauugaaaugguaauuaaaaaaacugccaacaaaaaaagucugggaccagauggauucacagcugaauucuaucagacauucaaagaagucuuggugccaauccuauugacacuaauuaucagggaaaugcaaaucaaaaccacagugcaacaccaccucacuccugcaagaauggccauaauuuuaaaaauaaaaaaaaauagaguuggcauggaugcugugaaaagggaacacuuuuacacuguuggugggaauguaaacuaguacaaacacuauagaaaauaguguggugauuccuuaaagaacugcacauucuguacauguaacccagaacuuacaguauaauaauaaaaaaguuacuguauauuaaaaaaaaaaaaagaacuaaaaguagaucuacucuuugauccagcaaucccacuaccagguaucuacccagaggaaaagaagucauuauaugaaaaagauacuugcacaugcauguuuauagcagcacaauuugcaguugcaaaaauauggaaccaguccagaugaccaucaaucaacgaguggauaaagaaaauguuuauauauaccauggaauacuacucagccuuaauaaggauugaaauaauggcauuugcagcaaccuggauaaacuuugaaacuauuauucuaaguaauucaggaauggaaaaccaaacauuguauguucucacucauauauggacacgaccuguucccccaaaacccauugaaauaaaaaauaauaaaauaaaauacaaauaaauugaugaauaaaaacaaccaaaauaaaauucauacugaagcuuaauuuccagugugauuguagcaagaagugggccuuuaggagguaauuaugccaugagggcagagcccucauuaauaugauuagugcccuuauagaagauccaagggaauuuauuugucccuuuuugcccuuuuuccacgugaggacacacagcaagaaggcaccaucuuuggagcagaaagcaagcccucaucagacacugaaucuguuggugccaugaucuuggacuugccagacuuagaauuguaagcaauaaaugucuauuguuuaugaauuaccuaguauaagguauuuuguugcagcagccagaaugaauuaagacaguauguaaccucaauauauuuauuuauaaauuauagacauacuccauuaugcuauuauuuuauagaaauuacaaaauaugaacaaauaauuuuguuaaagaauaaaauaaaaauuaaacauaaauaaaauguuuauauugucuuuccaaucucaggggauuguaauguauaaaucaauuuggagacugcugcucuaggaggcaauaaguauaaacauuuagauucuacuucuucaaauuggcaagaaaauaaucauagaaucuagaaagucuuaggggugugagguauucccuagucuauugagggaaagucuauguccacuuagguuacuacucagaaagcuggacuaauauugaguaauggcaaggcuagacgcuuaacguagccucaagaauuacaacacuagcaugugagaacaacaguauuauaaaauaaaaacaugaaaaacagagugacaauauaaauuaguaaguauuaguuacaugaagacuuugagguuauuuuuguauauuugcuucaaaugguaacuuuuuucuaaaaauguguuuauagcaacauuucugaaaagcacaauggcaauaacauaaccaaaaggcuuaaaaauguuuauauaucguaaguaaacuucuuagacuucuaagagcccagggaaagaaacuaugauaucaugaaaauuuuauaaauaaagauaucccaaugauauucauuauuagaaacaggcaaaaaugguuaaacaaauuauaauacagccaugcaaugaaacacuaugcgacuauuaaaaauuauacuuucaaccgcugggcaugguggcucacacuuguaauuccagcacuuugggaaaccaaggcaagcggaucacaaggucuggagauugagaccauucuggcuaacacgcugaaaccccaucucuacuaaaaauacaaaaaauuggcugggcagaguggugggcaccuguaaucccagcuacucaggaggcugaggcagaggaaucacuugaacugggaggcagagguugcagugcgccagagaucacaccacugcacuccagccugggcaacaagagcuaaacuccgucucaaaaaaaaaaaaaaaaaaaauuuauacuuucagagacuauuugcugacaucauaaaaugcccaacauuaaguaggggaugcaauauaacaaauuaagucacauaucuccuuacaaaccuuucucucccccucuuucacacacauggacauuccuacguacauuacgcugauaaauuccuaaaaggaaaaaccaccugaauuuuaaugcuaucuagggaauucuauuaguggugauuuuuaucauauucuuuaauguuuucuguauuuucuaaauuuccuagcacaaauacauguaacauucauauaauuagaacucaaugcuacugaaaagcuuacugaaagucaucuugaaagaaaauauauuaauguagguucucaaaauuaaaaaauauguuaaauaguuuuauaggucuaguguugggcaguggagagcuauguggucucuaggucugagaaaagguaguuugaaggaaauucagauagucaauuugacuucauguggcagaauaugucuaaauuauauuuuagauaguaauuauucacauuauaguaauaaugcauuaucaaaucuuucauuugaaucugaauuugcagaauuaacauugacauuacuuagauaaaacucucaaguauuaaaugaaaguuaauaaaaauaagaugugcuauuauuuaaaauguuuuuuuaaaaaaaauaauuuccaguugcuggcaagauggccaaauagcaacagcucuggucuuagcaacagcucuagucuguaguucccagcgagaucgacacagaaggcaggugauuucugcauuuccaacugagguaccccguucaucucaaugggacugguuggucagugggugcagcccaaggagggcgagcugaagcaggguggggcaucaccucacccgggaagugcaaggagucggggaacucccucucccagccaagggaagccauuagggacuguacugugcacucuggcccagauacugugcuuuccccacggugauuccuucuggugccuacaccaccagagcccuggguuuccagcccaaaacugggcggccauuugggcagacacugagcuagcuggaggaguuuuuuuuuuucaugucacaguggcgccuggaacaccagugaaacagaaccguucacucccccugcaaagggggcugaagccagggagccaaguagucugguucgucggagcccagauggagcucagcaagcuaagauccacuuguugaaauucuugcugccagcacagcagcagucugaguucgaccugggacaccugagcuuggugggugguggggacuccaccauugcugaggcuuaaguaggugguuucacccucacaguguaaacaaagccaccaggacguucgaacuggguggagcccaccccagcucagaaaggcugcugcagccagacugucuccucucugagcagggaaucucugaaaaaaaggcagcagccccagucagggacuuauagauauaacccccaccucccugggacagagcaccuggggaaaguggugguuguaggcgcagcuucagcagacuuaaacgucccuaccuggcagcucugaagagagcagugggucuaccagcacagcguuugagcucugauaagggacagacugccuccucaaguaggucccugaccccuguguauccugacuaggagacaccucccaguaggagccaacagacaccucauacaggagagcucuggcuggcaucuggugggugccccuccggguugaagcuuccagaggauagaauaggcagcaaucuuugcugcucugcagccuccgcuggugcuacccaggcaaacagggucuggaguggaccuccagcaaacuccagcagaccugcagcagagaggccugacuguuagaaggaaaacuaacaaacagauaggaauaguaucaacaucaacaaaaaggauguccacucagagaccccaucugaaggucaucgacuucaaagaccaaagguagauaaauccaugaagguggggagaaaccagugcaaaaaggcugaaaauuccaaaaaccagaaugcuucuucuccuccaaaggaucacaacuccucgccagcaagggaacaaaacuggauagagaaugaguuugacaaauugacagacguuaagcuccagaagauggguaauaacaaacuccucugagcuaaaggagcaugucuuaacccaauguaaggaaguuaaaaaccuugaaaaaagguuaaacgaauugcuaacuagaauaaccaguugagugaagaauacaaaugaccugaugggcugaaaaacauaguacgagaauuucgugaagcauacacaaguaucaauagcugaauugaucaagaggaagaaaggauaucagagacagaagaucaacucaaugaaauaaagcaagcaaacaagauuagagaaacaagauugaaaagaaaugaacaaagccuccaagaaguaugggacuaugugaaaagaccaaaucuacguuugauugguguaccugaaagugacggggagaauggaaccaaguuggaaaacacucccaggauacuauccaggagaacuuccccaaccuagcaaggcaggccaacauucaaauucaggaaaugcagagaauaccacaaagauacuccucgagaagagcaacuccaagacacauaauugugagauucaccaagguugaaaugaaggaaaaaauguuaagggcagccagagagaaacgucagguuacccacaaagggaagcccaucagacuaacaguggaucucucugcagaaacccuacaagccagaagagagugggggccaauauucaacauucuuaaagaaaagaauuuucaaaccagaauuucauauccagccaaacuaagcuucauaagugaaggagaaauaaaauccuuuacagacaaguaaaugcugagagauuuugucaccaccaggccugcccuacaggaacuccucaaggaagcacuaaacauggaaaggaacaaccagcaccagccacugcaaaaacauaucaaauuguaaagaccaucgacacuaugaagaaacugcauaaacuaaugggcaaaauaaccagcuagcaucauaauggcaggaucaaauucacacauaacaauauuaaccuuaaauguaaaugggcuaaaugcuccaauuaaaagacacagacuggcaaauuggaugaagagucaagacccaauggugugcuguauucaggagacccaucucacaugcaaagacacacauaggcucaaaauaaagggauggaggaauauuuaccaagcaaauggaaagaaagaaaaaaaaagcagggguugcaauccuagucucugauaaaacagacuuuaaaccaacaaagaucaaaacagacaaagaaggacauuacauaaugggaaagggaucaaugcaacaagaagagcuaaguauccuaaauauauaugcacccaauacaggagcacccagauucaugaagcaaguucuuagagaccuaucuagagacuuagacucccacauaauaauagugggagacuuuaauaccccacugucaacauuagacagauccaugagacagaaaauuaacaaggauauucaggacuugaacucagcucuggaccaagcaaaccuaguagacaucuacagaacucugcaccucaaaucaacagaauauacauucuucucagcaccacauuguacuuauucuaaaauuuaccgcauaauuggaaguaaaacaugccacagcaaaugcaaaauaaugcacaucauaauagucucucagaccacagugcaaucaaauuagaacucaggauuaagaaacucacucaaaacugcacaacuauauagaaacugaacaaccugcuccugaaugacuacuggguacauaacaaaaugaaggcagaaauaaacauguucuuugaaaccaguaagaacaaagacacaauguaccagaaucucugggacacauguaaagcaguguguagagggaaauuuauagcacuaaaugccuacaagagaaagcaggaaagaucuaaaaucgacauccugacaucacaauugaaagaacuagagaagcaagagcaaacaaauucaaaagcuagcagaagacaaaaaauaacuaagaucagugcagaacugaaggagacagagacacaaaaaacccuucaaaaaaaucagugaauccaggagguaguuuuuugaaaagaucaacaaaauugauagaccacuagcaagacuaauaaagaaacaagagagaagaaucaaauagaugcaauaaaaaaugauaaaggggauaccaccaauucccacagaaauauaaacuaccaucagagaauacuauaaacaccucuacacaaauaaauagaaaaucuagaagaaauagguaaauuccuggacacauacacccuccuaagacuaaaccaggaagaaguggaaucccugaauacaccaauaacaaguucugaaacugaggcaacaauuaauagccuaccaaccaaaaaaaguccgagaacugauggauucauagccgaauucuaccagagguacaaagaggagcugguaccauuccucccgaaacuauuccaaacaacagaaaaagagggaauccuuccuaacucauuuaugaggcaagcaccauccugauaccaaaaccuggcagagacacaacaaaaaaggaaauuucaggccaauauuccugaugaacaucgaugucaaaauccucaauaaaauauuagcaaaucaaauccagcagcacaucaaaaggcuuauccaccacgaucaagguggcuucaucccugggaugcaaggcugguucaacauaugcaaaucaauaaacguaauccaugacauaaacagaaccaaugacaaaaaccacaugauuauaucaauagaugcagaaaaagccuucgaaaaaauucaacagcccuucaugcuaaaaacucucgauaaacuaggcauugauggaacguauuucaaaauaauaaacacgauuuaugacaaacugacagccaauaucauacugaaugggcaaaaacuggaagcauucccuuugaaaaccagcacaagaccaggaugcccucucucaccacaccauucaacacaguauuggaaguucuggccagggcaaucaggcaagagaaagaaauaaaggguauucaauuaggaaaagaggaagucaaauugucucuguuugaagaugacaugauuguauauucagaaaaccucaucaucucagcccaaaaucuccuuaagcugauaagcaacuucagcaaagucucaggauacaaaaucaaugugcaaaaauccaaagcauuccuguacaccaauaacagacaaacagagagccaaaucacaaguaacucccauucacaauuguuacaaagagaauaaaauaccuaggaacccaacuuauaauggaugugaaggaccucuucaaggagaacuauaaaccacugcucaaagaaauaagagaggacacaaacaaauggaagaacauuccaugcucauggauaggaagaaucaauaucaucaaaauggccauacugcccuaaguaauuuauagauuuaaugcuauccugaucaagcuaccauugacuuucuucacagaacuagaaaaaaacuacuuuaaauuucauauggaaccaaaaaacagccugcauagccaagacaaugcuaagcagaaagaaaaaaccuggaggcaucacgcuaccugacuucaaacuacauuacaaggcuacaguaacaaaaacagcaugguacugguaucaaaacagauauauagaccaacggaacagaagagaggccucagaaauaaugccacacauacacaaucaucugaucuuugacaaaccugacaaaaacaagcaaugaggaaaggauucccuauuuaauaaaugguguugggaaaacuggcuagccauauguagaaaacugaaacuagaucccuuccuuacaccuuauacaaaaauuaacucaagauggauuaaagacuuaaaccuaagaccuaaaaccauaaaaacccuagaagaaaaccuagccaauaccauucaggacauuggcaugggcaaagacuucaugacugaaacaccgaaagcaaugacaucaaauggcaaaacggacaaaugggaucugauuaaacuaaagagcuuuugcacagcaauagaaacuaucaucagcgugaacagccaaccuacagaaugggagaaaauuuuugcaaucuauccaucugacaaagggcuaauauccagaaucuacaaagaacuuaaacagauuuacaagaaaaaaacaaccccaucaaaaagugggcaaaggauaugaacagacacuucucaaaagaagacauuuaugcaaccaacaaacauaugaaacagagcucaucaucacuggucauuagagaaaugcaaaucaaaaccacaaugagauaccaucucaugccaguuagaauggcaaucauuaaacagucaggaacaacagaugcuggagaggauguggagaaauaggaacguuuuuacacuguuggugggaguguaaauuaguucaaccauuguggaagacaguguggcgauuccucaaggaucuagaacuagaaauaccauuugacccagcaaucucauuacuggguauauacccaaaggacuauaaaucauuauacuauaaagacacaugcaaacguuauguuuauuguggcacuguucacaauagcaaagacuuggaaccaacccaaaugcccaucaaugauaggcuggauaaagaaaauguggcacauauacaccauggaauacuaugcauccauaaaaaaggaugaguuccuguccuuugcagggacauggaugaugcuggaaaccaacauucucagcaaacuaacacaagaacagaaaacccaaacuugcauguucucacucauaagugggaguugaacaaugagaacacauguacacagggaugggaacaucacacacuagggccugucagggguugggggcccaggggagggauagcauuaggaaaaauaucuaacguagaugauggguugaaugggugcagcaaaccacccuggcacauguauaccuauguaacaaaccugcacauucugcacauguacuucagaacuuaaaguauaauaauaauaauaaaaacaauugccauuauguuaaacuucagauuagagcaaaccuuuugcagcuaacauuuagcucccagaaaguaaugcuuuuacuuagacaagcugccaggacuaaacucuaacagcauaaauaugucacuaaaauaaaaacuuuucaauagacaaacacuguaaggauuaccugguuuaaguuuccaaguguaaauucaauuugaaaugauauaguuaaaaaucucuguggucuuaaggaauuuuuuuaaacuucuacaaagagaaugaacaguuacagcuucuacucacugaucugggucuucagaaacacaucaauacacauaguacauaagaaccagcuguaagaguuuuuuuugucaauacaaagcaaggucacugcauuauagaaagacucagcacucuguuuauuucacuuccauaaagggauuguucaagggcagauucuaaaagaauaauucugagaagcauugaaaccccuggaaaaacagacagcuuuaguaaaacccugaauaucuauugggauauucuuggauugcauuguaaauagaagcaaagaguauauuuaaauaaaauuguuugcauuuaucuuuauauauuuuaaacuaaaugccuuuacuccuuauuucaaagcaauggaaaggaacauaaauaccaagaaaauaauaaauuaauagcaauuauggugacucacucuggaaaaucaagauaaauaagaaaaacuuacaacaauuaaaugcugacaaaauuguaauuguaaugagggccugccccaugcuagacacuguagguugcugagauuacuguuaaugcuucccaaauacuguauuuucuguacacaggccacauuaaugauagggaacaaggccggacgagggugaaacuagugagguguuuaauuugggcaccaaauuuaaggaggcacaugcacacaaaaauccccuuaguaauccaaacaaacaauauuuuaaugaaauauuuuuaaaaucaaaaagcagaaaauccaugaugaacaaaauauugaaauuuuaauaaaugucugucagaaaucauauaccaaauacuacuugguucaaguggaaaugauaaaagcaauuucacaucuaaaaauguuuucagagugaaaagaagauaaaccuuuucaguagaaugucuuguuucuuuuaauacuuucagauuuuccuuaacgaauacucucuugagaacauaaugggaaaacaacauccagaaucuuuccacuucgucccucacuaagagacuuaaaaaaaaaaaaaaucauguguaagacacagggaucuuuaggagacagucauuauggaaagacagugcauuaguauuuacaaagcaaaucucauuauauaugauagacgguuagaaccagaaaaaaaauuuuaaaaagaaaaauaucaugacaauacuccuuuagaaacauacuuaauauuuggcuaaccuccuguuuuccuguuuuuuccauugucuagauguuucaacugauuuuucuaagccuuuuacaaacaaucuuuuagaaagccaacauucaagcaacucuaagaggccuugaggaaauaagaugaaacauucauaaaaaacaaaaacaagagcacuaaagagaaaaaaagaauaaccuugauaaccagccaauguucuaggaaauuuucuuuggaacacugaaacaagaucuagcuguaacauaauaaauuguaauaagguaaagaagguagcugccucacagcuguaacacggcaaguuaguaaccaggaaauucuaauauuuaaugacuaaagauagguuuguuuaagccuagauugcauuuugugaaugaaaauaaauacuucuaaauuaauggcuuucugaucauguguaacauuaaaauauuuuauauccauucauauuaaaugucauaagauuuaaaaaaaccuaauaauauuuuuaaacaaaaugaaagaauacauggauuaugaccuuauauaaucacaugcaucccaaaaccuuuaacuuccgagugguucuagaauuuagaacccacaaaauucucaucccaauuggcgggaaagauuauugaaauugcugauccuaagucccacacuaagauuuucuaaaucauuaucucuaggauuagcaccucauaaauggcacuuuuaggaaaaaaccccugugauacuuacauguuuguccaaguuugagaaccacugcuuaauauagaauuuuaacccaggcuuuuagaaauaggcaugaagaaaauagcuccugggauggauuuugagguuuagugcuauagaaacggucagcuacaaagcauuauauaggauauauaaucucuucugguucagucuuauuacugaugguaauuacaauagauuucuugggaugcauaauuggccauuacuguagaaaaaaauuuaaaaguauguuuugaugccuuuauugucuugaucuuaaacugucuaaccaaugaucauagaauuuuugguuuugucuuuuaaaaauauuucuguguccuagauuaugagacacuauaauuaccaacuuuucuauuuauauauacacauuuauauaucuaaugauuuuacuugcuguguuuaaaaauccugguuaugauuauauuaaacaauacaaagucacugggacacucacucuauuguuuucaagucuaguauuccagggucuuuggauucucuggcccuccauuacuacggcagcaggguuguucugacaucaugaagauccucugauacacaucuccuacugcuucagggacaaacugguagaggcaggcaggcccacuuucagccaaucaaagaagaaacccccaaacucugaagggauguggggaagagaagagaaaacagcuugccuaaaagaagagguuggguugacaauguaucuugauggucagcgggaaauagaaggaaaccugaauuuguaguaagacaaacaucacagauuauugaauauuacagcuggaacagauuugagggaacaaauaaauaaggccuuucauuuuaccaaugaagaaguaaauacaagaagagguuaaguagauugcuaaguccuuuaaaggaaagaaucucauaggucaccacacuaacacuuguuuaucaugguuuccaugaaguugcuuuaacuuauaauggaguauggaguauaagcuuuuccuuuguagcaguuaugcuuuauaggaaaugcuugguugaugcugggggagcagaagguaaggagaaugaaagaaaucacugcaaauauuuccaaacuccauugcuuuuuuguaaaucaacaauuaguuuuaaaaucaccuggaauccuucuaccucaaauaaucuaguuaguccaaugugcuuucaaacuaccuacuuaaauagaagacucuacucaacaugaucuuagauauuagaaaagggaauagagguaaguauggaugacccacgguggcuuccuuugaucagaauacuucuuuucauuugcuaauucauagccaagaaguggagaccagguuuacuuucauuacggauuccugcaaaugggcauaaugccuucugacauuuaacuuguaugaccaaaaucccauauaguguuauauaggauuuguguauaaagaagcucacauuucaaugaaaugcugaauucuaaacuauuacagcaauaucaugauaccucgauuuucuaacaaccacaugcaggaauugcaaauguauucauuacuuguggcccugaaguggacacucauauugguagauaccaagaacacaagauaguacaucaugucugauuuuucaaaagaaaagcagccaaagagaaauggccaaaaagguaagaggcuuucauuugaaagugugugugugaguguggggugugugugugugugugugugugugugguuaguagaagacgaaaaaagacaaaauagggcgggaauauagacagcggaggaaaauugugucuaaacaccacuauaauuaacuuauuuuuuguucaggaaucauuauggcaauaaaaauagaaggacaaaugggggcccagcuaucuuuacuucuugucauaaagguuuuggggcaccaucuaagcaucccaguaaaugggucuuaaguuucuuucuacaaaaucugcauaguuugaaaccaucaucacauuuauuucacuaucaaagaaauucuucgauuaucauuuuuccuguccucuuuucaagauuauacauuuccaucaaauaaucuaucuauuuugggaggcuguccuuaaaaaugggucaaaagguaaaagauaaucaacauucaagucauagugccacaggaggaaaaaguaagguaaugaaugguuuaccagcuuuuucuguguuuuacugcuauuguaaaaauaaugaugucccaauuaauauaaucagugaauauggaugcuacaacaagaugaauaauaccuuauuucauagaugaccgggguuaacuaaugguccuuguucagaaaguccagauuuaauagccuguagaaguagaguacaguuuuucuaucuaugaauuguacuuuuuguagaaaucugucagcuuuacucagcagcuaucucuaccuaaaggcauaucuguucuggauuaaaugucaguccucucuucucuucuuccugcuuuucuauggguacagaaauaguuuauagaaaaugaaaaguuauuuuugggucuagggauauuaacuuggauuuugaauuuuggaaauucuuguuagaauuuuuuaagugaacagauacacaucugcuuaccgcuuaguauaaaucuaauuauaaucaaacucauaaaauaauguuagaaaaacuaauauacaaaagcaaauuuucaagguacuguaauauauuugccauaagagccuuuugcugguaauuggaagauucagcuuuacuucacuguuuaaucacccacaaaacuguuuauugcccuauauauuccuccaacaagaacauuaugcucuuaacguggcccucggagaaccagggaauacagcaggguuacagcacguucuauuuuuuuuuucaaauauuacauuugaaauuaaauucaaaagacaaauuuuaaucugaccgucaggcucugauaacacauacuccaauuaguacaugcuugaacugaaagagguuauuauuugaugcagaaugauacaggcaauggauuaaggcauaaauaacaauaucugcaacauaagcuaugggucuaaaauauuaacuuuuaauuacauauggucaauccucaguuuagaccauaaaacuauaguuuuuaaagaaacuguuaaauauuuuguucauaaauauguuuacugcauguuuguauauauucauuuagguauauuuaguuuucuuucuaaagcuuuuaaauaaauacaacaauuacaaacuacuacuuuuuuauucaaaaguaacuuucuucacaaucauuagaaaaauaaaacuagcugccauuaguaauuucuagacaaaaauagagaaaaguuaacagacugguuauuuaaaauacuguuuaaaauacuuuuuaaaacuuaaguacuuauuugcaauuguaguuauguaguucuacaccuguaguuuaaguuuuuacacagauaugcauauugugugauagccacaaucuaaauauagcaucacguauuuauagagcaccuaaugugugcugagcacuguacaaggcauagggauacagagauuuaaaaaaugucucuucucugaaugagcuuuagcguauaguggugugaaagauauuuaaacagauccuuacaguguucuauguaaggcuauaguggaguuguuaaaagguguagcggaacugaggagaagaagaugggucuuagaagagaagcggaaguuugcuggguugauaagacugggacaagcauaccugguaggugcuguaggaaacaacaucaggugcuacagccuggagggauuagaggccaugcaaaagauuugguugaauaagcacuaguacuguaguuugguauuucuggagcaagaauggaaaagacacagaaggagagaauaucuggaaguauucuauauugccauuuuaaaggaggucauucaugcuauagguuaugaggagccauuuaacaaacuuuaugcaaaaaagaugugguaagauuugcauguaagauaaccuuauuagcagcuuuguggaugacagauuuaacagcacaguuaaaggcaagaagacuacugaagggaccacuguuaaaaucuagacuagaaaugaugaacgcgugaauuaggauagcagauguggagauaagaaggaagaugcagacaugagacauauuuaggagguggaaaacaaauagucugcucugauuaaucagaugguacaugaggaaaagagagaagccaccagugaugcccagguucuguucuggcucauggagaauaaagagguuugucuuuagagacaaagcagaaauaggcuaguggcuggaguagaaggaggugcaguuacauccauucugaguaagcucuagaucccuauauuuacaagugaugauauuuaguaggcaguggaauguagcauauauauuuugaagcccagauggaagauauaggauggaaauaguguuugugccucagcugcuuaaaauguuauuuugaacccauggcuagaguauacugcagagucugaauagucaggaaagaaguaggccaagcaccgaacccugagaaugacugauucuggaaugggcaggccauaaagaauauuagauagguucaugucagggaaauaaaccuuacaaaacuuuaaaauuauacucaugcguacauuucuauucuacaugccaacuguuaauuuaaguuacaggacuuguuuugauuacugccuuuauauagaaaauuguuaagaaagaugaucuuaaauacugagaguuuuaaaaauuauccuuuccaaugaaagauacuggcuugcacuuagcuuucaguuauggcuaaugaagagaggauuucaggcuguggaaagggaacccacucaguaaggguuugaucucuuccuguagccuuucuucuuccauuuuuuaagagaaugguuuauacauuuuauuuguauguauuuauacauauuuauuguauuuacuaugugccagggagugucugaggcacuauaugcaguauguaaugaaagauacugaaauuccugcccuggggagcuuaaauucaagugggucagauaaauaacaaaccaaauaaauaaguuaaaugauauagcauguuaguuagauugaaauacgcguaauggagaaaaauaaagucagaaagaggcauagggagggaauccaguguuggaggcaaggggugaaaucagggcuggcuucacgggugugcaaucuggggagucacugagggaaccacauccagaagggcuucguauuugguuuaauacucaccaucaccaucuagagcuuaauaauuuuuuaacaagcuauucugcauuuucauuuugcacuguaccccucaaaugaugcaguugacucugguuguaauuuuaaauacggugggcgagggaggccuguaugugaugucuuuuauuuggaucaccagauacgcucuccacauuucucuugaacucuuugucccaggagguuauguggauuguaguagugggcuccuuugcccucuggcuuccgauuugguacacauaaugaggauccccaguugaaguucaaaggucacugcuuuucucaagggaggccugucuacccauaucucauauaccggguucuauaagugcucccagcccuuguccagcagugguaacagcucugcuuuaucaggccugggauaugcauauccuuccuagacucccucugcucccugcccauaccuuuguuaaaucuuucuuaaauuuuucuacuuugaguuugucaucuguguuuugucagcacucugacggaaaaaaccucauuaggaaggcagcacuggaguagacuccugaaaguggggaggggaagccaugcagcuguuuggaggaagagaauuucaggcacuggaaauagccgaggggaaggugguagaaggaagugggauugggaauucuuggguagaaguaggagugauguaguaaaugaguucaguuucauucauuuaaagcuugaaauuucuacuaaccaccaaguaaauaugagauaggaagaaaaacuagaagaauauguugcccuaggaguuagggaagaaaauguuucaaggaggaaggaaggauggagcuaguauguuaauguagcugaaggucaaauaagaugaggaugaagaauggauaagugaaguuagccucuuggagucauuauuaacacugagaagacugguuucuguacagugaugugggugaaaaucugacuggaguggacuuaagagaaugggaggagaaaaaacaccaguugugaguaaagacaacuuuuugaaggaguuucacagugaagaaaaggagagaaauaggaagucacuggaggcagaagcagagagacagagauuuuaaaaaauauauaggauaacaaacagcacguuaguaugcuauuggaaaagaucuuauagacaggauaauauugaugacucaggagagagcauaagaauugcuaaagccauguccuuguaggugaaaggggaugagucuaguaaauaaguagagugcaggccuggcuaugagcaagaagaggucucagggcaugugacauugagcuauuuagcagauaauaaucaaucaauauugacuuucagucuuccuacaguacaaucuuccaauacuuugugagcaguuaggacguuaguauauaaucaagaucuuggaguuuaacucacuguuuugucacugaugagcuccaagaccccagacaaaaacauccaaccuuugugagacuuaguuugccuuuaauuauaaaacguaguaacuacuggucauugcagugccuggaaaauuaaugaguuauauaaguaaaccuccccaggugccaaaucucucugacauugcugcuacagaacuucauggagagaaaaaaaugaaaagugcuuauagacagagacgucuagaaaugaccaguggagaucuuuucacagucuguuacccgauuuuguuaaccuuaaauuuccuccagaugaaagguauuuagucucuaugccuuaauacucacuguaauuuucauuucugagaaaacuguuuuguauaaaugcacguuuaguauucuacuugccauuauuuccaugagaaucuugcaugugacacuugaccacagauucaucauccuuggagacacagcucaaaugucacugccacuggaagacauuccugagucacccccagggagaacaucuccuucuuguuccuauuguacucuguucauaccugugcuaugacacugaacaggcugccuuguaacgaucuguuuacauuucuaucucuuccagaccaugagcaccuuaucuuaccuuccucugaguccucagugacuugcacaaaguagaugugagauaaacauuugccgaaugaaugaauuuaaauauaaauuucugaaaggaggcuggucaaauaaaauagcaugauaugcgaggaaagauauggacuaaauggauacuaaggcagaagguuuguauaaguguucaugagaaaaggagguucaugaugcauauucuuauuaauucuaaguauuuuauaaagaggcccuauuuucaaaaauggcuaugguaaaaagagucagggaacacauucuugacuaggcuuuaauauuaaaaacagauuuuggagcugcuuuauuuccuuucuugguaacauguauguacagacagacuuagggauuuacuuguuuccuuaagaaaguauauacaugcccuuguucaacuuuuauuucuaggggaacccugacaucaaugaacuacugaaguuauagcuucaauaauuucaaauaagagaggauacaaaugaauugaguuuauguugugugaauuuucagaauugaacuuccuggcagaagcaaaguugcuuauuauuauuagauucauucuuucccaacccaguuacuccuuuuaccccugcugugaggucucugucuuugaauucuuuauuaagcuuuuuaacagacaaucugcuccagcacuuucugaggagaaaaaaagcuuccuuuucuccccacaaugccaguuaagccuuccauuuaauaugaaaucaaguggagacaucugugcuuugucaucacaaaagaaaaccguuuuauuuuucuaauuauuaucuacuuaucagccuuggguugagaauucacuugcuuuugugccaccuugagaauucagucucaauucuccacguccaggccuaagauaguaucauucccuuucuauuaguguuuaucugcaucugccuuagagaaguuguuuacauccaauauuggacuacccuucacauuaaguuuaaauuggaaacuucuuuuucuaauagagauaaucuguauaguguucaggaaacuacaauaauucagcaauagaugaaaauguuuuaaaacugugaagggcucugaagcugauguuuuccauuaucaguuguuuguuuagguaaauuacauuaaaggucagaaaugaaaugcccauaccaacaacuagacugagaaguggucuauuacucacugcuuucagcuuauauaaaagaguuuuuguuguccccaacucccaggagggcaacugcugggaaggaaugaaguuccuagaagauaccaauccauauugaaagggagcaacguguugguuacguuuuccuuccaacauaucacagaauugaaucuuuuuuggucugugcuuucuuuuuguucuacaauauauuuauuucaaaaucucucauagcacuucaauaccuggaauaucucaaaagguuugcugacuauuguuaacagcucugacuaaacaccuauuucuuacuacaaguguagaacgccagauaggaucaucacaguaggcaccucacaaaggucaugcagaccuuagaggaaauuauggcccaacaagccacaggagccagagaagucaaaccagauguauaagugacauaaguggguuggagaauagagaaagcaaacauugcaaugcagcgauaucaggugaauuugaaaagcaucugcuaccaaauacagggcuugcugaugaguaagggagaaugagagcuguugguguaucagagcaguucuuccuauggauggcugagauucaaagcugguccaccuuucagccagucaaacuuuaaacuuuugguggcagcaaacaucucuaacauagugggauuccagaaggggacuaagugguuucucagucuguagaauaugagcacuccacuagaaaaacaaaugggaaauaaugacuucuugacgauggggaugguaaaaaacgaaaauauagccauuccucuuuaucuaccucacaucaagcccugcugacuguuuagcaaacaaagcuuuccaaugaucaaugauguccuuuccaugacagaagaaucuugaacucaucaaccuagauucgauauaguacuaggguggaauuaaugccaucucuauuuaggcugguuauaagaaaucaagaacacuaugcugaaguccuuccuaaugaucuccaaaaguaaacauauucuacaggaaggauucacagugucauaaaauugaaguagauaugcaucaaucaaguaccucucaggagauuuuaaauuuuuaugaaaauaaccauuuauacuuaucagaugcuuacuguaggcugggaacuuacuauguguaaaggcuaaccucauugacauguauugucuaauguaauccuuacaacuaucuugugaagcaaauaugauuacaaauccaauuucacagaugaggaaccugaggcuuaaagaguuuaaacaaacacuuagcuguuaauuggcagcuugagcccuuaacaucuaugccaugcugaguauaaaucacagcuuauucauuucucuaacuucugaccucuagugucaucaugacaauugucaggucuacauaacauaccuuaaauguucuguuuguaccaaagcuaaacacugccagcauagcucccuggucaacacgggguccguaccucugccccugucccacuccuagcuucuaccuagacugggguccuaaaagcagauaaugcuuugaauucuuucucuaacagccaucaucccuuccuuuccaaagaaucacggaacuuggcaaauauuuuaacagcuauuuuaaggcauuuaaaagauuuaauugcaacuuauuacauuugccuccuaauguauuuccaaauuuuauuucucccaaaaguuauauaaaauaacuucuuagagguuuuaucugggaaagagacuucugguaaauguaucacuuuuuuuuuuuccccaucggcaaggugcuucagagugcucaaaaauguauaaaauacuugaauuauaacuacaaaauuuuaaauuucuaaaauuguggguccacaaaaacuauaaauccuaaucaaucaaucuauguaagaaaacaagcuuauggccuucaugguaagaccacuacuggcugcaaaauggcacguucuguguauaacgaacauguucauuugaagagcuuaucacauugccugaacaucaacucccgucuaggccugccucggugucauucuccaagucaccuuugcuucaaaaucuuguauuuauccuucacucuuuuguauccuucuugaccucuucacaagcaccaaauauuauuuuuucuuuaaguagcuuugucugggagggcagaggucagaggcaggcugcuaggaauggacuagugaaauccuauggagguuucuaaggaaaucuuaucugcugaacugaguuaauguccacuuguauuuuggacacaugcccagaagcuaguggauagcagggucuuuuauaagcaauacaauucccaaaaaccgaaagcaaaaaauaaaagauaauguucggagagcaagagcaagggcaaccauaaacauauacuccacccugcauuuguuuuugaaagcauuucucccauuuccuauuauuauuaaucaggauuuguuuaaaguuuaauuuuaaccauucucuuuuccuguaacacuauauguaauaaaaccauccuuugagcuggggaauagcuccaugguaacagauucucaaacaucagcacaggauggagcuuuuagugugugaucacaguucagcaaaggaggaggaggaggaaaaugaagaaauccacauuggguuucuuuccuucuuugggauaacauccugagaaaaagaaaucagaaaucuugagagguuacugagagugggggaaggaaaauggagucaagugauagaacaagcuuaacauuucaauaugcuaguuauggaauuuccuuuguuuuagcuuccugaagaaaugaaaaauacacuuccuauucaauggagaagaaaauaacuuucaacccugacgacacacuuuccggcauauacugaauuugauucauucauucacuuauucagcauucauugagugccuacucugagcaagcaaagcccuacggugggcaguguacuaggguccagguucauuaguuuuuaauaggauaaaucuuugugaaagaguguuauauacacaacaaauuaaauguuuccaucucaaauaucuggcuauacuagaagccagacaucaaaaucccaccugaacacuacuaaaugggaaggucuuuuauacacuuuucuaauaguuaccauauaacacugacaaaccacuuaaaucuuuauaaaaacuucauaauuugccugccaaguucagccaaaccucacaaauuggaguaacuugauuuaaagcagggcaauaguaaauuagggaaguauuucaaauaagggccauuuuaaacuaucaucauuguuguuggacagaaauccuccuuaaagaaaacugcgaauauuuuauauauggagcuuagauugucuguagguauaugggugcuucuaaagugcuuaaggguguuuaauauaauuuguucuuccaaucuugcuugcacuauuaauuugguuaauggguuaguaauccuuucuuuauagauagcaggacaguaaacuucagcccagcucuuugcuaaauuauuacacucucugaacaaauggggugcagauuaaugacguuuuacucaaaggcuuuaauucacagaagccuuaaaugaagcgauacauccuuguuuccauuuaaugaaaauaauaaagaaaugaaaacugacuugaauacaagguaacagaacuggauaacuaccugccaacauugaaaucaucuucaaaguaugccuucuggcaaaugaaagggcucugaccaccuacugacaaugccaacuauauaaccacuuaaagaugaacaaaaaaaguacuuacaauccuuucuugggugcagugagucucacaauaugucauaaauacauaaaaucauauggcacauuaacaauaaacuaaagggguuuucugauuuucaaguuuuuaaauucauuuaaucauaaagcaauauaugaguccccccacucaaaaaaggcaaauauuccuauuugcacuauucagccaaaaauaaagugaauagaugaaagaauaucaucacauguaauauugucuacaucaguauaucacgauugagcuuuuaaauaacucacugguauuaagaauucucuguguaaggcacaauuaauaucaacaaauccuguauuaaaaaauugugaaccugacaagucaacaaacauuuugaaauauuugcucauaagguagcaccuaauuauaauaaaaauccaaauguaggauaaugaauaugucaaugaaagagaauuaugacuucaaagugggaaaaagaauauguagcuccuuuuuuguuacuaaauuacucagggagaaaauguuaguauuuaagugcagcaucauuacuccugaaagaauuacucauaaauccaucaagcucaaaauaaaugcuacuauuauucuuuuacuucuaaucuucuagccaaccaagauguuauuaaaaacauuaaaaacuaguuaaugucuuugugguuucuuguauugaucgaagaugaugaagggaagagcuacuggaaacuauaccgauccaguaacaggcuugaacuugaaucccaaaccucaauuuuuacaucuauaaaaugaagaaauacugcugaccuagacauuuugccgcuauauucuuauucagcaaucugaaaagaaaagcuuaauuaaccuguagaauagauagcaaaaucaagauaaaagauaucuuguagauuugaagaguacacaucuacuauguaaaagcagguaggauaagaggaacaguuuucauuucuccucauaaaauauucuaugccuauaauaaauuagauugcuaagguuaauggugaauagaaguuuccaaccauaaacauuaucauaggaaauuaaauacucacagaggaaaguuauagacauauuuauaucccagaagagaagacaagauuacuaaugagauuccaaguuugcaaaaauuguggcugggcugaagaaguuaucaugacucucaagauaugcccauuaaauaucauauuggggggacacaguauggacugaagagaaucaucaauguuuucaaaauuuuuuuuucuucgauaugacauuaccacaaccacuuucuauuuaggauucuauauucaguacucaguauuuugucuaugguuaggguaugcugcuaguagauggaguaauggcuaggucauaacuacuggaaaucauucacucauuugagaaaucuuaaaauuucuuuuauuuuuaauuuacaucuaaacauugugcagugcgcugucuguuuagauacaucuauacauugugaaaugaucaaauugggguaauuagcuuaucaauaaccucaaacacuuagcuuuuaauacuuuauuuacuauaauagccaucuauuuauuaaauagaaauuuaacacgucuuuuuuaaaguaggcuaguauuuccauuagauuuuuaaaaacuguuuuugcuagugcuguaguuacaaagcuguguaaguuuugaguggugugccucauccuauuuuuuaaaaauauacuugauuugcagugugugguugugcacauuguggguguuuucaggaccacauauagcauguuacagcagaaauuccguaucauguggcuauaauuuauugaccacguaauuauuaguucuaaugauuuaauuaaauauaauuuguugugacuguauugguuauugaguuaucuacaaauagaauaaauuacacauuuccaaauaacauaggagagauuuauuuaaauaguuuaauuggugaaauacaaucuaaagauagacuauuucugacuaauuucuggcucuuaauaaacuuguauuugacuccaaucuggaaaggcuuuaacuugucaaaaauuaaacaguaaauguggccgggcgcaguggcucaggccuguaaucccagcacuuugggagucuaaggcaggcagaucacuugaggucaggagucgaagaccaacuuggcccacauggcgaagucccgucucuacuaaaaaaugcauauauuagccgggcguggugaugcgcgcuuguaaucccaguuacuugggaggcugaggcaggagaaucgcuugaacccaggaggccguaagccgagaucguaccacugcacuccagccugugugacagugugagacuucauuuaaaaaaaaaaaaaaaaaaaaaaaaagauuuuucauuucuuauuugggaauaggaaauuuucauggugggagucaggggaagaaauaaaaucacauuaauuugccauuuuuaauccuuuuugaaugguuuccuuuaugaaaacugagaauuuacauuuguccuaacuuuuuauuucauuaagagaaaaugcuuaauaucuugcuuuuuggucucucuacacagaaggcagaaacguaacugauuagagauucugaugaauucagagcaguuguaaucagaaacuucaggcaauuaaguauucaaggguggaaccuaauguuuggguucccagggcuucugaggaaacuuacagcaauuuucaugcuuaauugggccauuggauccugucugcgugaggggagaaaaacaagguccuccuuguuuggcauuuaaaaugacuucauuaaugauuacguggaagcauuaacuucagagucauuacaaugcuaucagcauuuccuguuuuucuuguucuaguauuuauuuugcaagaugccaaacugaccuuucagucugucauauaauuuauuuauccuauuaagccauauuguuguugcuuaugaguuggacagacuugcccaaagauaaccuuaccuacaaaagaaccaguuuguguuuuugcaaaauggaaaagauugaugacagacacaagcaaacagaaccagaaagagauuucaugcaugggagaaacgauguuccuaaaccaaguuuuuaauuacuuuaauuuacuuucaguauggguuuaaacugguucauuuuuaaauaauugauuuugaauugaucuguauaccuuaggauuuuaacguuaacucucuccuagugucacucuccacccuuuccucaggcuaagcucauccacuauaacaguguccuuuaccaaacuauuugcugaugacuugcaaauccacuucuccugcacacaucucucuccuacacucaguuauacaagaacgauacuuagauauaaucuugauucuucauucucuaucuuaugccuaucaauuaaucaucacauaccauauauucagucucuaccucuauuuccaauguuauucucuugaugcaagucagcacuaagcaggggaaggacuggaacaaucucaauaguuuccuaacuagucuuccugcucccaucaagcccuacuaaaucuaugcuucaugcuacagccaggaggguuuuucuaaagcacagaauccugguaaugucccuacuuuguuaaaacccauugcuuuugucauaaagccccuggcacggcacuuaagacauuuuuuuggaacugguccucugcuuaaucuguuuaucagugauugaagagaauuuuauugauugucuauuaugugccaagcacuguuccagaugcugguaauauagcaguaaacuagugugcaaaaucccugcccaugaggucuguuaauacagaaaaguagaaaacagauaaacgcauacuuaagaguuucaggacuaauaggugcuguaacuaaaacagauaagagagcuuuacagaaagugacuugggaugcugcuuuaauucuacagugauuggggaaggccuccaggaaggggugacauuugacuagaucuagaauaaucagcagaaacgugaaaaacggaaagaagacccugccuuuaaagagccugggacuggaaugaccuugauauguuugaggaagggaaaagaaaagaaaggaaaaaaaaaaaaaaaaagaaugaccacaguaaaggauauaaggcuggagugauaagaagcggccagaugcacagggcucugcaggccacuaugcaauuucaguuccauucugugcacuaugggaagcuagcuacuggaggguuuuaaguagagagaggagugaccugauuuucacauuaaaagcuuccuucagcuuucuucacuucccacucucuccugaugcuaggcuuuagccauaaugaacuacuuuuggccccacaaauuuccauacucuuucuccaggauuguauacauguuauuccuucagcuuggaauaucuucaaugccucccucccgggccagcuuccgcuuauccuauggaccucucagugcagacaucacugcaggaaggaaaucuauucuccaagcugaaauagacaucccuccuuucucguuuuaagcuuuaguaucauagcccuuauagcgacauguugugauugcuuacuuuccuaucucucccacuggaucaucagcuacuucaaaacccauguugucuaguccguuccuguuuacccagcacuagcucagagcccugauguuuacauauuuacugaauaaaugaaggaguuuuuuaaaaguaauaaugacuauugauugcuuacaggguagagauggcuuaauggaaacaugcacagaauuaggugugcuuaaauuuuuuguuaaugaaaauaaacagaguaugcugcuaaaguccauguaaauguucugguacguuuuugccugauagcacaauuucauauauuccucugguccagucuuuugaauacauuuucauucucgcagcacauuucuucugcugcuuuucuaaauuauuuucuugaaugcuagugcucuuuccuuguuauuuucguuaccugccuagaauuguauuuguucuuuccuggucacuucuuauacuuuauguccagccuuuuuagcucuuaaacauccacauucacuuccaugccauuuugcauucaucuggcauaacaggaaugaccucuuguacagagaacacacaugcugcugcuuuauaccaccauucauuugcauauaagcuuuuaauuuaguagucaacuaauuccucauuaugcugggauugauuguccaguuaauaaauuaucuaggucuccuccuuccuuuuucugcugucuuuuggccacagcauuuuuguauucugcuagauaauacgcagagaagagaggaaguaaaaugcaaauuaaucaauuuugaucauuuugagcagcucucauaagaagaucugauggaagacaagguugaaauuauuggcucaacugagaauuauaagcugucuaugggugucauuuauccaugcuauucugaucaccacuuaacauggauaacuggaaagaaaacgaacggaagaagaaaaaagaaauaaaaguuagugaaaaauaaaaagaaagaaaagagagcuaaaaguaagauagacguuauaugacaauacugcugacccaauaagugagugaagucagccccggauuugaaucaauuucuucuacuguaucuccugcuggggaaacaaucugaaucuuggaacaaauaaccacucaucugacugacuuagcacaccaaggaugaaaaaaccaacggguugacuauccgaacuguuggguuucauaaugggucgcccuuguucaaguagauagaagccaaugaagaguccccagucccuaugcauucauacaaacagagaugcccacauacauacaacaguaacgauuauguuacugauuacaaugguuuccugaucccaaagggacuuagagaguugaauucuuucuuaaaaucuagaagauaaaccuaauagugcuauaaaaucucaggcacuuaaauaaagcaauagcaaacuauuuucuguaaagaacucaggggauggaagugcucauacuuaauucccuuacgacgaaugugaagccaugugcauuuaugcagggucauuccugcauaaauucaauccuucaugugcaaugugccccccaauauaauggcacucauuagugaauuacaaacauuucugugaauauauuaaaagguuuaagagaaauuagccuuuguuuauaauuaggaaacaucagugaaaauguauuuuauuucaugaacuuuucugaauaaauuaaaauuaacagugaaaugccuucccccucccagucacacuucuucaccuaaguucagaccuuuacauuucaugcacugucuugucccugucaaaauccuuuugauguguuucauggcaguugauguuccugaaguuauuuuuauacauacaauacagcaaacguuccuauugagcagaucugcaucuucacaggaagguaucgaagacuguacuguguucuuauuugggcaacuauuacauuaaagauguacacagaaaagcaaguguucagugaaagaagucuuccugaaggcacugggucauuaggcggauauagcgcuccugggacgucugaccuucuaugacauucuaggaagacuugggguuccuguguagcacaugucacuuuauggcaaaaggaauaucugucuggcaaaaucaccauguaauuaacaugaacauugcucccacagagcuguguuguuccuggugggauuuacauagcacuugcucuguggggccugugcuguacucacagggucuaucagggauacucagaauucaccugcccaaggccugggcaggggacugaaauguugacaggaaaagggggaagacaaugauggcaaugucaagggaaaauuaaccuuuggaagguucugacgggaaauauccagagucucuucaaagaagggguugcuguuuuagugacuuugcagcagaauuauuagaaguugagggugagacuaggucaggaaaaccacuaugagacugcugguuuggacgagaaucucacugaggaggaucaagucacacguuaguguugaugcuguuaguaagggggaugagggagcugcccagggccuucuugcuacagguugaugccucuaaucaauaaagcuuugagacauaaugagaaaaaaacaaggcucaucuuaacaggagaaagcagggcugaacaaaugaaaaggaccuuggcaguggagcuacuggagcagggugguugagagcagggaccaccagacugccugacucccagcuuugccacuuucagcugugugaccuugggcaaguuacuuaaccuagcugggucucaaguuccuuaucggaaaacaagaaaaauacaauuaccuaucuaucaugcuggccaugaagcuuacaugagcuagaauauguucacacauagaauaguaccugauacauauuaaauguuaacuaaacauacgaggguagaguuacucaaaggacuuaucgaaaaacaucaacacaaaacccaacgaagacuccuauaacacagaauauaugccagcuauaauucuaauggcuuuacacauauuacaaaguguaauccucauaaaaacccuaugagguaaguaaucuuauaaccuccacuuuacagaugaguaacuugagacagauaaagguuauacaaccuugaagucuaggauauguacccagcacuugguuacagaagaugugcucuuaaccacuaugccagacuuccucuaugguauuaaagagaacucuuagucaugaucuuuugauaucgcauccugggaucggggcuuucuuugaggucuaacucaaaguagugaggaaaucuagcagcauaugaaacccuccaaaagcugccuggucucuugaggguaauuaggccuuaaucaucagagucaagggggagagagugguucuggaauacugaugugguagaaaauggaauaaaucuucccaaugcuccugaaguauccuucucacuugagacuucguggagucuacacauugagaauggugauccaugagcuucaggaauuuggaaacugucuauauggcaugaggucccacaucuguggguaaugccgaguacaaccaucggccuucuuguucucaaggcucuucucugcugucuggucaggagacucagcuccugccugcuggacccccaaggacagcuucauuacuuuaagcagucacccaauuuaaccuacggcugcuuuaagaacagcacuauccugcccagggacucugucguaucauagcuuacuuuuccauaguuuccacacuaucaucccuacacuggcuaugaccagcuuggcuacgagccccuucaaugagugugaugcugaggagugggcaaauccucucuugaagggaaugaugcuucucuaacaccaguggguaccauggaggaggcucuuguucagaaauuauggcuuuagacaaggcuuaacaagguccacuucucuucaauagccaggccccuugacugcaaugagauaggaccaaguuggucuugacucccccacucaagucauuuguaagcacuaugcaagcccuggguguggagcacuggacagaaaagcucagacuucccaucuucccaguauuacuggcaggaggccuuaugccugcauauuaaggaccaagugcaguaaaugacaugcacucagaacugugcaaaggaacacuccaguuucgaacgagaaguacuaucggccauauucauuucuuuuuuuuuucccuuuguccuuucaaauguauacuacccuuaaaauaauuacaaacauggauuuuuaaaaagcaauuuaacuuuaaagcauugaggagauauauauucccaaggcaauguauaaauuccacguaacaagaccuaaaaaaggguucuggucaucuuggagcaacguuucacaagacacugucaagcagaaaaagugguauuauuaguuuagucacugugugcuagaaaaccaaggauuuucaaggguguaaacaaaugaaauguugaaccuuucgauguuucaaggucucuauacugacaaaauguucacaacccgccuggggcgauaaucuugcaacugcuucaagcaaagagcacuaaauuuaccuccuaauuggcugagacacagccacaaaaaauucagguguuagaaaacaguaaaaaugaaucauuagaucacucuuaucugaagacagccugaaacagcaucucaaucuaauauuaugaaauacuucauauaguggguccugucuagaacauuaaaaaaucagucauuacguaucaggugcagggacagauuaaauuuagaacucuggccaaacaccgucuggcaacauaugaguauagcuauaggaacaauuuuccuuggacuguauuucccaaagaguuauaaacacaaaaacaaaaaugcaacuacaacgaaacaacugugcuaaaacuuuuaagccacuuaaccuguuguuuagaaacagaguuagcaacuuggccauccaaauugaguucuuaggugagaaaggacaggcagaauuaaaucagucauuucacuugcagguuaaucuguccaggagggcaauuaggcaagugcucaaugcaguuaauagucuauucuuuuuuuuuuuuuuuaguuucuguacuacuauucuuuaaacuauuuucugcuggagcuccaaaucaugacauuggguaaaauaaaaaaaaaaaaauguuuauaaguagccauuuaaaaggaagguaguauuggaaacagacauauuuucuuucuguaucucuagaaaucaaauuacuuucuuuuuguccuugauaacuguugcuguuuaagguuucuuguauccaacaauacuaugggaagggggaaggcugaaaaacuuuauaagggugccacauuaaaauauuguaugguauuuuauaguuuuaccaaauuuaaaaccaccagucugcauaauaggcagaaaauauuuuacagagaagauuguggaaucaguaacugguaaaccuucaguuaccuaaaaccuguuuuuccugaaacagggaacuuguuugguuugaucaugcucucugguuggcuagcaauugaaacuguucuucagugcugcaaaccgcaucaagcaagcauggaaaaggcaaaguuaguauguaaaaaugguacuaagugaauaacuccagcugcuuuuccuggccccaaggcaaauagucaucuauaaaaauauuacuuuaacaguauuuuuuacuacuuuuauccagaaggaaacaaaaaacccuucacauauuaugaaauaauauaaaucuguuuuaaaaucuuaggaaguucaauuuaaauauaguuaugugccacauaaugacauuuuagucaaugauggacugcauauaugguagcauuuucauugauuauaauaccauauuuuugcuauaccuuuucuauguuuagaugcacagguacuuacacuuguguuacaagugccuacgguauuuagaacaguaacaugcuauacagguuuguggccuaagagcaacaggcuauacuguauagccuagguguauaguagguauaccaucuagguuuguguacaugugcuauauaauguuugcacaaugacaaaaaggccuaaggacucauuucucauaaugaucuccugcauuuagugaugcgugacuguacuuauguguagaaauacacacauacacauccuuaaauuguaaacaaaacuccuuaguguaaaaaaauaaugaacugguuaaauaaaucaauccuggcaaauccauaggauggaauaccaugcagccaauuaaaaucacaccuucaaugauuacuuagugauauaggaaaauacuuguagcaagugaaauggaagauauaaaacuuuauaugcuguuucaauuuuggaauaaaaauuuaugcauauagaaaauauggguaggaaauacauuaccaucccaagaauuuacugacucuugauaaugagaucaugccuguuuucuuuuacuuuucugcauuuuccaaauauuuuacgagugcauaaugcuuaagucagcugugugugugugugugugugugugugugugugguucugaucuaauacagcuuguauguguagcuuaaaguguguacauuuacaaaacauagaacugauaguaaguugagucaauugcuauggguagugucacccgaaacagaaaaauucuauuuaaauuccaaguaaauacuugauaacaauuggaaaccuaaagaagagggcauuuguaugaaguguuuucuaaacuuaaacuaguagagaaaaccaugacuagagagcagcccauggagguuuuauuuugguauuccaagacacacacaaaaaauguugaauguuuuaaacuuucaaauacacacauuugucuuuaguucaaagccauaccuagaggaacccucaaaauacuuuucaucuucaaguuucguucuuucauaauugaaagcucugaagaauaaaaauauguuuuguuuuugcuacaucuaauguuacucuucuuuacuuggagaacaaaacauuaaauguagaguaaaguaaauguaaaguauggcaaccaccaaacagcucucaauuuucuccucuaaaaaaaaaacaugggaauuguucuuaaacaggaagcuguuucuccuuguuaguauuccaugcccacgcauuacccugguucuguggaacuccagaggcaacaaagucaacuugcuauuuuaaaauacaugcauaaaauaagcaaaauacacacauguaaaaaaaaacgcaugaaaaauaacuuauugaggaaggaacuuauaaaccucaaaauauaguuaaaacaucauacuccugccaauaauaaauaauccguaauuugaauaaaauaauucauaauaaacagugacuguguauguguguaaauuaucucuaauguacacccuauggauguuuaaugaacaccaaagucauuaguaauucccacuccagggcaguuagcaucagaagaucauaaucaagaguccacacuacagagaugguugugucaugcacuucaaauaucaccauuauuucuguacaacagggugaguuaauucgcguaaguaauguuaaaaacaaucuuugauaaaaaugagugguauuuaagagaggcgguuucccagaaaaaugauacagguaucucuacguuccaugaacgagaguccagcagcccaauagucaaauagcacacuaggucucgaguuugcuuuagcuguguggcccccuuaacugaggacaccaucaccugagcagagcagaaggcuuucugauccuaccacuauaauacuguugcaucuucuagggagugaaguuuuccuuaaagcuaauuguuggaguagcuuuuccuuaaagcuaauuguugaauugaguaggaauuaacaaguuguugacuaacugcacuugcauacugauaaauguauggcaguauucagauuauaacuuguuuucauuuuuaaaauggggaagagaucuauaucuuccacuuauccucaauuucuagaaaguaccaauauuucuuuugaaagccugacgacuauaaaacucagcccaugggucaccuucuuggucaagcuuucucuuuaugccucaaguugaaaagacuacuucuuacuuuauaccucccacuguaucugguauuguguuuauucuaucuuauugcagaggguugauuuuuaaaaaaauguuugucuuccccacugauuuuguguuucuuuacacauugaaguguggacuagggaccauguaaacuucaugguaacuuccugcaacuuucuaagacaggguuuguuaauauguguggcuaugaauuugacagcagcucuguguuaaacauaaggaaggugugggaggauaaaaguaguaagaaauuaguaucacuagaaauuccugagaaugucucaaauccuuucccaugggccuucuuaucauuggcacaccauucagggaugcauacuucuuaagacugcauucuugugcaacuaccacaggagcccagcucggcaggugugccugaaaaucacuugguugggccacaucuggaaaacacaggcaauaacuucauaaauaugugaacacaacucuucugagcuaugacaaccccacgagccauguuuccaugggggauaaauagauuuguagcaauauuaauaagcaagauguagucauccgggacaauuugaaagcaaaccugcuacuaaugcauauuuccuacaguaauauuuuucccuacaaccuaguuuuaaccuugcuguuccaauaagaccccguaaaucgaaguuucuuuagcccguuaauuuaauaugaauauucuauaccaaagauaauauugaggaauacugcugagaaagcugcagagcuggagaaugaacacugcuucuagaaugucuuauguuauauaagcuucauucuauaaauauguuuggcagaagugucauucugcauuaauuuugcuacaauauguguuauucugaggaucugcaauagugguggcuuacagauccacuauaucaaaauuuccauauugacaguuacaagggagaaaaucuuaacgccaaauaaacuguuaaaaaagauauaguuuggugguuacauaugcagucuuauuuuaaaucuaauuaauuauuuuaagagacugaaaauaagucuuuccuguucuaaagcuuugacuuguuuuucauuuauuguucuguuagucuaaaaagggaaaccuaacauuuucuaacugauggacagcagugaauuccuuuuuacugaaacacccacacuuaaaacuucuuggcaguuuuuaagguagugcuggguuaggaagaagaugagacuaugucaacuuuacuaagaugaacaucuggcuucuagagccaccaaaugaaggcaaaaauauaggagcugaaaaauauuuugucauacaaaaguuuuccagugaagaaaucuaauggacagagagucuagaagcuuuaagauauuuuaaauaauucuauuuaauacuucuaucuaauaagaaaaacagacuuuaaauuuuguguuuuuacauaugugaccaaauauaaaacuuaaagaaaagaguguauuaaacaaaauauaggaaauagaauauaucaaacaauucagaauuuugucuucaacuuaaggaacauguauuuagcaucuaugucauuauuggaagaagugcugggauauaaagaugcugauaaucucuuaugaugcacguauucaucaucguuuacuucuguuguaaguuagugaaugauuuuauucucauugcuguagcauuacuauuaccaccagaauuuagcuucuuuuucaauguaaaaauaaacuaaaauagagcaaacuuauuuuuauuccuccauauuucagaaagcucuaggacagcugcucuuaaauuuuaguguauacaauaauuacuuggacaagagaaccuuacugagaagaauaaggauggaaccaaagaaauuacauuuuaaaauaagguaagcagaggauagaaacacaggugcuuuaagaaccaucauuuuagauauguggcccuagaacuguaacagcaucuauuuuuuuuuccaaauacuauucagcuauaagugguguguuggaaaauguuuaacacuuugguuucaguguggugaagcugauuuguagugucugccuauuuuguggugcaaauucucucaccauggccaaaaucaagucaucggguuaaaaugauugaacauccagcugggaaguggugcucaguguuauaccauuuuguccaccauguagaguaguaaaaugcaguaacaugaauagaaagcgaagucuugaggauuuauuaccuuuaauuauaaguaacgauuuuauaaaauuugacuuuuaaucauggcuacauuuuaacaaucaaucaaaaaacugaaaacuuaauaaccaucucccagaagucaauacaaaccagucccagcacaaacuggccauaagagucauuuuauuuuguccacuuuacaacagucugauauauaaguaacaaauaaaggaagagauucuacuaguuauucuuauagcuuuuguuauaagcaaauaaaaugaaaucaaaguuauuuuuauaugcaaugaguguaaauaauugucuuuucauucaaacaucuucuauaccugaaaaauauaguaaguuaucaaaaaauaccaauggaggcaaagcaaauuugggucagcaggcacuguucuuacuaaauuugaacaauggagguuuaguuaucgagaaaaacaugacuugaacugaggucuggcagggggagaaaggcauuucugacucaggggaauuuuuggugaugugcuacuguguguagcuaguucuuaaacuccaaacagcauguguagcaaaacagucuacaaugcacagauuugugguauuucuaggaacagacagauggcuuaucuaguacuucccaacuuuuacgguaagcaaggaaaaacuauuuaagagggguguuaucaccuugcagggcccuaggacaccgcagcauauucuaccagggauuaacuaaaauuacccagguuaaaagaguuaauauuuauuuuccuggcaggaucuuacucagccauccaugugccaugcugauaacaauuguuacuauuguaauaguaaggaaaauacaggaguaaaguuccuagggaacugccuaacuaggaaguuaguaaaggaucuggacucugaauuugauuuaaagaaagaggaaaacacacguuggcuauaaaagaaauaaaugaaauaaccauugcuacaaccuuuuuagcacggguacugucacgaacauaucuucuaauguuaauuaaauaaaauauuuuauuuuucuaccuuuuguacugucuuuaaaaucaucuuugacacaugaguuauuuauguggcucgcuuagguaagaaucucuugaggaagagcugagauauccugguuccuuuuucugcuucauuaugauuugaaugcuugcaccaaagcuucaaaaacaagguugauccaaauugguauucaggaaauuaaguguacuguucaauuccuauaauugaauuagaagcugacucucuggauuaguucucuauauacuagauagaaaaagguuuuuguguuaaaaaaaacaaacuguuacgguuuacacuggugcugaaaagaaaguugagaauucaccacuggcaagcauauuacuugaaaauaagauuuucucaaagucucuauauuucugcaaauauucuagagcuaauucccacauauaaacugagaguacauucagagguaaauuuucaaacucuauugauucuauuguuucaggcuccucucaccucucaucucacaacucuucgaacacacaacccugcuugccugaucucucugccucgcuauuaccccuuccccacguugccaacucaccucuauguuccccucccauucuggcuuauucucauuugggagcugauuaauuuccagaaaaguaucagcugauuaaaaaaaaaucuagaagucuuaucuuacaaacuuaucuguauuuaaaugaauuuuacuuacccaaacuuaaaagcauaucucucauuuaacaaaggagggugccuuugcuacucuacuuccccacagaacaggcucagagugccagccuuuugcuucagagugccugucucauuauuugcacucccugucuugugaguucagcagcugcaugagagagcaguuccaccagugugggcuuauuauguacagaugcaagcuuuucauuaggggacuaauugagauuugaauagaaucuuucaaggaaauggggaagaugcuagaaguuaagauuuuacauauguguuccauuuguuaaccuugaaacauuuaaggauaauuauugaucaugaguuuauaagaauuuguagaucacugaaaaggcuuuuaguuauacauacuauguuuguuagcaauauggggcaaagcaaaaaaguauguauauuuuucaacaguaauuaauucaucuugugguauaaaaaucauccauuuauuaaauugggaguugaagaaagguguuccuauuuuuccuccaguaauguaaaacaucuauauccacgauacaauacugaguacaaauucccagcauagugugacauguuucagucuacauauuguaaauguaaacuccacaauucagauuuuuaaauuaauuuuuaaggugaauaaaaugcaaugcuuuuuugaguuaagaauauuaaaauauauucucuaauuucuaaauggcaaaaaauaaacuaccaaauucuaauuugccauaugguauucuuauuuuuuucaucaaauaucuacucaauauugagucaguauauuuuuucugagauauagauauuuuguauuuuuccaagaaaaccaugcauagaauaugcuuccaaaauggacuaaaauauucauuuuccuacguucagauauaauuuaggcaagauauaaauggauuuuaccugacaauauguuaugaauugucaaaacucuucauccaaaauaaaacagacccauauaaacuauuaacaacagacugugccuaaaauaaaacuuuaaggagauaauuauaagggaagucagccuaccuaauuauacuuauuuuaauaacaaaaaguacauauaaaguuucauuauaauuauaugucuaaggugauaugcuauacagcucuuaaacuucuuugaaaaauuaacaggcaauagaaaucaaauucucuuuuccaagaaagagaaugaucacuuucuucaauuaauuuaaagccuuucccuuugaauaugaaguuuauccuaguuucuuuauaacccaguagugguuguaagagcugagaccugaagauuaauuuagccgcuagccgagucagcccaauaaacaccuggaaugggcuauucuagucggcaggaagaucuggccuccucucagccuuacuucaaugucuccccagcauuuaaauccagauguacacauaaaagagagauucugagauauccacuaggcuuauaucuuaugacaaacauauuuuaagccuaagguagaugguacaauuccaauccucagaaagacuaucaaagugagacaauacacaugacuauuuuaaauuaaaaauaacaguaggggaaaaaauaaacaaacagcauaagaaucuaaccugcuauguguuucugacaguuuuaguacuuacuuuaguauugucaauuugacaguuucauuuucugacaauauguuguuugcuuaaaugugauaaaugcagccuuauugguagaggugggggacagauggaaaggcaccucuaugaaccacauuaguccuuuuuaagacuuuuuuuguaacuguuuuugauggucugucaagcaguuugacacaguagucucuucagggcauguuuauuugcauauauuaggucccuuaaaaaaauacauaaggaacgcuuauaaacccaaagcuuaagcuaacacuuaauagguacuuacuaugugcuaggcacucagcuacauaaaucuguaucaauuugucuuacaccaccagauccuucagaaacucuuugcuuagaggucaauuaaaucuucagcuauguacaaaacuaucacaugccuuggguaaaguaugggcauaggagcauagaaauuacuguguccuuggacuaagaauagagauucaaaggacagggauguagaaagaucagaaaagauccugaaaaugaaacugaagaaaaugccacaauccugaagcccaauaaaauaaugaaguaaauaaauuuuaguguguaggcugaggcaauggaagaggaauaaguaagggauuauuaugauuuuuccugaaaggauaugagcuggaaaugugcguucuugaguacaccgagguuggagcaggaacaggaucucgagguguauaauguuaacaagauucuuuguuuucuaucuugggucuaauuagcuuaaacucagcuaucagggaccauacagaauagggaaaaugauagcaugcuaauaagcugaguuuugucauuguggagcccuauaucuuauugcuagagauugaagcccaguauuaauauuaauauuaucucugugaauuuuauaauagcuuuaucaaguagguaccaacauccucaauuacaaugaggaaacuaaaggucagcaaaaauaauuuacuugucugaggucacagagcugguucuuaagucacaauuuaaguaaucuguucuuucuagcucaaaucagauguuguuucuauuacaacaggacuaaaucaugucaguaaaugccauuaucaaauguucacauguugaaauaugggauuuuaaagaacugaaaaaauuuaaacagucugauaauuagaacaaacauuuaaaaaaauuacuccugguauauauagacagucuuacucaauggaagugugaauguuuaaguaaaggguuuucacagcauuuuacuauaucaggguucugugaaaaauucaauaucaaacaauugaaagaggaagaagucugucucagguuacauuguauuuucaauacaagaagaggaaaaauacauagaaguuuaagaaaaugcagaaauguauguaaauguggagaagcaagcucucuaaggagucaaagguuuacagagaacagguuagcacauaauccaacaaguucauuguaguguggagaaaugaaaaccaugugaccugaacacauuccuaaaccccauggagcuuuggucccuccauaaaaagacauuggacuagccuaucauuaaguucauuauaacuauuaaaauuaaaaaucaaguacuauuaauuuuaugucuuuuauggcacaaauaaauauuuucuucagaaggaccuuagugggucaugcaagaacccacaauaaaagaauuacucuccaauuugcccuuccuuuggaugacuuacuuucuagauaacaagaauacaauaaguaauauuccucaucauugguauaauuccuaaccuccgucaguguuacaguuaguaauuuaaauacucgauagcaaaaccuauggacuucuucagcaauggaaagaccuuauuuuacuuuuaaugcaucugucugcauggucucaaaacucaugacaaguuuuugcauauauuugaucuuuaaaaaaucauguaacgacugcaucuacuugcaguauccuccaucacacugaacagcaccuccuccccuccccuuccacauucaauuuguaaucaagaccuuucaucuuccaaauaacucuugauuccaucuucaucuaccaugaagccaucauccaugaacugggcuacugcccaagccacuaaaaggaucugccaacauuuacaucuaucauauuucccucuaaucugaucucugugcuuucaccagagugauuuuuaaaaaauguaaaugugaucaccccucauccaugcuuaaagcuuuaaagauguaucaugguucuaggauaaaaacaaaaccucucaaugaggucuccaauucaugcaguggucuucaucuuagcugcacauugaaaucacuuggaaagcucuuuugaaaauccuaaugccuggaccccacccuggagauguuuauguaauuggucuggaguggggcuggagagcagauuuuucaaagcucuacuuagagcuccccugugcuaccaggguuaacagccaguucucuagagcugcacuguccagcaugguagccacucaccacagagauuauacucacugacauaaaauuuaaaauuauaauuccauguuaaaugacgucauuuuaaaaugagauacaagaaacacuuguaaaacauuuucuaaaacaugguauuagaaauuaccuuuacucagaaauaagguuaauuuuaacuucucaucaauaucaugacauucuuuuuagaagaauagauucagauaugauaaguaaauuuugguguuaaaauuacaguaggaggugguagaagucagaaugcucaauuaugucugaaguccuuuuuaccaaaagcuauugguaaaauuagauuaaaaauaaauguguuuuagccagaaaaauaucccugaaacaaggcuugucaucuuuuaaaaauuugcaucaacacagucuucugcuuauuaucacuuuuaaguaauggucauuuuaaaauaauauaucuucuuauuaaaugucucuaauucuguugguggugauuccacaucaguguggcuggauuuaaaaaugguucuggugaccuugaaaaucagauguucucacccucuaggaugguagagucccaaggaucuuuuucaguauuaggacuauauacaaugagcuuggagagcaaaaauaaauccuaaggcacuggacuucccauagauuuucccauuuugucauuagauuagaaaauagugacuucuugaaggugacacaucuaggaagaggugaagcaaagauagaaucagucuuuccauccucuacuaugguagucuuuucaggauaccgccuugcaucaccaaugagaggaaugcauauuugucaacagaaagcauuauaaaccauauccacuuaauuuuauugcagagauguuugaucugaucaacaggcuauaucaucauauaauuauuacaaguaaaaaccuuuaauaauggaaaauaugguaauaaaauuucaagaaacuaugaucuauaacacuaauuguuccacauaauuugucaauggcacauugauauguauuuuucucucucuuucauauuucuauaucuaguuuuuaaagagacuucugauuccuugaaagggagaggcuaucuuaaggaucuuucguauuuucugcaagccagucccaaaccaggcauauaacagacauacuguaaguccuuuuauaaaugaaaacgaugaauucagaaaaaggaugcuuacuagauugccaauuucuguauauuaacaauaaauauuauaaagagucuuuuaacuaacauguuuucauguuuucccagucuaagauagaaacagcuucauauaaagaaauuaguuuagucuaauguucccagaauuauuuuuauaauaagcuguaucaaauauaauacauaguuacuugaaucucaauauauaucuauggaaaauaucagaugaguuuuucaguugcccuuugacacucagagacauuugaaugcuagaaaaacauaauuugcagcaguauuaagucacugagaacagaugagaguucaaauaggaucuguuuuaucuuuucacggaguaaagaugcuaaaaauagcaugggcuuaagcuugggcuacaguuuugugaaauugcuaucacuucacuggaaaauggaggaaaugaaacaagacuguuuuagggggccuccuguaggagauggacuggcacucacguaccagcccuucagagcuguuacaccaaaggccuuuuacagcugauagcuaaaccuaacacuaaguaugaucuaaauauacaacacuucauuguacuucuauuacaguaugcaaauacaaauaaaguuaccacaaauuggcgaacaauuaaugagauucauugcagggauauuucaucacugaaugcuguuuuccugccaacugagacaugauguauuuaauucuaaaugacaccaccugcucccaccucuaagugaaaugaaaaagcugccaaagggcauguugggaauuaacuugcaggcuuccuuuuaaucaggcauuucuccauaacacugaaagccaaaaacauaacauaaugaaaaauaacacagcuuuguaagucaauaguugaauuuggagugcuugucaaauaaaagaaacuugggauacauagcaugauauuccacacaauaguauucuuuucuugcugugaaauuacuuucuuacucuaaagcaggaaaaaagaaaaaaaauacaauuuuaucugacaugacaaaucaauaagaagugacuuauaagggagaaaacugaagggaauguuuucauuugucauaguuaccaugauaaugacacugugaacuuaaagagugucuuuuauuugagaaucugaaagugcuucccaacccuuaauucauaauguugcaauauacccccagugaaguauuaacaugcuguauugcacauuuuccuaauagguaagaugaguuaguguauggacagguauuuuauaaagaaccuuacaaagcuuuucuugaagcuuuuaucucuugauuuucaguccucucuccugagcaacugaacugcuacucaaugugaucaguugaggguagaggagggcuuacgcaguugcuuuaugccaauuucuuaucucaggagucugucaaauaaggauccacuucagaaauaaucaaguugccaaggacaaucuugguacuagaaaauauauaauucucccaaauuauuuucccauuaagucuucugcuaauccccaggagucucaaagugacacccuaauuaaaaugugaagucaaaaucacauuugaauuaaauuuguaaaauaauuuugagggaugcuaagccaaaacaaaaagauuccuauuuaauucauuccacaaucauucauucaccuaaaacauuuuucugaauacgcuuuauaugucagguccuagguacuaggaauaggucagugaacaagauggcaaaauccuugcccucauaggguucacauucugaugcacugauaagaaauaaaugaauaaaugguaaaguuccaggaaggacaaaaaaaacagauuaagagaauggaguaggcucuucuacauaauuaguuagagaagguuucuucaaggagaagaauacaggucuauaugaggaaagggagggaacccagcauacaucauuuacacugcaugccuuucccuccugccugcucaaggacuuugcuccugccgauauccccgaucauuauuuacuccacuuucuacuuuuuuuccccacuaguuuacaaauacgcucuaaagucuuccagccuaaaaaaaaauaacacccuccuuugaccuaacaucuccucuaaaagucauuacuuucaucuacuucccuuuacagccaaacucuucgaaauagauguucacacucaaaguuuuauuuuccuuucauuuguucuugaacccucacuaagcuggguuugagcuucacaacaaggaaguaccuccuaagggucaucaaugaccuucagauugacaauuaauucucaguccacaucuuauaauagcacgugaugcaguggauuuaagcuaauguaaauacuugcuuuucuuggcuucuagaacaccacucucuuaguagcacuggcuacuuaucucagucuuuuuggaugacuccuuuucaucuuccugagccugaacauugaagugcuccagggcucuguccuuggaccuucuuuucuuuacuuauacucacucugccucauccagcuccgugcuuucaaacagacaaguggcuuccaaauacaucuguagcauagaacccucuuuaaucauauauccaacuguuuauuugacaucuccacuuagucgucuuauagauaucacaaauacaacaaugccaaaaucgaauuaauuuugcgcuccgaugcacaccugcuauucucacagccuuccccaugaugguggauuguguaguccaaagagggcugccacaauauuucccaucuugcuugcucuucuugcaaugugaccuugacaugucucccaucaaaugguaguacaucuguuuccuauccuugauuccgugugaaccuuugugacugucucauuccauagagaauaguggaaguaaaguuaugugaugucuaagacuagaucaugaaaaugcaauuccaauuggcucucuugggucagucagucuuggaacuuagcugcugugcuguguggaaguccaaacucacuugccuggaaagacgaccuggggaagcuguguguagguguuccagcugacaaacuagcugaaguccuaacuaaaagcaaacaucaauugccagacaugugaaugaagacacuuccagauaauuccagucucucaccacugagugaaccccaggcuuugggucuucccaaccaaggcuuuagauauugucgaauagagggaacagacaagaugccccugcugugucccauuugaauuucuaaccuaucaaacaugugaguaaaauaacauggcuguuuuaugacacuaaguuuguuaugaugaugguaaauggaacagauuuaccaguugcucagaacaacuuguacucaucuuuagcuucucccuguuucucauacccaccuuaaaucuguuagcaaacccuaugaaguccagcucuuucuuugaaauacauccaggauccuacgacuucauaccaucauaucuuuugucuggacuauugcaguagccucuuagccuucauguuuucaccuucccucccuuauugucuacucucaacacaauagaaagaguacuucucuaaaaguauaaaucaguuaugucacuucaaugcucaaaacuguccaauggcuuccuuuaugauauagauuaaaagcuuaaguccuuaauggccuagaaggcccuucauccucugagccuccaccaccucacugaccuuauuuccuaccguccucccugccugacauguuacauccuaggcauacuggugcccuugcucuucccuaaaaacaccuggcacacucauaccucagggccuuugcauuuucuauuccuucucccuggaauguacuuaccccaaauauuuauguggccacucuuucauuuccuccaggcuucuacucaugagucacuuuguuagguauucucuaaacacuuuccauaaaguagcacaucuuaugcccauggaucuuauucuucuaauuuugacuuaccauuaccugaguccuuauacauuuguuaauuuauguucugucauccuccuguaggaugaaagcuugcuaaggauauaaacuuugucuuguugaaagcucuagucacugggccuacaguagucucuagugcauagcuccauaaauauuccuuauuguuaaaggccauacaagcagaggggagaacaaguagaaagggcugaaacagaaaccagccugacuugcuugagaaacaguauaacugggacagaaugaaaaugggggagaguguaugugacaaggucacagagguagccaaagguuggaucauguaggucuucagaggcuaaggcaaagacugauggaaagaaacugaagggcauuugaugugaucugaguggcauuuuuaaaagauuauucuggauuuucuguggauaauugucuauaugaagagcaagagaggaagaagcaucaaggggaccaguccagaggcuuuugcaguaauucagacaaacaagagaucaugguggcuugaacugcaaugguaaugacagagguaccuaagguggucagauacaggauguaucuacuuuucaacguagagcugaacagacaugauagcuugguuauaagacaaugagaguaaucaaggauggguuccagauuuuuggccugagcaaaugguuaaacagugguacaguggggccacuucggaguagguuuacuuuaaacaaggguccuauuuuaauaugaugaauucagagccggcaagcaagucccagagcaauguucaauuguacuaugguuuagucaaacuaaaguuccaaaauucagugaguaaauucuuugauucucagaaugucugggcacugaacacaguagcugaauuugaauaaaaauaugcaaagagaccaauaaugacaccucacauaagaaauaccuaugugugccacugucuuggagaagcaccccugacaccugcacauacagauggccuaacugggcacccugaaaacugacagacuugguauuuggcaggugaaccaucaagaaaauuccauaaacacaaacuucugcccaugaaaacauagcucuucauaacauuuacagauacuggggggaaaaaaucacacuaaaaaucacagugaaaggcuaaacaccaccacucaaguaaagaaugaaguacuugcaugccuuucucccaacaugcacauaauagaaaaagaauuuguaagacaguugaugacuaggaucauuauggaauguaaaauaaugaaacauuguaaguauagcucuuagggagcagccuuuaaaauggguuccacuggcuuggugcuauccaagcagaaaaggcaagcuuaccugacuaucucuacucuuccauaagccaauaacccuuuaaacauauuugucacucagucucuuuaaaauauuuugccagggauuuuucuuacccucuccccuaagggcagaaaugagaacuauuacuguguuaucuuuaaugauaauuauucugacauacauauauuuuaacauaugaauccuuuagauuuuuauccuacccauuuuugagauuuucagggaccaguaagcaaaacaauauuccucuuucucuccuaauuuggaaccaacugugugauggauaaauaaaagaucaaaaugccagcuuuauuacuaauaaaguugaucaaagaacaugacucagagguaccaccacaguaagcccccuaauaccuucuaauacuccugaauuuaacaauugccagaugcucucugagaggagacccuagccugaaagcucacugaauacagaagcagagaauguguccagcagacaggagccagaaggaugaucugagcaccaucauuuccuucucugaaacucaacuaucagagaagucacuccuccugcccuggaaagggcaaaugaugagguggagagaagcaggggcaugucuuccucacaugguuuucccuccuggagagcagaguagaaaugaucucccucuaugagaacauggaguugagaauaaauauucuugcaucuuacccuucaaaguugggcaagggaacuaauuuuaucuacagucagagaacuggauuucuaccuaucaucuauguacacuucauuuuuucauuauuccuuauauacaugaaugagguagcugguggcuauugggcacagagagaggcagacagguuugacacgugcacccucuacccuuagcuuguugaauuuagcuaauaaucuaacuucucagaaucuaauuuucuuacaugaaaagggauuauacauacuuaccuccuagaguuagaauuaaauggaaauaaaugugaaaggacuggcauacagguacugaguugauaccauuuuuuucccuucucuaagucuuauucaguacuaguuuagaaauuaaaaucuguaugaaaucaaacccuguaaguuuuuuccagacccugccacuugguugaucucuugauagucacugagacuaaacauccggcuuuucuggccuuuaaaaaaauuuuuuaaguagacuuuauuuuuuaagcagcuuuggguucucaguagaauuggacagaaaacacagagaauucucauauacuucgaucucccccacaguacaguuucucccacuaacaaugucuuucacgcugcuugcacugcagugguacauugauuauucuuccaugaaccuuuucugacacaucauuaucucccaaaguccacaguuuacaaaaaaaggucacucuuaauguuguacauucuagggguacauucuauugacacacauacaaugaaugacauguauccaccauuauaguaucauacagaggaguuuuggugccuuaaagauccucugugcuccaccuagucaucucccccucccccagccccuggcaaccauacaaugaaaucuuauucagccuuaaaaaagaauguccugccacuugcagcaacauggauaaaacuggggggcauugugcuauacgaaauaagccagacacagaaagaaggagacugcaugaucucacuuacacauggaaucuaaaaaaguugaauacauagaaacagagagaagaauggugguuacuggggugggcaguuggggaaauggggagaaacuggucaaaauguauccagaaaucaccccugaagaacuuauccagcugagcgugauggcucacaccuguaaucccagcacuuugggaggccgaaguggguggaucacuugaggccgggagguacaaaccagccugcccaacauggugaaacuccgucucuacuaaaaaccuccaaauuauccuggugugguggcaugccccuguaaucccagcuacuugggaggcugaggcacgagaauggcuugaaucuaggagguggggguuacagugagccgaguccacaccacugcacucuagccugggcaacagagcaagacucugucucaaaacaaacaaacaaacaaacaaacaaacaaaacaacuuaaaagaaguuauccauguaaccaaacaccaucucauccccaaaacccuauugaaauaaaaauaauaaaaauuuuaaauuaauuugaacuaaaagaaaucaacaaaaaugcacaaugccacaguaauaaaaacuuguaucuucucuagaacaaaaaaaaaguauaaagcugcaguuauguagaaugaguaagucuagagauguaauguauagcaugauacaguuaauaauccagugcuguauacuggaaauuugcugagagaguagauuuuagguguucucaccacauacaugcuuaaaaauaauuacuauguaaggagauggauauguuaauuaguuaucauucacuguguauaugcauaucaaaacaucacguuuuauaccuuaauuauuaaaaaauuuauauaaaaacuuuaaaugcauauauacagauggcaaauaagcacaugaaaagguguccaacaugauaugucaucagggaauuggaaaugaaaacaaguuaccacuacauaacuauuggaauagcaaaaagcugacaacucaaaaugcuggaaaggauguaaagcaauaggaaguuucauucauugcugguagaaaugcaaaauggcacggccacuuuggaagacaauuuggcaguuucuuucaaaacuaaacauacucuugcuauaugauccagcaauggugcuccuugguaucuaacgaaaugaacugaaaacuuauguccacaccaaaaccagcacauagauauuuauagcagcuuuauuuauaguugcuaaaacaugaaaguagccaagacguccuugagcagaugaauagauuuaguaaacugugguacauacauacaaugaaauguuacucagcacuaaaaagaaaugaaauuucaagccauagaaagacauagagaaaccuuaauauuacuaagugaaggaagccagucugaaaaggcuaucuacuguaugauuccaacuauaugacauucuggauauacacaaaacuacggagacaguuuuguuuuagugccgauuaaagauuccuuaaaaaaauguaucuuccauuauuaucaaaugguacuuaaaugcgaucaucauauauuccuauuuuugaguuaagacauuuaggauauuaagcuuggaaaaaaccaauaagacaaaacaucaucacaaaacaaaauccccagccuccuagggauucuaccacaguauaugacuauugcuauuaucaccuuggaagaaaguuuccagguuuacuuagaagaaaauaaggaaaguguaagaauguuuugauuaugagaugaagaccccguagaaucauacauaugaguuaaaagaaacuuuuagcuccaaccccuucauuaaauauaaauaaauaacgaauacauauauucauuaauaauaaugaauuaauuaauaaauaaugacuagauauauacacacacauacagggaaacuaagacaaagaauaccuaaaugacuugcccacaguuuuacauuuaguuagcaauugggccugguccagucuuugacuucuggcucacugcucuuuccucugguucagauacauggagggaaacagauggggagaugcagugaagacucugggcagucagggugauuuaagacaccaggugcuuuccaaacaaagagaauaagaaaagggacaaaaguggcuggaacauguugaagacaaacauugcaaauuuuaugauggagccccaaaugaaauaugcuuuaagauuauggcugaguuccugaguuuucuauuuggaccccagccuugcuuuuuuuacuggccacuaccaaaccaagcuaguagguuuuccuagcuguugacucaguauuugucacaugauuacagauucuccuacuuagugaugauuaaaagucuaaagcaagauugguguuuuaaaaaaaucaguauccuaucaugguuuaaauauaaaguauugagcaagugggccagaaacaagcaagggacuuucuuuccuauaucaguaauaauaaacauugucauaaaauugaaguuacauccucucuugagggcaagauacugugcugacagugcuuuuuacuuaacagcccuaacaaccaacucaagcauaagcauagcagccauaaagaaacaucugcugaaccagaaauguagagacaaaugaaauuugugacaaaaagagaagauggcacuggaugcacagucaaucugggauucagguccauauccugcuuuuuaaccccagagcugaugccuuguacaacugaaccagggaaucacacuaagauuuuugucauacaucugggaacugaauagaaaucaaucaacauuuagaaaccagcuacuaaaucccaggcucugggauacagagaaggagaaagcaacuuucuuacccccaaggagagcauuauacaaagcaaugcuugccuugcaguaggacagagauagguggugauaugguuuggcuguguccccacccaaaucugaucuugaauuguaguucccauaaucuccacguguugggagaaggacgugguggaagguaauugaaucaucagggcgguuacucucaugcucuucuugugauagugagugaguucucacgaaaucugaugguuuuauaaggggccuuccccuuucacucucauuucuuccugcugccaccaugugaagaaggauguguuuguuucuccuuccaccaugauuauaagcuuccggaggccucccagccaugcuaaacuaugagucaauuacaccucuuuccuuuauaaauuacccagucuugggcaugucuuuauuagcagcaugagaaagaacuaauacagauggacuuagaacucauccagugcuccaccuggaugccaagcuucagagagguaaagcacuguagagagguaaagaaaugaguucaaggcagaaauagaacucuaucuucuugcuuccucgcccagugcccuuuccaacacaacaauucaaaaugguauguuauuuuacuaucuuuucuugucuucauuauucaaaaucuuuguuucugacuuuuagaaagagauuuucuaacaaaaacucuccaguuaaauauuauuggaccaaguucucauccuaugguaacuuaaaacacaaucucaauuucuuucaaauacuaagaauauacacuauauuauguuauuucauagacuacuuuucuggaauauaguuuuuccuuuuuggaagaggaaacaguuuaagcuagauaaggaagaacucagauuucacauaccaacaaaaaucuuuguauuacaacccacagcucugcuuaccuagaaagcaagaccugcaagaucacaggugaaaagauaggguuccuucuuucaauacuugguuaauuaaccaaggauaucuacaagguguuagccgaacacuccagaaaauaucacauuuacaaugcauacaaaguauagcuaaaugccuuugccuacauuagccagccauuuauugcuuauugcgaccucagcaaguauugaguugauucauuguaagccucugguuuguagagcaaaggcagcaaaaaguaaaucagaacuccccacuuccaagaagagugccaguuucauuuuccugacuaccuaugaguaaacaacuccuauguaaguacuaaaaugcaggaucuauggaacuuugauucucaauuuaaaagguaaagagcaaggugaucuuucaugauccuuuuccucaggaagcaacaguucugucuuugcuucugucucagaaaauaaaaaaaaaaugcuaugaaauuuaaauuauuauuaccuuauuucacaaacugaaagucuaagugaaauaaaaauccugaaugaaacauuucaccccauuugacuccucaucaaaauuacacaguagaacauauguguaguagaggagcuuuaaggaagaaauaauauugguuuuaagugucuaccuuuauucaagaauaaauuauuaauggaaaaaaguuuuaauuuuuagguugaauuaaagcaugcuuucaauaucaucuucccuucucccugauguaauuaaccaauucagcagauaaaauucaucuuauguugaaacaugcauuuaaaugaagucugaaaaauaauuaacuaagagaagaggcaauuagacaacacguuucuguugugccacagcaaguucgugcuuguaagugugagcacacuggguacuaguauaagaauaucugccauucuaaauaccuauauuauucacugggaacugauuacuuuauucacaugcuauuuauugguucccugcuauauggaagacacugcuagucccuagaggagaguugaaaaguuauaaacuaaucccugauauccuagaaguugaaaucugcuaacagaaagaaaacacaugaaggaucgcagugcaugacaguauaaaauaagugucaugucagcaucaagaagugauaaauaaccuaaaaaucaguuguuuugaaauggaucuugcauugugcccaugaaaaauuaaaugauguagaagaaggauuugaagaauaacuauucugccugauaauaacagaagggcaaacaaugguuauuaacacaaaagaaaugccaaaguauaagaaaagguacgagaugugcaauuaaucacaaagccauaagaaucuuacagcggucauauaguuuauauauaacuuuuauuuaucaaaauauaaaauauuuucuucuuugugauucuaaucacacuaggacacaauuacaggaaaaaaaagaaaagcacaaaauauuaaaaucuaggcacugugauuaacuaauucaaacagauaaaauucaucuuauuucaaaacauucaaauaaaugaaguuucaaaaauaaucaacuaagagaagaggcaaucauacaacacauuuccgaggaacauuuacuaugugcuuggcaucaugaaaggcacaaagaagaaaucagaagggaagcuuuuugaaggaagagaauauaccucauucacaauuuuauccacagugcccauacuaccugacucauaggagaucaucaacuaauauuuuuaaagagauaaacuuagacggaugaaugauugaauaaacaaaugaaggagagaaucucuaacuuuuggcauucauauuaguaacauauucauucuaguucuagaaaaacguuauaccaauuuguaauagaaaauugagauuaaugcuagaaaacuaaauuuaaagccaaauaggaagaaagcggggguggaggggaauacuaagaucugaggaaagauggugacuucaauugaacauuauauuuauuucugaguuuucuacuaguuaaggaaaaagagaagcaauuacuuuuucaguucuuauuaucugauuaaagggaaacaucuccacaaacagacguuuuuuaucuggaaguauaagagaaauuuacauauagaaacauacauauaaaaauuuauauauaaggaacucugugauuaaugggcaaugacaucaauagccucuugcagauaauauagaaaggcuuuucaugugguccuuuguuuugcugacuuuugauaaaaacuaaaacaaugguaauacgcuguaacucaaauaaggcauuuuaugucaguuaagcuuguuguuuucuagugauuuaccgaauuauaaauaaauuuugaaaaaaauguaaaggaauaagugaacacugccaaucucaaauaccaguuaucucccuuugauacuauuagcccgagcuggguaguagucaacuuaacauugaggucuuuacaaagaaugccuagaguauggacuccuucgccugcuaacugcaugcuuaccauauguauaucuagaagcuuagaaccaaaaacugaagaauuaaauuugagggugcuaaaaccaguuuuugaaagggugacuccuucacuaaaaccaagugaaaggggacuuuaaauugaagaaaaauuaaaugaaugaugugccuuuuuucugaaacucaagucaggacauauuuguagacuaauugacugaguauauuauaaaaugaauuuagauuguaaaguuguuuuuaaaagaaagaggauaaaauuaucuucuauuuuuauaucauugaauuuguuuuuggaagcaugucauguaauauauagauuaccacauccuuugcauuuaacauaugauugcccaaauacuuuaguaaagggaaacauacuggagucacauuuacucgaggaacuacaguauauaauuucuggaagaaaagaucaaagaugacaauuuaucauuuuuauuuaccgcuagucauuuuauuucucaaauaaagacggaaaauguucagugguagccuuuucaggcaaagucaagacagccuaggccaagcagaugggugauucacuggcaauaucgaugguuuugucugaauuacgaauuccacugguugaggcuuugcuucaguucacccauagagucucuaacauaaccagcuuugcagugauguaggccuguccagcucuacuguaaaucacuccaugacaaugagggugaauucugaaauucauuuccauaaauguucccugaagugguaccauaaauuuuaacacaaaauugaccuuaaagauuugcuaaaauauuaaaugcauguguaaaauauuuauuaaucuuuucuucauuauuucaaagucauucuguucaaauggaauucaugcacuugaaagaagaauugauagcuuuuuuaaucuuuuucauuuauaaauuucuaguuuguuguugcuguacauucuauaaacaaaauauuuaacuaauagagaagaucauuaggaagugugagaaaguaucaagagggaagucugcaggaauagauacaacaauuggaguauuagaaauacuuugagaaugaaugacaauacagagagcaaauuaucaagcuccccucccgcccaaagcugaauggcauguccaucucauuuaaugauguaugucuucuguuauaagcuaauuuucaggguuuuccaugaaucugcagagaauuuuugaauggccaagaaaagagaacaaaaccagaaaauaugcagauacacauuaaacaacaaaaggaucacaucaauaaacauucaugaagugcuucccuaugugcacaccugccaacucuuugagaaguuauaagaagaaggaaucauaguuucuucccaaaaaguuaauaugcugguuugaaugaaaauauauggauguagauaacacuauuuuuuccuuauaacaaauuuuccuuaagaugaugcuuuuacaaauauauuaucacagcauuuuuauucauuguggcaaaggacaugcgcacauuuucuugaaaacagugacagguuagcaucauuugacccuauccagguuacuauuuuaagguucauauaccuagauauauaauagacaaucauaacuucuuuacaggguacauuugguaagggcagaugccaauaauguaggaugaagaaguggcuccaagaugagucuacucuauuccacaagucuuagucagauaucucauaaaugggggccacuguucacaauggguaccuucaucagaaauguggaucaggcacuaaaaacaaaaaaauuaaaaacccuaaucaaaucaaacaaaccaaagcacaugacuuacagcccaugguuuaguagauucauuuuuauacauggauggcagcauacuguuaucugugauuguuuuuaacucaugacugcuguacauaguugaaaauguuucuacaccucaguuuccaccagcuuucuaggucugacuggaaagccaaaacuacucauaugcucuaauauagagccugcaccugcuaucuguuauuuacuuagcugcuguaguugucccuuuagaggcauguugcuguuugaaucuaauauuuugcucaaauugagccuucccauauacugcuugucuaaauuuuauuugaacuucccauaauaaaaacaaaaguaugcucucuagaccucugucucgaaacuagauuuuccaaauaugugcuugacuuauacuuuccuuuggucauuguucuuaugagaacuaacucaguugacugagacacugaacaauaaggauugccagaaaacuauaaacagugaugccauauaauaauauccuaaaagauggguaagaggaacauugacauuccuauuuaugcuguuacaauucuagcuagaauugggaauugauagguuuaagaaugugaaaucaacuucacucuucaaucauuucaguugugaacccucugauacugaaaaaggaaguaggucaugguuagucauucacagagagaguccuaacagggacauaaauggaaaauacugagguccuguacacaggcacugguaagguaugaauucccacugcuggcacaacagaauugucgaggucuggaacaugggguaacagauauuggguugggugacacagcuugcugaguuguaggauuauugccuuguaugccuaucucugugcugacagcuaugggagguaggugguaggagaagcagcaaacucacaguuuuaggauccuccuauuuaacagagauaucucauuccauaugacagugaagaucaccaaaccuuagguaugucuccaugaaauacauggagcccggggcauacaccuguacccuuuacaacauauauucuuugcuguguuaugaaugaaccagaauagaagcaaauuugaacuaaauccaagucauugaucuuggucaucuuugaauauagauaagaauccuuggucuacccuagcagaaauagaaauuaugacaauuaaaaggaagcuuacauuauuaaaaauccucuucugaauuuucaugaaauuagagguccugagguuaaccuggugguauggauuguauuucaaaaggaauuuuucuuuuaaagacaguguguauguguguauguguguaugugugugugugugugugugugugugugugugugugugccugugucuguguugguaaguacagcucuauauucuuuuuuuaauuauauuuuucccuacauuguuagguggcauuuuuuuguuuacgucaaauuaauauccuauaccauuauuauuuuguaauuuuauuuauaaauguacuauaaaauacuuagacuaugaagaacucauguucuuaggaaaauaagcauucaaauauugagaaauauauaauaaaaucauaagauacggucuucuauucagaauauguauuauuagcgucuucuuuguuaugggccauaaaaaccauuaacuauaauagguucuuucagucaguaaguauuuauugaacaucugcucucuuuaaagcacaacuauaagaaccacgagaauauaacagagucaaaaaacaaaguccugacccugaggaaccugugcagaggaugaagcaagaagauacauacggaaggcugguggagaaauuacaaggcauuaugggcacauagugcaaugguucaguacucauuucugggccgguuaucuguuuaaggauaacucuagguguggucccugcccucagggagcuaacagucuagaaggauaaacacaaauaaauggccauuuucaauaccacuugauguuaaaauagaaauaugcaaaagaaguagagauuauaaacacaauuacuagaagucuguccagaucagcuccauagugguuuuauggagaaugccuauugaaauagaugaguuugugucuuagccuugaaggauguauaggauuaggauagguaaaaagagcaguaauggaggggcauauuagguagugggaacaaaauggacauaaucucugagauaggaaugaauaguaggagcuguguaggggauggugaggaucagauagaccaaagaagagaggguuaggaagcagcugugagguaugaguugcagagcuuagagacagccaguugauguccacuuugaauaucaucaaacugcagaaccuggacucaauuugaucugccauagagagacacugaguguggaaucauuacuguugcaguauggggucucuggaaaggcagacucugaaacagaauuuaguguuuaagauguuuauagagaguaggaaucaaugggaucaauguguacacagggagaaggagaaaggagaaugaggcugagagggaagucaguugacaccacuaggaggucuaccacugaaaggggcuggaagaaugucuuggguuggggucuuccuaccucugcugugguuagucauuggauggggggagcuccagaaaugggagugaccuuggaccaggcagcucccuguagccaagggcaaguccugaugggcugacaggcuauccccugggagcacucccagcaauugggagaagucauuccuugaaggaacaccuggggagucagaguuaccaguaguuuucaaaguaugguccuggaaccaucaguaucucaacacuuggggacuuguuagacaugcaaauuaucuugccccaccuaagaccuggugaauuacaaagucuggggguggggccaugcaggaaucuguuuaccuagucuucuuggugauuaugauauaagcugaaguuuaagaacaacugguaaaauggguacuugaaagaugagaaugaguuuaugaucacugaguaaauuaaggaagugcaaaaagccuuguuugccaauacucuacaucuaacuucuuaauugugcugcuuugaaaccacauguaaacacucuaaaaagaaaugaaauaggggauguccucuuuguuuauuaucaucuccaaacacccaggauuugggugguaaacacuguguuucugaucuugguauuagaaacauaguauuuauuuaaaugcuagauccuucuuucaugccaauuacuaucuccagaugaaaaauucuguguggcauuccuaaaagaaccuccuauacaccaaauauuugcauggcaaaaguucauaucauaauguacuuuuguacuuuuggcuguagguuguucugugucccugaagcaaaacuuuauuacauggaagucuuuggagucuaaaagaguagugauucaccuaucacuugugggauugacuaaaaccaaucagaaggcaggguguucuggaacucugguuucuaaugcacaccgaguccuguggcacacuacuagcuguccccucaaugcauucuccuagucuugcugggcacacagcagcucagcuagggacuacauuucccagacuuccuugcagugugagguggacaccuaaguuugggucaauaggaugugcgaaaagugaggaaugcaauuucuaguuauuuucaacuuaaagacaaucagcuuuccccggacuuccucccaaacccacuccccgcuggggcuggaauaccaaaguagcagcaauccagcuucggccaugcuaaugaggacuacuuacaggauggaagaaaaacauguaaggaacuugugucucugaaugaucuaaagguucagggcuacccugcagucuaagccagaauguuagguaagagagaaacaaaccucuaacauuuuuguuucagcgcuuuacauuagcuuaaacauuuauagacagcuagguuacaggaaaacuccugaaauuaaauaaggaaauaaaaucaccagugauguccuucacgauacugaacugccuggaaaaaauugacuuuaauauuaccauagaugcuacauugaauuauuucuuaaucuugaacaaaguacgaagaagucacaccaguuuuaaaagguagaugagugacucaaaaguccuacugaauaaauaaacaaaggugcucaagaaguguuucaucuauuacugauauaacauaaauuaacauuuaauagaaacuuaaauuuuuaagaacaaacuuuaccagucugaaaaugguaacuauuguuccacaguacaagucagugcuagaagguaagcuccaggaggguaaugaauuauggcuuauuuauuguuaaauuaacagaaccuagaaaaaauuccuggaauaaaauaggcauggaguaaagcuguagaaugaacgaauaauacaaucucuuucaugguccaacauccaugcauaaucugaacagauauauacuaauacagaauugaaagauuugcaccuaucuuuaaauacguuaaaucuucuuaaaaauaaaccaccauuaagucauuuuuuaaaauaacauuaaaaaauucuaugauccuauaauuaaaauuuugcuauuacacuaacugauuaaauucaagauuuaugagcaauugugucaaggaaaaaauauaaacucucaggccuauuaagaaaaauguaauagaaucauaaaauuguauuauaucacagccaaauaaacacaguaaauccucuucuaacaaugcaguaacauuggccuuacaaucuugacuugucuuauacauggcuuuuacuuugcauaauuguguuuuagagauauuuugaaacuuuucuaaaaccuaaugacgugguauaaugcuugggguauaaugcuauaccccaagcacacaauuuauacaagguagaaaaaucaaaaagacuuuauauuuggcauuaucuagucuauuuucagugaagaguuaacuccucuaguuagaccaacccuugcuaaagugggggaagccauucauucaauaaaucaauaaguggaccaguuaucuuuguuccauucuuaggccaaagacugcacucuuaauuaggaauccuuguuauugaucacagagggaaccuggugaguaauaagauggauagcuaaauccaugaaauuacuagaaaaaucaguacaaaaccuauuuauugcauguauuuaaagcaacgagcucaaaugucagcggaaguccaagagaguugguucauguucuggcucugaaguucuuuucugcauaauuuuggacuucacuuuagacuucauuguaccauaauuuuucaauauguucaaugcagauauuauuuggcauccauuuaacucauggaaacauuaauagauuaacaugauaaaaugucuugaaauaaaguaaagggcuauugaaggaagauaugcuauggauccaagauagcauuaaacugauuauuugagaggaauuauccauaguuucaaaaguauuccauaucuuauucccuauuaucuugcacuuuaacagauaaucuucuuuccuauauguuaagcaugaaaauucuuaacaaucuucaaagggaaaaauucccacaaaacccaaaaaauaguuggucucaaaaaaaugaaaccaacuaaagggauacugcacacuaaaaaggcaauuaaaaugauaaaauauuucugugcucagaucuauggcugccaaauuucuggucaacuucucaauuuagaaauaugauccaauuuaaaugcuuucuuuuuuuaaaucccccuuugaaauuuucuggcauagucagaaaaggugauaugaaagaugagaaaaaucuuaauuaugucagaaaguacaaaggacucuuagaaaguaaaaagcauuugaaaaacaguuaaauauuuccuuaggaugaaauagccaaaugacccgacugugguuugaggagguuuaauauguuucaggauagguguaaauccuuuaauauuaccuuuguauaugucuguucugauuauccauggauguuggaccauaaugaccaaucuaugcuaaguagucaguccccaucucuguaucaauucuuggucacuguuuaagagacuuguucuggcucuuaguuuuaaaaucuuacuagaagauagguuaaaaccuaauaugcucuaauuuucuacauuccuuguaugugcuuacucugguuucuccucuaugcgaagcuuuauucuucaagccuauucuucuagucccuauggagucuaccccauuuuaaagcugauagaguuagcuccuuucggucaaauacaguauguucauucuuauucucaacccaggaggacauuucuuuggccauuaaaaaaccuaguuugaaagcgugucugaauuuucugauguguguuaaaaaauacaaacaagaaaucucauugugcuuguauccaucuccaaccugaacaaaacaagugacaaaucaucccucuuccuaaccacuucccuucauuuguaccuuuucucuagucacccaaacacaaagucuaauuuuaaccaaguaaauauuugauaauuucagauaaauuacuuaagacuccuaugaaagcaacugauauucccaaagcauuaauuuuuaaaaaaaauuuaaauaaauauacaugaagacauauauaauuguguacaaacagguuggaagaaaaugauuacaacuuuuuguaaagaagucuuuaaaucuauccuuuuaaauacaacuucauuaguguuauaguuauuuaagguauccuaccaaggaaacagaaaauuuucaauucuguaugcaaaucuugucauccucacaaaaacuggcccccagcuaaaccacugacucuuggacugucccuugaaccagauacaagucagaagaaaucaguauaacuucugcccuaguugaugacagaaauuggcuuaauaucuguguguuaugauuacaaugguuucuagagcuacacacagccugaagguuuuuaagaaaaaguuacaaaugaguuugcuaaaauauucucaaaguuuuaaaauuuuaccuuaaaaaaagauugccauggaaggaaaguacaugggaaaauauuaguuuuucacuuuaauaauuacauuuaguaauuacauuucaauaauuacauuucaauacucagugucugcuuaaaauacauauucaaauaaagauaaaagcuaucucaggacaugguaaggacuguaaaauucaacuuaaaugcauucuguuaaggauaauuucauuuuuacuuuguuccaauacccuagcccacaccuaggaauuuggcuuggugguaguaggcaguauaaagcagagcagccaccaugcgcuaacaaucucaguacaucugcugucauccaacauuucaaaucuucagucugcaauuauaauaggagaagggaaucaagaguuuauuuauuuugggcagcccuuuaugaaugaaugcagucacuaaaaggcuaauugugucuucugagcuauuaauugacuuagcuccaggaguacuguauaaaacauauggcacaagauccaagcaacuguccagggcugugcacagggggcauuuggcuucucuuugaaaagaagaaccgaagguaaucccuuugcagcugcagugcagaugguuuucuuuacaccauuucacugaauacuaaacagaaacuggaaaaaguuuggaaacauaauaaacaaacagcugaguguuagcuuaaaugcucucugcaucuaucagagggaagcauucagaaucucuggauguuuaccagauaguuuaaaggaaacauagagacgugaaaacuggaugaaaugauuuugaaauuguaccuaaauaugguucuaugugguuuucgucaaagcaacaauauaauuaaaucucucugaaacuucaguuaugggugucaugauucauaauccucgacaucauaaaaaguuuagguuuccucggaaauaugcugaaauggauaaagcuaaaaucacccuuccuauaggaguuacuugaaaaucaccguuaaccuucauucuucuuccuuaauguggcaaccuaaaacccugucaucuuucccaaauaaaaaugcacagugaagcucaauuaccguuucaacuucacaucauuuuucuacacuggcagaaagaaaccaucaaauaagagccugguuggugggcaggcaaaaagcaaagucauaucaaugaagagauuuggccuguuaauauucaguagguaauaaauaauaauguauuuagcucacugaagaagacuaagauauuaauacuaaaaacaaaucagguaaauacuaaaaacaaauacucuuagacauugggauugcaguaguaacaaaauaccugucaugccuaucaacauauauacauuauuuuauauauagcaagaaagaccaaaauauuagccuuuuuaguucuaauuaugaauaagauuaugaaaaagauuaugacuaguauuuauggauaacuugcuuuaacuuuuuuuggucaggugccaauccagauuuuuccuaaauaaacauauauuguauuaucuuuauaaagaaaaguuaccuaaaagacuauguuacauacuguauuaauaacaaacgggccagaccaaaagguaauauuacuuuauguaaaauacauuaugaacuagauaaauauaauaauuucuuuauguuuucucaaaucuccuagaaaauaguguuaaaaugaaguucuucaaaaccugaaauaaacaauuacuacauuucucuaacagggcaacuaucuguuucaucaguuggauacuucaugaguuuuaaacaacaaagcaauucauuaggcaaaauauauucugaagcccuacuauccaaugacaccaaaccgaaaauaaucuaagaauauaaaauaaaaauuacuccucuuugccacugcucacccuuucccccauucuucaguuccaaaagcuuuacauacacuuuggaaacagcaguagcuuugcauuaugaaaaacacgaaagacaaagcacaccaacgccaacucuaagagguugguggcugguguaaaggcuuccuuccuaaaugccugccaucuggagccgguguccucacuauucugccuugccggcuuccaucucguucccaacucucagcuggaaauguuuugcuuaucccuuguuuaguccucuuaauuucuuucuucucacuugcuugauuucauuuaacuuggugaaacaguacaauggcugcauuuaauucauuuaucaauauucagcuaaaaaggacuauaagagaauucacauauggcugcugauaccauuucuggcccauugaguaaaaagacucuuaacauuucaaauucuucagugagaaaaauucagcuauaagucacugaagaaauaguuauaaucagauagcauguguugcuaaaggagcuauuauguuacccauuccaaacaucuuaauauacugggggcauaagaccccuuucugguaugucaguuauuaaacagccuaagaaaagagcugaauuguugacaugagaaugaacauuuaagcugcuugucaguacucugguuaugguaagaaccuuaacccauuuauuccugagguugcaauuuuuugaaucuuugccaucagaccuuaagcaguaggauauaaauaacucccacaugcuuagaguuccgauaauggaacacuaggcauaaaugggauuaaugagccucaaauauccucaguggcagaguuugaagcuuggggauaaacagaccacagccuaauucaguuugaaagugauuaauuauaauaaacaauaccugaauuugugaaguaguuuguacugauauguuauuuaagccucaaauauguguuuuucuucaaauuaauacgacuaaauauuugaaacuucaauuaugggugccaugacuugacaucauaaaaaguuuguuucccugaaaaugugcugagaugcguaaagcugaaaccacuuccauuucuaucaggucagcaacguagaacccuguguaccuacccuggggugacaggagaggccauguugaggauaugggggacagaugaaggcuggggugacugaaagauuccccaggcucuggcuucugauaccagacccuauguacuuggauauuuuugauuugcuugacauguacucggguaaugaaaccagugaaauuuauuaguuuuuuuuauugguuugacagucauuuuucuuaaggaaaaaaauaaauauuauugcuuuuuagcaauuuucucuauuuuuauaacacuguaaaauauuuuccucauacaguggagaagcacaaggcuuaauuguuuaaaaaucaccaauucuagaaugaccuuagugacucauaaagaagauaucacagaaaauccuaaaaaucaaaucuaugaaggccuuaaugccaagcauuagccuggugagaaaugugauaaagguucauauauucauaaacaaauauaagggauggcaauuuauuauaaauaucauucugggcuuauucaucaaugcagcuggaacaggugaagguaaguguacaaacaacuuucccuuuucuuuuuuuauuuuuauccagacaauuuuuggcagaaguauugguuuagcuucuauagcaauuuaauuaaaauugaaauagucuguguauuuuuuguuuaauuuuuaagcuaugguaauuuagagcuauuauauacaguaaaguguuaugcaaacauuguaaacaaaugaagacauccaagagaguauuaucauggauaugugcuguauuuauugccuggcaucucguacccuuucuggaaacagcauccugguuuuucuucaugcaaccacccuucccuaguuguuaguccaugcaguuuaaguagaauugacuccaccucuggcuuaagaggggcccaccuaauaagagcauccuaacccucuggccacagugauuggcucagggacaggcauaugaccuaagccauucaauaagauucaaguuagaacuuugcugcuacuucuaccucuauucuucuccagggauaaucacugauagccuguuucauauguacucguccaaccuuauuucucugacacauauauuuggugauggaauaaaccuauagauacauauauccacauauguauauauacauaaauguaccuauguaguuucuaaauagagugguacaauauaggaagugaaucucuuuuacucagauuauuuacaucuuuccauuucagagcaacagaucugcccuaaauucuuaaucucuguauucuaacaaauagagaaaauaauuuacaaucuaaucaauaggauguccuauaccauagcagacuaugaggguagaaaaacccuagcugaagcaacagcucauuucugaucacccucugcaucauuauuuggcaccucaggagugacacaggaguuagaaggagccagugauaaagggggagaaaguccuauggaaguggugggcuuaagaaaaauggagacagaaaugcaguauaauucagaagagagaaacaguguaaucugaaacaagucucgcugcuaucuucuaggagcuggcaucagaaggcuuuauuuagcaggaggacaaggcauauguugguucuaaugaaaccaggcucaggcuagacuuggaauuaaguuacauauccuggaucaggauugggaguuugggacugaagucucaauugucucacagaagauggaggcugggguaaaugaagacagagaagaagggaaaacuuguuucaaaaucaugaacauuaacucauaaugagaacucauaaugagaucuuauuguuugcaaaguuacuaagaacaggacacucauuucguuuuucauuuauccucaccuaaaauuccauguauagaugauacuucuuuauguauuucucucuucuuaaaagaaaaaaaaaggcaaaucaagcaaaugccaagucuguuuuuauuaaaauauacauacauucacacaacuggcauuuucaagugguacugcauuuuuuauggcaacuaguuugcuuaauaaaaacuccuagaagaccugacacagcaugaagcugaauuagaguuacgaggaaucacuuugcaguaaaauguuuuccccuauauuuuaccacuaaccucuuuuuucaggauuaaggacauugugaaaaaguugucauaaaaucaaaggauauagaauggaaagagguacaugaagaguuuuucuaacuuucuaaaucaucuuauuuuuauacuuuauucaauaacuaauucucauuuuaaacugaaacucccucucuuauugaauucauuugagcaaaaauugaagucaaacuguuuuuccuuuuuuuauuugguccuuuuaacagaaaaaaauuaccauuuugcaacauuacuucaggucuguuuuggguaugaaaauucuuaauugucuguggguuaagaauuauuuaaaaacauaaaguuaaaacauuucuuucuuuuuuuuuuuuugagacagggucuugcucugucagccaggcuacaguacaguggugugaucauagcacacaguggcccugaucucccaggcucaaaacauccucccacuucagacuccugaguagcugggacuacagacgcaugccaccacaccuggccuauuuuuucuaacacgccuggccuaaaauauuguuuaaucaaagucaggcuaccagagggaaugguggaaggauguuaacuguagauaaaaauaagaaagcuaagaaguauaauuaugaagagacagaucagaaauucuaagcaaacacaccaggauuuuuuuuuuuuacuuucuauaaauacuguccuagacuaauuuaauauuuauuaacucuacuaaaguaguuccaucacccaauuuguaaagugcauuuuuugccugaguuuaaaauagaaagaacacuuuaaaauuacaccaaaaggaaagaaauuuuacuguacuguuuccucagauaaaauaauuucaucucaacuaauuuccuggacagaaacguauuuuccauacuuaauucagaacacaggcuauuuuuuuaacgcuuaugaguauauuaacuaaagacaucaauucccaaugaaacagagaacacucuugauuugauuggcaggauugggcucucucugcuugugaacaucagcuagaaauugcuacauuaccauuuuacuguauuguuuucaggagcaguucuaaacgcauagucaagcaacauuccaaauuccauccccaguuuuccucucuggagaauuuuucuuaugucacaggaaugguguauaauguuuuuauaagcaauugccauuuuaagguagcaaaaucauuaacuggggccuacuugagguuaucaguuuuuccuauuuuggaaccuacauaauuuuauuaugacuaaacaauagcugaagagcauuguucucuauuuacuccuaagaugaaaauguauaugaccuugaggaaauaucaaaguaaaaaaaaaaaaacuauauaguaaaaaagcauuaucagaguauuaauuauuaauaauaggcuaagaauuaaaagagggagcauuuauaucuaaaaaaaucacaaaccaauaaacuguuuuggcuguuaaguauaugcuucauauuuaccaggacaaccugauuucuuuuucuuuuuuucuucuauuucuuuuauuuuacuuuaagagaaauggacuuacucuaucgcucagaguagaauucuuuuucaacaaaaacaauuggucaaguacagauauauauauauauauauguauauauauaaaauuuagcuguaugaaagucauuucuaauaauugauugcucagaaagaaaccucauuacaaauugguauuuuaaguauaaaauaaacuuaagacagaugugaucacaauacuuaacuuguuaauagaaauuuguuaugauauuuaaucuauuuccuccucaauaugccagggaccauguagguuucaaaaaugaaacacaugguaguuuucuuuuagaaacaaaauacaauugauacaauagcaagccucguaaaaccacacugaacuacaacgucuuaacugugagaugccgagagagggcucuaggaguacaauauaauaaauaaguucuuccaguuuuugcccauucaguaugauauuggcuguggguuugucauagauagcuccuauuauuuugagauauguccaaucaauaccuaauuuauugagaguuuuuagcaugaagcgcuguugaauuuugucaaaggccuuuucugcaucuauugagauaaucaugugguuuuugucuuuggcucuguuuauaugcuggauuacauuuauugauuugcguaugcugaaccagccuugcaucccagggaugaagcccacuugaucaugguggauaagcuuuuugaugugcugcuggauucgguuugccaguauuuuauugaggauuuuugcaucaauguucaucaaggauauuggucuaaaauucucuuuuuugguugugucucugccaggcauugguaucaggaugaugcuggccucauaaaaugaguuagggaggauuuccucuuuuucuauugauuggaauaguuucagaaggaaugguaccagcuccuccuuguaccucugguagaauucggcugugaauccaucugguccuggacuuuuuuugguugguaagcuauugauuauugccacaauuucagagccuguuacuggucuauucagagauucaacuucuuccugguuuagucuugggaggguguaugugucgaggaauuuauccauuucuucuagauuuucuaguuuauuugcguagaaguguuuguauuauucucugaugguaguucguauuucugugggaucgguggugauauccccuuuaucauuuuuuauuccgucuauuugauucuucucucuuuucuucuuuauuagucuugcuagcggucuaucaauuuucuugaucuuuucaaaaaaccagcuccugcauuaauuaauuuuugaaggguuuuuugugucucuauuuccuucaguucugcucugaucuuaguuauuucuugccuucugcuagcuuuugaauguguuugcucuugcuuuuccaguucuuuuaacugugauguuagggugucaauuuuagaucuuuccugcuuucucuugggggcauuuagugcuauaaauuuuccucuacacauugcuuugaaugugucccagagauacugguauguuguguuuuuguucucauugguuucaaagaacaucuuuauuucugccuucauuucauuauguacccaguagucauucaggagcagguuguucaguuuccauguaguugagcggcuuugagugagauucuuaauccugaguucuaguuugauugcacuguggucugagagacaguuuguuauaauuucuguucuuuuacauuugcugaggagagcuuuacuuccaacuauguguucaaauuuggaauaggugugguguggugcugagaagaauguauauucuguugauuugggguggagaguucuguagaugucuauuaggucugcuuggugcagagcugaguucaauuccuggguauccuuguuaacuuucugucucguugaucugucuaauguugacagcgggguguuaaagucucccauuauuauugugugggagucuaagucucuuuguaggucucuaaggacuugcuuuaugaaucugggugcuccuguauugggugcauauacauuuaggauaguuagcucuucuuguugaauugaucccuuuaccauuauguaauggccuucuuugucucuuuugaucuuuguugguuuaaagucuguuuuaucagagacuaggauugcaaccccugccuuuuuuuguuuuccauuugcuugguagaucuuccuccauccuuuuauuuugagccuaugugugucucugcacgugagauggguuuccugaauauacgacacugaugggucuugacucuuuauccaauuugccagacugcgucuuuuaauuggagcauuuagcccauuuacauuuaaaguuaauauuguuaugugugacuuugguccugucauuaugauguuagcugguuauuuugcucauuaguugaugcaguuucuuccuagccuugauggucuuuacauuuuggauucaacauaguguuagaaguucuggccagggcaauuaggcaggagaaggaaauaaaggguauucaauuaggaaaagaggaagucuaauugucccuguuugcagaugacaugauugcauauccagaaaaccccauugucucagcccaaaaucuccuuaagcugauaagcaacuucagcaaagucucaggauacaaaaucaauguaccaaaaucacgagcauucuuauacaccaauaacagacaaacagagagccaaaucaugagugaacucccauucacaauugcuucaaagagaauaaaauaccuaggaauccaacuuacaagggaugugaaggaccucuucaaggagaacuacaaaccacugcucaaugaaauaaaagaggauacaaacacauggaagaacauuccaugcucacggguaggaagaaucaauauugugaaaauggccauacugcccaagguaauuuauagauuccaugccauccccgucaagcuaccaaugacuuucuucacagaauuggaaaaaacuacuuuaaaguucauauggaaccaaaaaagagcccgcauagccaagucaauccuaacccaaaagaacaaagccggaagcaucaugcuaccugacuucaaacuauacuacgaggcuacaguaaccaaaacagcaugguacugguaccaaaacaaagauauagaucaauggaacagaacagagaccucagaaauaacgccgcauaucuacaaccaucugaucuuugacaaaccugacaaaaauaagcaauggggaauggauuuccuauuuaauaaauggugcugcgaaaacuggcuagcuguauguagaaagcugaaacuggaucccuuccuuacaccuuauacaaaaauuaauucaagauggguuaaagacuuacauguuagaccuaaaaccauaaaaacccuagaagaaaaccuaggcauuaccauucaggacauaggcaugggcaaggacuucaugucuaaaacaccaaaagcaauggcaacaaaagccaaaauugacaaaugggaucuaauuaaacuaaagaguuucugcacagcaaaagaaacuaccaucagagugaacaggcaaccuacaaaaugggagaaaauuuucgcaaccuacucaucugacaaagggcuaauauccagaaucuacaaugaacucaaacaaauuuacaagaaaaaaacaaacaaccccaucaacaagugggcgaaggauaugaacacacaauucucaaaagaagacauuuaugcagccaacagacacaugaaaaaaugcucaucaucacuggccaucagagaaaugcaaaucaaaaccacaaugagauaccaucucacaucaguuagaauggcgaucauuaaaaagucaggaaacaacaggugcuggagaggauguggagaaauaggaacacuuuuacacuguuggugggacuguaaacuaguucaaccauuguggaaguugguguggcgauuccucagggaucuagaacuagaaauaccauuugacccagcuaucccauuacuggguauauacccaaaggguuauaaucaugcugcuauaaagacacaugcacacauauguuuauuguggcacucacaauagcaaagacuuggaaccaacccaaauguccaacaacgauagacuggauuaagaaaauguggcacauauacaccauggaauacuaugcagccauaaaaaaugaugaguucauguccuuuguagggacauggaugaagguggaaaccaucauucucagcaaacuaucgcaaggacaaaaaaccaaacaccgcauauucucacucauaggugggaauugaacaaugagaacacauggacacaggaaggggaacaucacacucuggggacuguuguuggguggggggcggggggagggauagcauuaggagauauaccuaauguaaaugacgacuuaauaugugcagcacaccaacauggcacauguauacauauguaacaaaccugcacauugugcauauguacccuaaaacuuaaaguauaauaauaacaaaauaaaaaaaagaaaaaaaaaucaguucugacuggagaaguuagcaaaggauuugugaacuuccuuuggaacuuccuuuggaacuguaacuuaacuuggguggaaccuugcuggaagucaugguaagguaaagauagguuacagcggaagagaagcagcuuaguguuuggggagguucggaggcugggagagaaugaggcugugauggaacugagaaaggccuucaagcccaagcaguuucuauaugauaugaacuuuacccuacaugaacugugaugcauauauuuuggcugaagugcagaaauguccccauuuugaaaacugugaagaacucccaggaugucuaauuaaaauaggguauggauaaugaaagugaucccauaagugugcugguggagagcugcuuccacuuacuuuucugugcaaacccaaaccaucacuaucacaaaguuccaaaaaccaugaccucagcaacauguaauuguuagguacucacuaugaauuucuuaaaccacacaguaugaauucuuuuagcaaauuaggccccaaugauuuuacuaagcaaaaugucccacuguagaacaucaugugaauuuuagagcuagaggagcucagaauggggaaaauggauaauaauacgaauuaaaaggaagaaguugaaauuccuaguuaaauaaucauuauaaauuauaucuuucaaguaaaacuacaacuauugauuuccaugguguguguaaacaagacaauacaaacguguuuuauaaacugacuauaccuuuuuucuuaauuucucuauaucuuuuaaacaauauuuacaugcuguucauuuuguuuuauuuaauuuuccauauuuaccuuguuuuucauaucuagaguaugacaaucuagcaacucuuuauuucugguaacauucuaaaauguuuuauuuggaaccacuuauuauggcagaugauaaaaaucuaggcucaguuuuaucaccuccaccuaacuccuaaaauagaugacauaaauucaauaagaaucuaaaucuacuuaucuucaggguacaauacaaaauccaucuacuuauucaaauuuuugauuaacagcauucauauuuaugaaaugcucugggcuuugcaggugaaaauaugugaaacucaaguaucauuaaauauucugugauguuaucacaguguuuugugugcauaugugcuaauguucaauaacuuuacccugagaucuaauaugcaucauaaacuuacaaaacaagaaaaucucuucuuauguguuuaauucaccuaauaaaucacaaagaaaauuauaaaauaagcuauaucaauaaaguagcuuauggaauaucgguguuuuguuucccauugaauacuggguggucugcaacugcaacacaguaacuaguaaguauuaucugaacauauauguuucauauuaugaguauuaucugacacacacacacacacccacccacccacucacccauaacaguucaugcuaaauuugaucuaacaucuguaaagaggaaacuucugaccuuuagcaaauuuaucaauaaaggagaauaucugcaauguuauugucuauaaggcauacauaauuuuucaacucaaauuauauuuuugguuaaccuacucaugauggcacagacucuacccuaauaaggggugguaggaaguacaccgaacuaagaaguguuggggccucagugccaucuuucucuagauauuuaugcguccuugaacacaccuuuucaacuuuccugagcucucuuuuccucaucuauaaaaccaauaugauuaucuccaaucucccuccacuaaaauguuuccauugguuaaugacaaaugcuuaugauguuacugucucugaugaugauuguaaaaauaucuaauauacacugagaccuaaauuaugcaucagccacugaccuguaugcuuuauauacacuaacucauuuaacucuucccaagagguaacucauuuaacucuucccaagagguaacucauuuaacucuuauauacacuaacucauuuaacucuucccaacaaccugugagguagauacucugauuauuucugucuuauaaaaaagguuaaauaacuugcccaaaaucaaagagauagucaacggcugauauuagaaucuaggcaguuuggcucagagggcucaguucuaaccauuacacagcacuacaauaaaugaucagacuuuacaguguaacuauaaacagagucuuuaucaaugaguuuccucagaguuucacguuugcuggcauuaauguaauuucaaucuuuaauugcuaaacauuuaauucucugcuuguauaucagauauguuaaagggauuucacagauauaaaaaaaaugugauccuuaaaacaacucucugaaggauguuggguaguuuuacaaaauuugcacucaugagaaaauggaggcugagaccuagacauuuaugauaugucauaauuacaaagucaagcugcuuuaaaucccuuauagaaaaaggaaagguaggcugggcacaguggcucacauccauaaucccagcacuuugggaggccgagguaggcagaucaugaggucaggagaucgagaacauccuggccaauauggugaaacacugucucuaccacaaauuacaaaaagaaaaaaaaaauuaccugggcgugguggcgcaugccuguaaucccagcuacuuggaaggcugaggcaggagaaucgcuugaacccaguagguggagguugcagugaaccaagaucacgucacugcacuccagccuggugacagagcaagacucuugucucaaaaaaaagguaaaauucacuagucauaaagccagugaagaacauaacaacauagucagaaacuugggauuucuaacuucuagucagucaacugaauguuuagcacucuccaaucuuuucuccaacccaggugugucuccugccugagauccugacaaguaagauuuaauauacccaaaugaaauucaucauuuugccccuaaaccuaaguuuucuccuaaauucuuucuucugaucaaugacaucaacaauuacuuaccugaaucagaaaucuggaaaacucuuccuuucuuuccuucaaucuuacauugucaacucauucuauaaauucuaccuucaaaauauagcucaacucuaucuucauccccauugugcugcuuaaugucuugaaucauuugcaggacauaaaagauccucugugauugacaaccauuaauucaccaucuuucauuucuucugagacuacagucuuaccaaaugacuuguaguuccucauacuuuagcauaaguuccauucaugccucugugaaugaaaauuucucugccuggaauuccuguuugcuguaaacaccuccuuauccuaaacacuuguccacuaagaaauuuuuccuuaccugucuccauccccaagccaauuauccauucuuucuuguacauuccugaauauaguaccuuucauauuauaguuuaaggguaauaaauaaaucucauuugaauagauuuaguuccaggcucuguacuuuuaauguuuucucuaauccuuaaaaaagacacacacugaaauuauuaucccugaaacuuagaaagguuagaagucuauaauucagaagugaggaagcccaaguuuaaaauauguuuacuccccaaaucuuaugcccuuccuauuucaaaauguuacuucuuuaauuauuugcuuacaugucuuucugcuccauuggccacuaaauucacagaauguaagaaguaugucuuauucuaugucuuauucaaggcuggggccccaguaccuggcacgggaucuggcauagagaaggcacucaagugucugaugaguaaauaaaugaggccguguguuguuuggcucacuaaauaaaauccuauuguuauuaacugccauuuaaauggaaaugccaguuuuaugaacaugacugauggagaaauaagauuugaacaauguuuaugaguuuuuaauguaauuuuuauugacuuuuuuguauccuaacucauuaauaaaagaaauaaagaauaauacuggcaugcuuuaucucccaacauuauucaaauugaauugacuuuuuucuuucaauaagaugccaggaguaaauuauuucuguucuuccagaaagguacaccuauuuucacacaaaaaccuaacuccuauauuauaaaaauauaguugcauauacaguagacacaaguuugucuguauauguugaugugauuacauuacuugacucuugacucaaagagauuauauuacucaacccaaaaagcaguugugguaaucacuaaguaauuuuuaaaaauuauauaauaauauauggaguauucuuuauuuaaagauggcaaauuccaucauuuaucugacaggaaaaguuuauccuaaagacaagcuuauccuaagaauagggacauucugcuaaauaaauuucaguuuguggaacuggcaauggugaaauuaagguacuaaguucuuuuccuaaccuuauaaaagaucagaguucuuccuacugugaugcaguaaagacucagugaauauuuacuuauuuguccuaguagccccaacauacuuugagagcaaaauuaaaggugaaaagugaaugcuaucaaaacuaacagaugaaaaaaauucugaagauuuuaaaguugcucagagauaagauuuugauggaggaccuuugguaaagaacuacucucaaaacauuauggcuauucauuaauuaauaacaguaucaaagaacaucggaauuuaaacugagagaucaguugaauauacucagaggcagaagucugaucuaugauauuucuuuaucauucaguaauugcuuggagaacacucuacugaugggaucacacuaacacaugaaguggucauucacuuggacaaccaacagugucacugcauauguaauaauuacauacauaaugcaauacuuacauuauaaacauucucuauaggccaggagauuuaacgcugcucaacuaguuuacauuauaauuauggguauuaucaccuacauuaauuuuuuaaacaagacaaaaaauggauacguaaauaacaaaauaugaaaggguaugaaaugagaucugaaugucuccuuucacccuucuuuagccccuaaucauuuucucccauguaacuccaguuucuaggcauuugucucuauucacagaaaacugcuaauuauuuacacaaauaggauagacuaaaaauaauuuucugcagcuauuuuaauacuuaacguauauuagaacucuuuguauaguucuagauaaguaacuauuuuuaauguuugcaaaauauauaugaauuccccaggcucaagagauccucccaugucagccuccugacuagcuggaccacaggcacacaccaccacgccuggcuuauuauuuuuuaauuuugguaaagauggguucucccuauguugcccaggcugggcucaaacuccuggacucaagagauacuccauccccgaccucugaaagugcugauauuacagggaugaaccaccgcucccagccuguauugcacuuucaauggaucuuuaccuaugugcaugcuuuugaaacaucaugucuaguuucaaguggcuuguucagcuggcaauucaauaccacaguacuuuucucaagacagcccuuguacuuccaaaauguaaaagugauuuauauauacuucccauuuuaucacaccaaauauuaaaaaggauauuauacucaaagauugacauuuaauaaaagaggaagucaaauugucccuguuugcagaugacaugauuguauaucuagaaaacgccaucaucucagcccaaaaucuccuuaagcugauaagcaacuucagcaaagucucaggauacaaaaucaaugugcaaaaaucacaagcacucuuauacaccaguaacaaacaaauagccgaaucaugagugaacucucauucacaauugcuucaaagagaauaaaauaccuaggaauccaacuuacaagggaugugaaggaccuccucaaggagaacuaaaaaccacugcuuagcgaaauaaaagaggacucaaacaaauggaagaacauuccacgcucauggauaggaagaaucaauaucgugaaaauggccauacugcccaagguaauuuauagauuccaugccauccccaucaagcuaccaaugacuuucuucacagaauuggaaaaaacuacuuuaaaguucauauggaaccaaaaaagagcccgcauugccaagucaauccuaagccaaaacaacagagcuggaggcaucaugcuaccugacuucaaacuauacuacgaggcuacaguaaccaaaacagcaugguacugguaccaaaacagagauauagaucaguggaauagaacagagcccucagaaauaauaccacacaucuacaaccaucugaucuuugacaaaccugacaaaaacaagaaauggggaaaggauucccuauuuaauaaauggugcuaggaaaacuggcuagucauauguagaaagcugaaacuggaucccuuccuuacaccuuauacaaaaauuaauucaagauggauuaaagacuuaaauguuagaccuaaaaccauaaaaacccuagaagaaaaucuaggcaauaccauucaggacauaggcaugggcaacgacuucaugucuaaaacaccaaaagcaauggcaacaaaagccaaaauugacgaaugggaucuaauuaaacuaaagagcuucugcacagcaaaagaaaccaccaucagagugaacaggcaaccuacagaaugggagaaaauuuucgcaaucuggucaucugacaaagggcuuauauccagaaucuagaaaguacucaaacaaauuuacaagaaaaaaacaaacaaccccaucaaaaagugggcgaaggauaugaacacacacuucucaaaagaagacauuuaugcgccaacagacacaugaaaaaaugcucaucaucacuggccaucagagaaaugcaaaucaaagccacaaugagauaccaucucacaccaguuagaauggugaucauuaaaaagucaggaaacaacagcugcuggagaggauguggagaaacaggaacacuuuuacacuguuggugggacuguaaacuaguucaaccauuguggaagucaguguggcgauuccucggggaucuagaacuagaaauaccauuugacccagcuaucccauuaccggguauauacccaaagguguauaaaucaugcugcuauaaagacacaugcacacauauguuuguuguggcacuauucacaauagcaaagacuuggaaccaacccaaauguccaucaaugauagacuggauuaagaaaauguggcacauauacaccauggaauacuaugcagccauaaaaaaggaugaguucauguccuuuguagggagauggaugaagcuggaaaccaucauucucagcaaacuaucgcaaggacagaaaaccaaacaccgcagguucucacucauaggugggaacugaacaaugagaacacuucaacacaggaaggggaacaucacacacuggggccugucaugggguugggggaguggggagggauagcauuaggagauauaccuaauguaaaugacgacuuaaugugugcagcacaccaacauggcacauguauacauauguaacaaaccugcacauugugcacauguacccuagaacuuaaaguauauuaaaaaaauaaauaaaaauacauuccagagacuaaaaaaaaaaaguuaauaauuuuacuccuucaucaaaggcauucuuaagugaaacugguauguauuuuuucucaugacaguauaugauggggaugaaaacaaugacuauuaguucaacuuggugcuacugcuuugauuuguacaaagacaccaggaguugucccaccauugcuuuuguaccaucaaugccaguauugacagaguaaaaaugacaaauuucuuagcauucuaauaaaaauaguuuugaccucaaauaccccuugagauuguuuuggaaauacccagggguuuauagacuccacuuagaaaacugcuucccuauauccucuccauuucaaagcugaggaaauugagguucagagauaagcaacccacccaaagaccguuauuaaacaggacagucaaaaugcaaaccuaggcauucuaaccccaaguucuuguccuugauguccaagcacacugcuuaggagacuuuucaauugguugccagcacuaccacagaguucuuuuuagugagauuucacaaugguccuugcuuugcccucugggauuauaauauaccuucacucaucaagcauuagguugcuucuaugagccagggccugagccccaugaugaggaugccaaaaugaauaagauauuguccucacuuucaaggauuucacaaucaacuggggagacaaaugugcaaacaagaccuauagcguugugugacaaauacuguaacaguacuuuguacaaagaauuuuggaagcacagaagagagggugauuaauucugcccaaagaagggaguagcuggaaucaggggcuugacaacaaaagcacauuuuaauuggacuugaaggauaaauacaucuaaucccuuuauucacaggaaaagaguccuucacauacuugaauacagcuauuguguaucccauguaaguuuccaguacuuugaauaaagacauacuaauaucaucaagaauauauuaugaagaugaacauagaaaacaaaucacauaagaaacaccucuggaaaauauguacugauccuucugcaaggauauaugcaaauuuauuaaauaaaucagcaguuaaucaugagagaguuagacaaguucaccuaacagccaugcaguuucuucuaaauaagaacuagaaacaagugugcaaacuaaaaagacuguucucaaagugcuccuauccagauuuuuuagucaucucuccucuaagccagaggucagcaaauuuuuuauguaaaugaccagacuaaacauuuuaggcuuuguaggccagauggucucagaaaacuauucugcucugcccuuguagugugaaaacagccauauauaauauguuaaugaaugggcaugcuguguuccaaaaaaaacuuuauuuacaaaaauaggcccagauacggcccacgggccauaguuugcugacuccugcacuaagccaucuuucuucuuguguucucccuccuuccccugcacaguaguaagagcguuaggucuggaaucaucagaauuuuaauucuacccuugcuaacaaccaacugugugaucuuaagcaaacugcuugaucauucuggcacucuguuucuuaugucaaaucaaggaucuuuggauuauaugaucaauaauggcccuccuuaaauuccaaagaaucacugcagaguaugucuccuccccugauacuccuaauucauuccagcauggaauacacuauaugagagacuggcaaaaaauaaaugugaccuuaggugauacuaaaagaaauguauaugucaaaugaagauggggcaagccuagucuacucuacacaagauauaucacauguaaaguucaauuaugaguaaaacacuaacaagacucuccacaggaaaacaaccagggaucuaaaagauucugaagauuuugguaaaugagauaugguugaaaaaccugggcaagaguggagagcaaaaauuuagugagcauaauacuaucuuucaaaaugcuuguaaccaaacaaauauuagaacauaaauaaaauauuccaggccuaaaugauauuucugaauccucaacuauaaugaguauaaguucugugccuucuaagucuucguagcaucuugagucuguaaaguuauugcuaauaacaauguuagaaguaacaucauuuccaauacuucauauauguauggcuauuuaaaguuuauauccuuguauaucacauuguucaagcuuccugauccuaugagauuggcaaagaugguauuauuauugucuuuuuacaaauaggagagcagaaauucaaaaaguuuauucuguaccuagaagauuacugaauaaacaacauaaaauggggaggugcuaaagcuaaacuccccaaucagguuagaaaauguagauggaagacuaaaacagacaucaccaaauauuuuauagaacaucaucuccuuuauaauucucagaggaaggagagcuugggggagugggauauaacagcuuaacagcuucaaagcacuuuacauuuggaaauaguugccuagcauuuugcuuuagcuguuagugcucaauuuaccuaauuuuucuguuaagugcuucaaucacauguaaauguguuaugaauauagcucauaaaaugucugaggggugguguucuauaauaaaacaaccccaaaugggaagaauucuaaaaacgaaaaaauauuccuuuccauuucauugguuucagauaaaugccuuauucuuagaaaaacaaaaaaacaaaaaaagagagaaaaaccccaagcaucugugaauaauucaaaguacuaaauggcaugaauagauucauauuuuaauguuauacuuuccuuuuauccagacacaacuuugaacauaauaaaucuaguuuuagaacuugaaauccucaagacucugcauuuggucucuuuuuaaaauauguauaauuaacuucaucuuugaaggcuccuggagguuguagagggcagaagaaauguguuuuuguuaaaaugagccaaucugugggaggccucccaaguuuccugcauagaaaauuacaaagagauuugagagagaagcaauauugaagcuagguauccaaagagaaaggauauuaugcauugauaaauuaaucucaaucagcgcuuuuuuuccugggcauugaggauaccaaugagggaacagggcuggggcaagucacauaugugcuuagugucauucccuuccccaacucuccaaauuuucuuagguuaaaucagauuauuuaucacuaacaucccagguuaccgugcaugagaaaagagguuaaaaaaggaaugauuuguagugugcuuagaaaggaaaaagggacauucuaaucuuguguagagaaguugagggaauugaugggcugacagcauauacaugggccuuaugccuuuuuagcaauagugaggcuccuucacuuuccuguggaccgcuuccuucuagaagcucagguucuccaaaggcuguggcuaggagggacagcauuuaggacaaacguguuggacuucacauggggguuuguuucuaaaaaaaaacagucuauaagacaaaaaugaccugaaaucaaaauacccuugaagaucucuuacaguuuccuuaaaguaaaguggacacaguuuuacauacacaacccuguacuguaacuauucauaaauauaauguucucaguaggacacaguuuauaauaaagaaggccaucuuguacugcaaacaaaaaaaacaucaaaauauuucaauuuuaaaaaugcacucagugaugugagaggcuaauaccaugaggugugcaagaagccacuugagagucauaguauggaauggagaccaaauugucccuacuguuuauaaugucagauaccuccucuccucuuuuucuuuuuauuuucucucucuuccucccuugcucucuuuuccccaccagcuguuguugaaaucaaguaaaccuggacacucagauacuccaaggcauuuugagccuuaccaguuuucuauugcuaccauuacaguauauguacaaucaccacagacguauagcagcuuagagcaaacacaggcuuagaacaacucaagucuauuaccucacaguucaguaggucagaagucagaacuggcugcucuggguuucccaaggccgaaauuaaagugucugcuggccuggcccugggggagaguucacuuccaagcucauuuggauugcuggacaaauuuagcuccacguagcugaaggagugaggucuggcuuccuugcugccuguggacuggggucguucucaguuucuagaggccacuugcauuccucgacccuuaaaguuggcaacaguggguugaauccucauguuucaaaucucucuaccuucccuucuaccucaucuuucuucugccuccaucuucaacagcuucucucuaacuuuucuguuuuccugcuuugcuuuuaaggguuugugugauuacauuaaauauugcccccuccccuagaaacauucagguuccuuaucuaauuuaaggucagaauuauuaaacuuaauucugucuccaaagucccuucacauaaguaucugggugaguguuugauuacacaauuugggaaugggaaucuugagaaaacuucuuuauucuuucuaccauaugguaauaacaaauuauuggccuuucaaacguaucuuguuauagccccuaaaauaugcugcauauuuagccaaaagacacaagcagccaacuugguaaauaagaucucauuugcaaaaugaaaaccgaaauggaaacuuaucaaaagaggcuguuaugagagguuacaaauauuucaauaaaggguugcaauagcaaguauaaaaauaaccaugcacuaaaagaagaaugcucuggccugacgaaaauacuagagggaaagaaucugcagaaucuucauuuguucucuagacauuuggggucacugauuuauucagagguacccagguauucuuuccaggugaagucuaaaguguuuagugcuuuaaaacaaacagugcucucagacuuguuagaggcuucggugaaagucccuaauugaagcuaaaggucccagcaggguuuuuuuuaaaacugcuuccgaacugauuugacuuuaaaaccacucuguagggcugggcgcgguggcucacgccuguaauccccacacuuugggagguugaggugugcggaucacgaggucaggagaucaagacuacccuggccaacguggugaaaccucgucucuacuaaaauacaaaaaauuagcugggugugguggcgugugccuguagucccagcuacucaggaggcugaggcaggggaaucauuugaacugggagguggagguugcagugagccgagauugcaccacugcacuccagccuggggacagagcaagacuccucucaaaacaaacaaagaaaaaacaaacaaaaaaacccuacucugucauucugauuuuagccagguuuugcacuguacugucguuauccugguauauucauggguuuugcuaaauaacaucuuagcaaaguaagccaugcuaaaguucaggacgucccaguaugugacacauuccuucucuucuagccaguagucauagaccacucucuucagcugacaagccugccuucccuauuuuucacaaucuaaaaggggccugcugguggcgugcuuccuagcuuuucuguagcuuuacuuggccuggugaccauuggugaacucagaacguugugaagcccaagucucgagcuauguaccuacccagaacugaauuuaagucacauggaucaccacuuaacccuggacaggcauuuugcacauagugauaauaauaaaaaguuucuuuuguucacaaguaccaccaagaaacuuagaauucuucauaggaauucugcuaucacagagauaaaaauuacuggaguaugagaaugcagagggagaauucagguuucucugaucauaugaauaacauaaacauauagaaauagacacagaagucgugaugaguuuuucuaauucugagaaugcauuuagguaaccaggccaguaggagaaaggauuagggcagguuucccugcucccuccaguacagcuccugacauguuuuccucugggaacucuacuggugaucaguaaugccucacuccccucugccacauucuaccucauacauaagauguaauuaauugucauauuauggccuugcuuccuauuuaaugcaagggagaacauuuauugcauugcuggagauauucauucuagaacaagaaaaaguggagcucuuagaagaguuuuaaucaugaggucgggcacgguggcucaugccuguaaucccagcacuuugggaggcugaggcaggcagauuaucugaggucaggaguuugacacuagccuggccaacauggugaaauccuaucuccacuaaaaauacaaaaaguagcagggugugguggugggugccuguaaucccagcuacucaagaagcugaggcaggagaaucgcuugaaccugggaggcagaggucgcagugagccaagauugugccauuucacuccagccugggugacaagagugaaacuucgucucaaaaaaaaaaaaaaaaagagagagagagcuuuaaucacaaaauuagaguauuuuuaauuaugucuugccaccuaggggcauucuuagaccaucuggggggauggcugauuuuuagagacuucauaguacauucacugaggcaaaacaauaaauuuaaucuuucagcuuuuucagaaguucaauauuagaagacgauuuaaagcaaugacuuuuuuaaauaaaauaacuugcauauuaaacauuacauuucauguuacagaaggccuaauaugacaaauucaggauaaauuuccccuguauuucaaugguaacucagcugucuaagugcaucucagcccuuugguuuuauuuagucagugaaaaagauuuugguuucugcuuagcuuuagcucaaacuccuuugaauggggcaaacacaagcuguaccauucucuuugguuuaugcccagucaauucucucauuuacuuaccagccugauucaugaaggccucugagaugaauaugaaaguucucuucagguaaacaaugagaacuagaucaacuaaguuauuuucuuuuuugcuucagaugccaguaacuugagaauuaaguuuagugcucaucuauauuaauaaauucauuugaaguugcuucuagcgucuuucuccuuauaauuucauugguuguucuaaguuuauuuagaagucucuaguuuuuuauuguaauuuauuuuuaaagcuucuucaaauauucuuuaugaauaauaaaucuuaaauguaguuuuaaaacugggacuuccacagaaauucacuguaguuacugcuggagcacauucaguuuagacuaucacuuucccauaccagcacagcagccugucauguaagaaauggucacuagacauaaaucaggccuuacuggucauauuaacacaaaguuaagaguguguguguguguguguuauaugcaacuuuauauauauauauaguguauauguaacauauacacauuagcucaacucaauacugaagaaaguugcuaaacaguguucuagcaauucaucaaggagacugguaccagaagaaauaggagacaaccccuggaaggaagaaagcuuugugcuccguccuuccaaguauauaaguauaaacauauauaccucaccauuauaccaucuuagaacaaagaauuaaauuuuugaguucacagcuuuuguaguuuaguauuugcuguacaaucaaaaacuuaacucuugaguugcaaacaguuugaagaagagaaaacuauagcaugugacagugcaaaguaugaaaguagacuaagauugggagcugacuuuucuacaaagagaauuguagggauuaagacaaauuuaacugaaagaauuggaagaagagauuacaguuggcaguagugaucuucucaaacacccuggccuuuguggaguaaagcacaacuugguucucaugaaauaggugcuuuuucccaccugccaggggccacaggccugccauguaaccaaucacccucagaagaauggaugccagguaaacacugagugccaucagccaggacaggugccagauggaagcauucaccugaaaauuuuuuucccccagagaaagauucaucaccugugccaccuagccuuagaaucucaccaccagagcaccuuaggcaggaauaaguauguaaaacagguagcuaaaucaccuuuagugcucagagcaggaaaaaauguuugcuucaccuaacaauaguaagaacaaaauaaaaacuuugcugcaaaaggaucaaaagagauuuugcccaggggcuuauuucugggaacaauaugagagaacaugcugggagagaggguaguaugacucuaacuaucauuauauguuaaagaauaaagguguuuauuaucugaggccaaaggucugauccacuuaccuaauaugcgguauggcagugcuuuuuauagacucugaaauuuuuguccucagaucucucagaugaucaaagacucuuggaaagcugccaagaaggucucuggcucaucaaccugcuuuccccaaacauccugagagcccuaggaccaaggacaacuauaaaccagagaaaacaaccaggaguagcaaagccaggacaauuaaaguguuugguuguaaauuucaaaucauuucuccaaacuaaaauacuugccuuuguucccagaagguaguguuguguuaaacucaguagcauuuuuuuuuuucucuuccugaaucucuuuuucuuucucugugaauucacuugguagaaaugagagcuaugaucuuugcauauaugacacuguauucaauaaauguuaaauaacagaagauuagaacucuuuuaauaauucuguuuguuauucucauuguuuguuuucucuuguucuucuuauucaacaaaucuuucuucacaugccucacauuuuuugagggcagaaaauuuuugacccauuuuucccaaugggucacugacuuugcagagcauggcauaugcugaaaugaacauuguaauuacauuuacacccagggcaacacccaauuguucacugucauuuguagcuagaagcaccuacaaaugacauauauuaaugaaugacagauccuguggugaguuaauaagauaacaaaucucagucaguauugcauaaauugggaguggaggggagcugaguucuuuguaaacaugugaccugguggaaugaaaucucuguaagagcaauucagaaaugauaagguuagguuaauacugguuccuguauucccgcuguucuaucaacccacucaauuccuacauuccagcugguuguguuccagaauuucucugagaguaaaaccugaauuuacaaguauugucauaaauugggggggugguccucaugauaugauuuggcuguguccccacacaaaucucaucuggaauuuccauguguugaggaagauacccaguaggagguaauugaaugauagagguaggucuuuccugugcuguucuugugacaguaaauaagucucacgaaucugaugguuuuaaaaggggaguuucucuguacaagcucucuucucuugccugcugccaugugagacgugccuuucaccuuccaucaugauugugaggccuccccagccacauggaacugaaagcccaauaaaccucuuucuuuuguaaauugccagucuuggguaugucuuuaucagcagugugaaaacagacuaauacaccucauaaacacacauggcaaaauucucucaugcaucauaaguuauuaaaaaauccccuuagaaaccucuguggcccuaggcuuuugguuguuugcccuugugcuuuagguggcugaugugguauaaugaaacauaaagcauuaaugaaauucucuuauauuuuugccaauugaauuggaaaacaauuuuaaagacugauaaauccagaacuaauaaggauccccagggugcagagaaauucugcuucacugcugauggccaugugaauuaccacaaccuuucugaaaaguaauauggcaagguccauuacuauuuaaaggugaagauaccuuuugaaucaguaaucucaaguucagggauuuuucauaaaaauuaaaggcagaauaccuaaguauuuauguacaagguuguuuauugcuguuaguaauggcacaaaacuaaaaacaaccugcucaucaauagagaaaugauuaaauaaaacaugauacauucauauuauggaauauuauacaacuauuaaaaggaauggauuacaucuacagguauugacaucaaggcaaugucuauaauacacuguauaaaaagaagcaaguuacagaauauguguaugguauuccaguuuaggagagaagaaagggagggagaaagaguaaagaagggaggaaaggaggugaggaggaaagagagagaaaagaggggaaggaaacaaaaggcagagagacagagaaagagacagaaagggagaaagagcaagaaagagguaaggguggggaauaugcaaaaauguauguaugugucuaucuucauauuaaaauaaagaaggacuacuaugcugcagaugauuuuaacacuugcuacacaaagacaugaggcugaaggagggaagaugaaguuauuauuaaauuuucuuuauuuacuuccguaggguucuauuugguauagagagaaugaauuacuauugcugcccgccaucauuuaaaaaaaauagcuuaaugaaaaagauagguugaugucaacuauacaggggccucaagcuacuuaagagaaaaccgauuuuuaguucaugaaaauuugagaugaauggggguugggaggaaggcaggaaggguaauguuuacugaaaguguauuucugaaugacaguggagacaaacaggugcuuuccuuccuaaccgggaaucccagcauaauuuagacaugaaaaugcccagaaggccuggcaauugagccuuuaauuucuaccuguaaauugcaauuuauauguuggggauggcucuauugagaaaccaaagacuauguaagaacauauuguuuucggcccuagacuagggcacucaauuuguuuuggucaaaugaauugcgggaauaacuaaaucucacuguuguuccagcaaaggccuuggauuaagauaugcauuuaacaucauagguagaaauaguaguuagaauuuguaauagacuaguuuuuagcuuccuaaauaaucauauucagucaguaguuaucugggccuuugauccuauauuccugaagaauuuuuuagcaugcacaccacauaaauacacauuuaucuauaaauaauauacauguucuacuauuaagcaauauuuugacuuaaugcuuuaugaacauaaauagaaguagacguuuuauuauauuguauuuaugcaucuucaaugguuuguccuuugcguuucuugugaugugugcacucuucuuuggggucuacaguuuuauagguugcuaugguuugaauguguuccccgaauuucauguguuagaaacuuaauccaguauggcaguacugaaagaugggggccuuaaaaagguaacuggauaaugagggcucuacucucaugaauggacuaaucuauucaugguuaauggauuaauggcauaucauaggaguggaacugguggcuuuauaagauaaagacccgaaugaggacgugagcaugcucagcccccaagccauaugaucagcaagaaggccuuaaccagaugugacaacucaaccuuggccuucucagccuucauaacuauaauaaauaaauucccuuuuaaaaaauuaauuacccaguuucagguauucugcuauaagcaacagaaaacaaacuaauaaacagguccuaagacuuuauuuacugaguccaguuauauguucuaauauauacauggaacaguuaauuuauuugagucaggaaaaauauaucauaaggaugaucucugacugccauucagcuguugaucuuaauguagccuuaaauguuuuaagaucuagugauuuuguuuuccaugaauauucaacacuuuagaucuaguagauguucuuauuaauaugauaauaacagcauacuuaauaucaccgcauucuccagaaaucagggauauguuaguuuaacaacaaauuucagugcuauuguuugacccuuaaauuucuucauuugaaccaucuuaauauaugaaaauacagacuuaagaaaaaauuagacgaugauucacagugaaaauuuucuauuguuacaugaaggacagaccuuggaauaucuuuaaaaaacuaauuccauucgcuauuagcaaaauuaugccaaauauguauuaguuaugaaugaacauuaguagaaacaucaaaugaacaaaugauauucauuaggauuuguaaacacuccuuggauaauaaaaaaaaagucuauuaggauaauucaggcugugcuaaaaggcuaauucauuuucaacuuagguuaauacaaaugccauucuuucuugaccuagguauagauauaucagaaaucauuuuuaugacaaaagagguccuuacaagagaauguugaguauguaguccuuaacaacugccuccuccuacagcuguaccuuuaccccaagcacucaguauauauauaugaauauuccagauuauugauuugagacagugcaaugaaguuuauuuaagcacauaaaugcuuaaacgugugcacauauauuuuaauuaauauuaaacacaugaauggauaaugagggcuauguauguguuccuauauuaagcagauauaucuaccaaccuauaccuguuaugaauagauaacagcuauauaugauaucuauucauauuaaucaauuaaauaauuaauugauuaauagcugcuuauauuaauuaagcagauauauuuuaguaaauuagaacauuuaaagacuaucauuguuucauucauauaguaucaacuaagcugauauacucugcuugcacacaucccucccucccaugguucuauccacuguuucuccuuccuucucagugcuccuggaugagucuuugaugggcuacacugacagacuucucuagugucuggcuuuuguuuggaauuagccagcagagggccaaugagaagaaaacggcagaacauagagaaugagauucccuuucuguugggcuacaguuuggcagaaguccagguuccuugaacggucacagcugcugcuagaaguucccuccuauagcuacaaccucaacugaagcucuuuguagguccugguaguaucuccccacuuucacccucagacauaggagcgguaauagcuccuacuauugcuagcccaggagugcuucgccaucccgguuuucuguuauccuuuuucauaccuuuguaaauaguuuccuaucuacaauuccaccaaauugaaugugccaucgauuuccuucuggaauccugacccauaugcuuauacacagaugaucuauuaaggcucuauaacauauaaaaauaaacaaauuagaaauugauucugcuuucaaacaguuuacaaucuggaaaaggaaauacaugugguuuaaccgauaucauugguuaaugucugcuuagcuaaaauugagaaggugauaguacugucacauaaaugcagagggugggguggaaaaagguagaaaauuacauggaauaacuuguucucuacaugcugacuugaaauaacuuauuuacauaugauaguaugaaaguguauuuagaaacauuuuaacaagauuuuagaauaucuaccuuccuauaauuuguguauauguaacauauuugaaagggcaauuaaaaauuacaugcccuugcuccuaaugauuguaucacauauauacucauuuuaugaaaaacuuuugucucuuuucuauauaauauuuguuuuuuuaacuucuauauacaaacucucaaguacaaaaauguuauuucauagaauauuuuaagcucucuauucuuaauggaacuauuaauuauacauuuuggcaauuugguagggauaaacucaauuuugguaguaauauaacaaaccaugagcuggauucuaauagugagaaggcacuaggguuucauaaaaggauacuaguuaaugguguuuauuuaauucaaggggccauucaauaaacuugaaaaagcacuuuucaaguuuuacaugaauaguuaaauuuagauuuucaagcccuacugguauaucagaugaauuaacaaauguauaacacacgguuuccuuuuuuccuuuuuuauuguauacauuuaaggugcacaacauuauguuuugauauauauauacccauagugaaaugauuacuauagguaagcaauuuaacauauccaucaucucacauaguauccuuuuaaaaauagaaccuuuacuucaaaacauuuaauacaauuaaauguuuuaauaugaugagauggauauaaacaacagaugagaccaaaaaaggacaugauucuugucuuuaaaauauuuaaugaaaaaucuaugcacgaaaauuaaugauagaugacaaaguagaaucauuucucuauagauguuuauuuuuagauaacuaauaaggcuaaucuagaaucauuuaguuuaauuagaguuuaacaaauauucccacaugaauauguucaugcuugcuucacagcuuccucacuuucuuuuaucauaauagauaugucauucacacugcauuucagaucaaauuuuacaugacuucaauagauacauuauagaauuaacaaauauugaaauacuauugcuugaagacuuuuuuuuaaagaacuggggcuuaagaggaaaaucaauuuucagauaagaccuacuauaccuggacuuggcaaacaaaaagugcuuacauauuugcagaaguaacuguaaagaucaaugacuacauuaucaaauugucuaagaauugauguaaaauucaacuauuucacccugucccaauggcaugaguuucaaaauauacaaacauaaauaugucuaaguuaaaauaaacacugggucaauaaaucucaaauuuauaaaguacacucaaagcuuugaacuguacagccucaagugauacauuagcaguacagacauacauuaaagcacuuagcaugaaaauuguccacuguaaaauggggcagaaacacauuaaauauucuuaucaaucucaagcccaaaaggauuacaauuuagaacauaugcaguucaguuauucaaaauggacucaguagcuucuccaaaaauuuccuaacuauuuggggauuuuuuuuccucuccacuuuugaaucugcugaacagggagaacaggaagaaaauauuucaauaauuuauuuuuguuuauuugucugaaauagcaaaucaugaaacacucacugaacauaauuagcuccucugcacugugauuccaaaucucucuggaugcugggccagcugaccagauggugugcuguaacauaaugccuuugaaacagaggcuugaguucggguccacaggccacaggacaacagaggcagauugcaccguggaagugauauauucaacucggaaggccuggggcuggcaagugcuacugugcucuuugccaaagggcaaaccaaaugccaucuuccucaagccucaggcucuauuguuguacguggcagcuuauuguguuuuuaaccuuugggggaggcagaaggaggggagauugugagaggucaggaagacaaaauagguaaggaagaagggaaaguuaaucaguuuccaaaauacuuauuaccugcuaugcugagaaaggauaugacggcauuugcaaaaggauaggcuguuccccuaaauuaccuuguauacaaaggaauuuucuuaggaaucuuuuuuuguucuuaauuaauaagacugauugguuagcaaucugccuuaugacuaagccugacagagcuuaauugaaaagaagcuuaauugcaggaaagcaauggaagaaauucauuagagaagucuugaaaucugaaaauuaugggcagagcaggcuacccgaauggaaauugggcaauuuaagaugucuuaauuagauuuaaaaccacagcuuagaaaaacuaaauuagcuauaucgaaucagauaaaaaaaaucugagauaaaaugcaugguuauuauuggauuacucaagauagucuguauagcuuugugcugguaauucuaaaacucaaucuuuaugaggaguaacaacgacgacaaaaaagacaaagaagacagugaacaugaacuuuuaaugguauugaauuuauuccaagccuuauaguaaauguuuaagauguuuuaauaacugcccacugccaauuaucuugaagaaauccaaaaaugguaagcaaauagaagcuuaauuucaacuuuguuggcaaaaaaagaugaagaaacaaaccaaauacuccaauuuauuacugauuugagauuuagacauuugcauaaaacuguugugguuugauggugaugacaguauggguauggagggggccagucagucaacaaaguaguauacuuacuagauaaacauggggcauuggaguuaaaaauaaaggaaguagacaggaagagaaaaauauccaaagguauuuggauaaagcuugucacuuauucgguuauauuauuggguaaauaugucucaggcaucaugcugaagauucaucuuagaacaaaauauacaaggucccugcuauaaugcagaauaaaacucggugaacaggauggacauuaagcagagauaacacagauaaauguaaauuacacauuguaauaaacaccagaaaaaauauaaagccaucaaugugacaugauagcaggaaaaugugauauggauaagggccuugcugaggaagucauauccaagcuaagaccugaaggcugaggaaggaacuucucuuggcuaaccagugccaagggaagaauauucuggacuaaggaagugguccgugugucggcaugggaggcagagaggguggccaggguggcuaaggcagggcacaugagugaaagggcaggagagaucucugggauaggaggaaggggcuggguccugcagacuguuacagacuggguuucgugcuaagacuuaggaucuaagugaagccuggagccuuuggauggauucgagcagaagagugacaugacaggauuugcaguuuuaaaagaucacugccauugcugagccaacagugugguaaaagagaagccucuggauucccagugugcgcuggcuaguguauucaucugagaaacauuuuucgacaucuauuauuugccaguuccacugaggagaagagaaaugcaaagaucaauaagcucagaguuuucuuucaagaaauguaacaaauuauuaaauaaauaugguuuaucacagguaaauguguauuuagaggcauguacaaaaugcuaaaggagacuagaaggaaacuucauaaaagagauaaacauggaacuagaucuuguaaggacauaagagagaaaauguuucagacagcagcaauugcaaaauaauggagucauagaagaguucaguaugaaauggaaaccaaaaaaaguuuagcaguuuugcacccagaaaaaaagaaaacggagaaggguaagcuuguaacaaacggaugggggucuuuuauaugcuaagguauuugcccuucauccuaugguuaaucaauaggggagcuuucagauguauucaagccagaugacacuguaguuuagaaagauaaaucuaguccuacgcagaagacagagugggagauaaagcacuuaguggcagggaagacaguuaagaaacuucuacagcaguccagaaggagagauggugaagcuacaaccuaaaagacagcauggaaauggcaaggauggacaguuucucucccaacuccacauuuccaucucugcuucucccacaaccaacuauggccaggaaauuuacuggucacaggguuccauuacauguacaccaaggacaacauaaaagucgguggagucaaagugcaauuaagaggauugaaaggggaggcccagaaaaagagucccaggcacaaaguuuccuacuuccucauuuuaucuaggaaauuggauggcucuuuuauuuccaaacucucaucagcugggaaagauuuaaaaaguagcaugugucauaacuccaauauuucaaucuaaaauccaaaaaagcagcugcuuccuugcaagaacaugcucagagcuuucucucucaccuuuccuuuccccuuucaccuucauucacuguguuccauguuuauuuguauaccugucucccucagcaucuaguacagugcuuagcagacagugcacacugaauuaauauuagguuaauguuuauuuauaaagauaguaauugaugaaugaaaauauauguuaauuuauuuuuguuccugagagagcuuuugagaaguaucagcuccauucuccauaucccagauucugacaaagggaguaggauagagccugcucgucuguguuuuuaaaaagcucccagcugaguccucucugcagccagauuaagaacuccugcccuauaaucuccugacuguuaaugacuuaagggcccgggguaaaauaaacuuuuaucuuuaucaaauuguuauauuuuuaucagcuauauuuacacuaguuucucucuguucuauggcauucauccauaccucuuuacuaaacuuauuuccaacugauucuucuuaguagaucauagguacucuuuauuauaauuuuccuugaauucuuugcagugcuugaucggacugucuaacacuucaucacaaacugucuucucccuuaacuucacgauuccacauugcuauggucuaaguguuuguguucccccaaaauucauaugaugaagcuuaagcaccaaugugaugagguauuuaggagguaauuaggucaugagaguggagcccucaugaacgagacuagugcccuuauaaaagaggugcuagagaauuuccuugcccuuuucccaccaugugaggauagaaaaaaggugccaacuauaaaccaggaaacaggcccucagcagacacugaaucugccagcacacucaucuuguacuuuccagccugcacaacuguggagaaguaaguuucuguugauucuaaguuuccuaguuuaugguauuuuguuauaguagcccaaauggacugagacacacauuguucuggguaaggccucuucuaaugaucaccacaaucaggugauuuguuaucacagauucagcuguuaauaaucuaguaguaauguuagaaaauauacagccuuucauucugaucauuuaacccccaagaaaaccgagaaccugaacagcgaagugccuuggccaagguaacaugggugguuacuuccaagaacaccaaguuucuuuagcuaaggccaggauccugccuaccuugcuucacagcgucucuccaacccugauuucuuuuuuuuuuuuuuuuuuuuguuguuguuguuguugagacagagucucacuucgucacccaggcuggagugcaguggcacagucuuggcucacugcaaauuccgccucccagguucaagcaauucuccugucuuagccucccgaguagcugggacuacuggcgccugccaccacgccuggcuaauuuuuguauuuuuaguagagaccggguuuuaccuuguuggucaggcuggucucgaacuccugaccucagaugauccaucugccucagccucccaaaaugcugagauuacagguguaagccacugcaccuagcucaaacccugauuucuaauucaaccuugaaugcuuccaacuggccaugggaaaauuuuaccuggauuuccuguuuucacuugaaaauaaauaaggacauagacauucuuaauauauuagcuguuauucaaauccuuguguuuggcauuacucuauuucugucauugacucaauuucuucaauuaccaucuuaaauaaacaaaucuaauuaaaaucccucuguuaccaagcccuguugguuuuugacaucuaccuuguccucuauccuaccauggcuauuauuagagucaaaggucuccucaaacuacugucuagaacuaaaguuucuucaguguuuuccagauguccucuuuauucaaccuuucaucaauaucacaguuaagaaauauuuuguuaugucacauucucaaauauuacauuuguguaucucuaacaacacagcacaaaaaauauugcaugugaacuauucaagcaauguuuguuaaauuaugcugauuuaaaaagucaagcuagacauauucuaauaaauuaaaguuacaggacuauuucaauaaguuuuaggaguucuuagaccauaauacauugaaaagguuugcugaaaagcuuuuuaagauguacaacauggauaaggaaaaaaaguaguguaauacaugcaaagcaccugauuuucuguuuguacuuuuguacuaccauaaaacauguuuuaucuuaaauauauuucuuuuagccugauuauaaucgauuuaauacacgcucauuugagaaacucagauaauacagaaaauauaaagugaaaaguaaaauagcauuacuuugucuagcuaaucacugauccuaacuugagcuguagguucaacauaaccucaaucaaaagcaaguuguuuuguagauauuaacaaacugauucuaaaguguaccuggagaaggaaaaaaccuggaauagccacucaauauugaaggagaagaagaacaucagaggacugacauuagcugauuuuaaagcuacaguaaucaaaacagcauguuauuagugaaagaauagacaaagagauuaacagaacaaacuagugagcccagaaacagggccacaggauauagucaacugaucuuugacaaaggaaugaagguaagucaauggagaaagcacagacuuuucaaaaaauagugcuggaacaacaggacauccuuuugcaaaauaauaauaauaaaaaaucuagacagacuuuacacccuuuacaaaaauuaacucaaaaucaaucauagaccuaaauguaaaacacaaaguuauaaaaccccuagaagauaacauggaaaaaaauaaaugacguaggguauggugaugaucuuuuagauacaacaucaaaggcacaacccaugaaagaaauaauugauaagcugggcuucauuaaaauuuaaaacuucugcucugugaaagauaaugccaagagaaucagacaauaagccacagacugugagaaaguauuuguaaaagaaaugucugauagagaacuauuaucuagaauauacaaaaacuaauuaaaacucaacaauaagaauauaaaucaccuuuaagaaugagcaaaaagucugaacagacaacucaccaaagaaaaaauaugguugguaagcaagcauauguaaagacguccaacauaauauagcauuugggaauuucaaauuaaaacaacaaugagauaccaccacacgccuaucaggagggccaaaauccgaaaugcugacaaccccaaauucuggugaggauguggagcaacaggaaaucucacugauagcuaaugggaauguaaaaugauagucacuuuagaauacaguguggcaguuucuuacaaacuaaacauacucuuaacauaggaucuagcagucacacuucuugauaucuuccuaaauaaacugaaaacuuaugugcacacaaaaaucugcacacgaauauuuauaguagcuuuauucauaacuuccaaaacugggaagcaaucaacaugucuuucagcagguaaauggauaaguaaacugugguauauccagacaauggaauauuauucacugcuaaaaagaaacaaacuaucaaacuaucaaaagacauguaggaaacuuauaugcaaauuacuaagugaaagaagccaaucugaagaggcuacauacuauacgauuucaaauauaugacauucuggggaagaaaaacaaaaacaaaaaaacuauuaugacaguaaaaagaucagugguugccagaaauuaguugggaggaaaggauaaaaagucagagcacagggauuuuuagggcagugaaacuauucuguaugauaccacaaugagggauauaugucauaugcauuugucaaacccauagaauguacacaaccaagaacgaacucuaaugugaacuauagacuuuggguaauaaugaugugucaauguaugcucaucauuguaacaaaugcacuacucugguagaggauguaaacagugggagaagcugggguauguguuugugaggacagaggauauaugagaacucuguacuuucugcuccauuuugcugugacccuaaaaaugcucuaaaaauauaguuuacuaauuuuaaaaaaacucaguguacauaucuaucugauuuuuugauaaagaguaacuuacaagaaaugaacagaaaucauaaaacauaaaauaaucgagagaucugucuguacuuuuaaaacaauacaugucuacgaaaucaaaagucaaauuacaauauaggaaaaacauuugccccaaauaucacucauagucccuuaauauuauauaaaucaauuugaaaaauaaauuucaauuaaaaaagacaaaguucaugagagaaaaauucacagacgaaauacacaaaucacuaaugaacauacgauaaaauguucauuguccuuguaaucaaagcaaaauguaaauuaaaauaaugauguuuaucacguaucaaauuaaaaauuagaauaagugacagaaaucagugcuaaaaagguaaaagugaaauagaugcuaccuuacacugccauugggauuuugcagcaguaaacauuuucuguaaagcaauuugacaauaugacaauagccuugaagauguuccuacuuuuaacccacuaauucuaccucuagaaaucugcuuuaugguaguuaucagaaagguagaaaagauucauuuauuaagaucauucucauagaauuauuuauaaauuuaaaaaauacaaacaaaauuagauuaugccauauaaguguucaguaacuaaaauauguuucaaguggucuuagagaauguucauaauauaauauuuagaaaaauauuuucuuauagagaaaaauucaagaugcauauagggaaaguauguagaagauaaugaaauuuuaaaaugauauaauugucuaccuagaaauucaaagagaaucagugagaaaacuacuaaagucagaaaauauaaugcauaaucagaaaauaaauaagaaaaaagagcuauauaucagcaauuaggguaggagacugguaggacuuguuuucugcuaucaaaacaggaucugguccauacaaaauaaagcaaaaaaaccaaguaggaaccagcgaucccuagcugccuucauugcucauuggcauaagacacuccuaccaaugccaugacaguuuacagaugcaaugacaaugacccagaaguuaccaccuuucuccaugacaaugaccuggaaguuacugccccuuucuuuaaaaguuugaaaugaugggccucucaauuugcauugaccugccccuugauuuacauauaacugaaaguggguuuacauauguaaauauaaguugccaagagcccauacauugacucuggcugcacugccuaugaguuaguccugcaaugcaaggaacgguaccauucaauuaaagacugcugucuaauaccacuggcucgcccucaugccaagaacccuccugggcuaagccccaauuuuagggcucaccuguccuguaacacuaacacuauaacaaauuaggaaauauaguaaaaaaucaaaauucuuaguaaaaaaaaaaagaaaaagauacucaaaagucaggaacuauaaagaaaagacugauauauuuuuaugugcuguuggacagaagagcugacaaaaguaauauaaaagauuaaaacuggaauauauauuuauaaauguagacagacuugcuauucauaaucuagauagcaagucagaauaucaauaagaaaaagaaaauaugccucaauuaaaaagccaaaaaagacauggaaaaacaauuugcuaaagaaaaaaaagauuaauaaccauguaaaaauuuguucagcaucacaaaaaccucaaagaaacuaggaaaacaaaaagacuuauguugauuagauuggcaguaauuaggacguugauuaagucuaauguaugagguuaaauucuuucugacuacuugguagaguaugaauguauauaaauuuuauggaggacaauuaguaauauuugucaauggacaaaauuuuaaauguacauauucaaaaauugugagauuucaauucuaaaacuuauuuuagcaauauaaguucacagguacacaaagauuuauauaaauagaucaucuuuacacaaaaacucaggauauacaaacacacuagacaccucuuguaagccacuucauauuuauuaagucuaauguagacguuguaccauucaagcaggugcaugaugcacagaggaauuaaugccccauaagcaaacuuuggccaaugggagacaggagacagcagauaaauuacucucccuuccuuccuuguccugagacguuguuuauguugccuuugaagauaugauucugaaagacugagcaaucuaucaugcuugauacugagcaguggucagcucaguaccucauucucauuuuugcuuuccugacauccuuaccucauuuuccuuuuccuaaaugugaggccauuuuccaaaaggagaagggaaaugaggcaagaaagccacuuacccucuaggauugaacuaacucacaaaauuaugacacaaaagccuuuaccuuacacauuguuaucugaaaaauucuuagcuaaaagaaaugcagaaauucuaaauguccaucaauaggaauuuaugcagaaauuaaaaaugauaagauacauugauuuguauugauauaugugacagauggaauuuucuaauaguggucuagcaauauuucugguuucacauuuuauuucagugucguucuauuucucuucuaagagcuggagucuacaucccuacccuugaacaugggcaggccuuugugagugaucaaccaaugaaauccagcaaaauugacacugcaugacugcugaggcuguaauacaaaaggugauacagcuuccacuucgcucugacucuuucacaaaagauuugccuuuggaauacagccaucauuuggugaggaaacuauuauaucagaaacugugaagggucugagauuuuaucuuucuuccaagugaacaauuuagacugccacaggauggauggguggauggaaggauggauggauggauggauggauggauggauggauggauggauguauacacauauauagccauaaacauccauauuaaaauuaugaauauugcuugauucacacacauacauauacauacacacaagaaacaugaggccucugagucauagacaaauacaguucauuacucacagcaagaacaacaccuugcaugaguuuucuaagcccaaguccuugcagggcaacaugauggccagaaugguaccugcacaugcaacggggugcauuauaaaacagaaauccccaaauuagaaaauuuuugaucuucuauagggcuguugaugaugugccaauccucccuucaggagaaagagaaacauuaucuucauucuggaaugcaagcaaaucuggggaggaggacagguuuuuaucuuuacuacccuggacugucuccaggaagggagaugucucuaagcuucacuauccuggaaugucuccuuauaaaaacguuauuguaaaugccuuuguucagagggccuggaucauguagaaccaugaaauauucauggagaauugucuuccaauagaaaccccggccacauagagagcccaaguggaggcauuccaacugauagacuaaacuaagaucuaagcccacagccagcauaauuugucagaaacaugagugaaaacgucuuuucaugguuccagcucccagacuuugagccaucccagaugauacaaaaguggagcagagcugcucugucccuggugaucccugccaaagacugaagauacugcuguuuuaaacaacuacaucuugaguugguuaugcagcaaaagauuacuagaacaacaugggaacauguccauaauaaaucacauaagcaguuccuaaacaaaauguauaacuugauuacauuugcauacacacacacacgcauauaucugaguacacacacacacacaaacacauuuauacaggcauagaaauaagacaaacacaaacauacacaaaugcacaaaaaaucaugauguuaggccaaaaugguuuguucuggugggacuugaaauuuguacuuuauacacauauguauucauugguauuguucuguaaacaaagacauguauuaguuuuaucagaaaaaaaaaccuuagcuuuuguaaaauaauguguauacaccuuaaucucuagauuguguguucaugagcuuuuauucuuccaucaacuuucuauagagaguaggcacugagcgcguaugucgugaugugaaguaauuaggauagcaauuaggauagcaguggaaaugguuucagacaguacaggcugguuuccuuugaacagaaaugugaugccauuuuucuauaauguuaguuaccuugugagaugauagaaccuuuagagaucuuuuaaagaaaaaaguguuuuccuauacaugaagucagauaaugccucuuguuauuauuuugaaacuugauauugacuauaauuuuucuauuuuucucucuagaagcaccuggugaaaacagauuuaagaaaauucugaaaacacaugauuuugaauuacaauuguuaaagauaaaugguaaacauaauuuuuauguagguuucuucacaaaaucaaagagaguuucaaggcaaaauagucaauacuaacuaguuaugcagguuaccuggaaaaccuauaguucauuggacuauguacuuuaauaugugauagccaaagaaaugacaguuuauauaggacaugauaaacacacaaucuaugaaauguaacacauaaaugcuguucucaauuuagacagaaucauuuuucuguuuaaaguauggacuaagaauauuauuaaaucaaagugaaagcaaaagagccuaugucuuacagucaccaauaaauaguuccagauucuugaaacuaauuaguguuaauuagguagguacacauauauuuuaaauauaggcauucuaauauucuacuuguauguaauacaaccauaaguuuuagaaagaaauaacacugccuacuuuuccacuuaacauauuuauauuuuccauuuaaauuuuuuucugacuuguuuuauauaucaguggaaaacuuacauaaagaauacauuuaaauauuacauccacuaugccuuacuuaaucccucuggaaugaauccuauggaaugguaauagugaacagacacuaaaucauuuuggaaaauccacaggagaaacauguauucuuuuuuuauuaauauaaaauucuggucuuuuaaaguguuccacauuaaguaaguuucacucugucaaaaaaauaaaacugugcuuuuugcuccuccauuguaauaauaauguagcuuggaacaugcacuuaaaacauuacugaauaacuccauauugaccucaaaucccaugaaaauagucaaucuagccagaugaaauaacauuaacagauaauugauaugugaguacacuaauauuccaagauuaauaacacuuaaaacacauguaacuaacauacucugaaaauaaauacauacaaagagguuuucauucaauaaucagaccucaaaucagacaucaccaucuugaaauaaaauaguuugcuugagucucuaauaacugcucguuuacucaucucugccucauacuagacuauaauauucuggaauucagugacuguccacaugcagccuagugccuagacuauaucuaauauacagcaaguauaaagaaaauauuugcuguugaauaaagagaaaugaaaauaaagcuucuagauccgucuuuccuucuagaugugucauauucccaaacccauguuaacaauuaaacucaugaaaggacaguuauaauacacauuuuuaaggccaguucuaucacaauuuaagaaaacacaccaagauaacaguccaaaaauguucagucaguuaaaaaauaugcaccaaaaagacagacccagggcugugaagaaucaagggaaaagaaaauauauggggaaaaauuuaucuuaaaugauugcuaagcuuucugaccaagaagaaauugcugcuaacagaaaaaaacaauuaauggauaaucaaaguuauacaaccuaaaguccuacauguuagaguccuacauguuagacacuucuaucuuuucuguaugacuaaaauguucaggaugaagagaucuaaugccuauggggugauaugacaguacaguguaguaugauauguaagaaguucuacgcuggaaaggugugcauuuuggcuccaccuccaccacugacaauuguuuggaccuggagaagucaucucacuucucaggacuucauuucguaagacugauaugcaggauguauucaaugaucuuccaaauuucucugauucuaugcuagaaaccauucugggcagaagcagacacaacaaagaaagagagcuaauuccucauuauccuagcagagaauguuuaauaucccuuauacccuuagccaucugucaauuuauucaaugugaaugacauuuuuauuuucccaauccaaauuuaucccuucucuuucuuuuaaaacucugccaaaauucaucuucuucaagauuucuugccaaacauaucucaccuuuauuugaucacuauaaucagucccacaauacuucaauuagauaugccacuccuuaaacuuaaacuuagacagguacuugccaaucgauaucuuaauuuauauauggagaccuaucuggguaaaucuccuuacaaauuauacuuacuauaggaacacuaauaaucaaucuacucaauacucaaauaauaaugugauagaccgaacaauagaaaacuguaugcuuauaguaaaacaaauucagcuauaaguuuugaaaauauggaaagcuucaauuugcuuuuuucacauacuucuuauaauguuugaacuguucaucuacuacagcaaucauucuuuuggcuaaaugcacuuucuuccaaaaccaccaaauuuauaaaacuuucaguaaaaaacaguaagaauuauaucaaaauuacuaaagacacucaucgucaagucuggucuguuaaaguaagguugaaagggacaggcaguuuaaagcucuuaguuuauucuuuuuuuaagacaagggguccauuuugugucaaacuuuaaaaaaaguccucagcuaaaggcauauauggauuaccacacguuguaaguauacuuagcuaagggcagaauaaugccacugccaagauaaguaggaaagcaauguuaauuucuagaagguaaaccaaucuccucgaacaugcuaccuagaaauuaaggcaagacaaaagcagcuuccauauccuggugauguauaaugaaagugacauuauuuuaucugauacaaauucaugaaaaaggaaaaucaggcuauuuuccuauaaaagauaaaaaauuauauaagcaucuugagcagcuagcaagaucugacaugcucaaaucaauuuggcacguaagggaaauugauuuggaaaagggagaauauccacuuuaucuuucuguuacaaaaccaauaguuauauuuaaugaaaauuuacgucaagauaugcuuugaauuguuaccgauuaaccaacagaggcugaaaucaguggccuuuaauuaauaagaaauaacaacucaguaguuuaggcuuccuaaaugcugaugagauggcuugguguucauuaaacagcaguggucuuaagaggcagggaguccugggagcagccagcuguuuggaugaaugacucaucauuaaccuugaugaaacaaaaaccacugucucugucagacauucucugacauucaucugaucgauauuaaauagcaccauguaacaggucaauguguucaauugucuggggaacaucuagcagcucacuuauccuggcaggcauaucuggagaccugcaaagggucaucauuaaggcuuuugggauagcuauuugugugccauagauaauacuuucucuaaggauuuucaaacacaaaacuaugucugauuuguucuaacuugauguuugaauucaucaguaauccaaguacuggagcaaacucaaaauucuuucuuggggaauaucuggucuugaucaggugaaaccuauggggggcuggccuuuugucuagccuagcauaccagucuggcucuauaauuugcauaaauagaauaaaaguccuaccaauugugugauccuguauaguucuccccuuaaucagcauuauaaaacaccugcccugcaggcugucuucagauuguauauuauuaaacuauucuaucugauuccuaagaaaaauuugacuaacauaaaagacauaugaaaaaagagagcccaagccacugauuuucaaaaugcuacugagacuaguugcauuagaaucauauuagguaccuguuaaaaauauagauuccuggaucucaucucaaacugacuaaaucagaaauuccaggaauagagcucaacaaucuguauuuuuaacaagaacuuuauuagucuuaugaguacucaaauaccacuuuaagggauucaaaauccagucaguccugaggcacuugaggcuccucuauauuuggguagcauuuaaccucuguggauauucauacaacuucauuauuugaagcaucugcuugauuaagauggguuucaauguuuaaaguccuaauuuauuuugauaacuaucagaaaacaaguaugugauuucugcuuguguuaaaaaauauuaaaaagacacugcuaguacaccacucagcauuaacuccaucgccuuguaagagaugauauacauucgcuuuucugauauuaaaacucuuuuauucauaauaacuccacuuucuacuaggcugccaggaagcucauaaccaaacagaugccuaacuacagcugaacucgucucacaguaagcaaauuuguuucugcccuucucuuugauuucuuucuuccuuucaauuacauuuguauuaaucuuuuuugguagguuaaacaagaaaacaaacuuucaaaguucucuuggaaagaagcagaguaugaaaaaaaaaucucaaauaacaauuacagugguuuuaucaguugauuuaaagucaucauccauauccauuugggcuugggcuuguucuauuuuucccccauacacuugcagaaauacaguaggucuagauuaauaacaagguauccuccuuguuccuaaaaacugcagggagauggucucuguuuccagacuaaaguuuuugcaacacuaauuuaaucaaacuccuuggacuagcagagggggagggggacagggagaaucaaaacuaaccacguaccaguuugaaaucuacaguuuacuaucaaucuggacagauaacuuagacuucagccuuguggauuagaaauauccagaaccuauagcauuagcugcaguaggucugcuggaaucaaguaucaauuuuaaagaacuuuauuuuauuuuauuuuauuauuauuauacuuuaaguuuuaggguacauaugcacaaugugcagguuaguuacauauguauacaugugccaugcuggugugcugcacccauuaacucgucauuuagcauuagguauaucuccuaaugcuaucccucccuccucccccgaccccacaacaguccccagagugugauguuccccuuccuguguccauguguucucauucuucaauucccaccugugagugagaacaugcgguguuugguuuuuuguccuugugauaguuuacugagaaugaugauuuccaauuucauccaugucccuacaaaggacaugaauucaucauuuuuuguggcuccauaguauucaaaucacuucuuucuacuuucugaucaugucuuucugaaauuacuggaucaaucauuuugguuuguagauaaccccaaacagauaagcaacugguugacuuucuucuuauuucuuuucuuuuucacugaaaaugaauaguugauuuguuguuuugauugauauaaaauguaaacuuggaauucuguaggcccaagcaaacauuuugugauaaaaaugagagugcucaucaaaauucugaggauuccaauguuuuuaugaagcuuuugacucagagaucuguauuauuagauaauuuagagauuuucagaaguauuuuuucagucugacuaaagucugacuugagugcugucugguaucuuuggccauaucagaaaaccuaaaugaaaaaauguuaggaauuccgauaaagacaguuuuuagaaaauauuucagagcaaaauuugagacuaaaaaguuuaguacaaauauugauuuuuuguuaaauaaaaaucuaguaugggcugugugugguggcucacgacuguaaucccagauuuuugggaggccgaggcaggcagacugcuugagcucaggaguucgagacuagccugggcaacauggagaaaucccgucucuacaaaaaaauacaaaaauagccaggcaugguguuguguaccugcagucucagacacucaggaggcugaggugggaggaucacuugagccuggguggcagagguuguagugagcugagauugugccacugaaacuggccuggguaccugggugacagagugagacccugucucaaaaaaaaaaaaaaauacguuguuuaggaguauacaguugugcaaauaaaaauuuaaaaucugugucuuuugucaggaguaaaguguaguuuuuuuaguucuaaaccuagaauaggaaaauuguucauguuauuacagaccauccuucacaaucauacucauaaaaaauuaugaauuguacuuuuaaaacuuguucucaucuacucuggacuuaaacugauguuauauuuuuaaccuaaaacauuaauaugaggaauucaugaaccaaccugucacaugugucauuguuuaguuuugcuguuguuauaaucaaagcuucaccucauucugaacugauuaaguagagaucaacaucaaugguuagauggucagaauaaacaaaucaacuguggggcagcauuauauuccauuuuguggaauauauaaagccaagaaacugaauuggaaaaaagaggaaaauacaagauaauuaaaaauuuaauuuuaacuuauaaauagcaaauuuuucauuuauccuaagauuuaaaaaauauuucagucacgugaauaugcuaugacuagaguaauaaauuucauagaaaauauuaccuccuauugagagauaucucuguauguaguacauucuuggagcccuuaagauuacuuaaaaggcaaugucauguugaugguaauaccuuuuauugaccaauugaauguugacagauacaauuauagaacuuaaguauaucuuaaauucuauacuuucaggaagcugaagaaaaaaugucuuauucucugcaagcauguuugucuauaauuuauaguuaguacaauaaagguauuaucagaaucuuggccuugagauucauauaacuagauuacugcucaucucauacucuacaaaauuggagaacaauaauguauaccgcacugaugcugcaacuauacugacaguucacaaauuauagaguuuaaauuuauagcucccuuuacaucugucaucaacagcucccaaaucacaaggcuugcaggugaauccaccuacauuuuuuguguuaaagccauuuuggaaaaaaggaaaccuaagaaaacuaaaacaaagguuaacuaaauuuccuucuuuuaaaaauaaagucagggcaauccuuucaauuuugaaagcaaaguagucacaauuagauggaucuagucaaauaauaauggauaaaaauguauguaaugaauccaacuauucaaaaauacuaaugucauuauuuacugauuaaaaaaauuaaaaauuccucaaagguauuuguuuuaucucaaagccaagagguaaaagaaugacuaccaccagcaguuugugugugugugugugugugugugugugugagagagagagagagagagagagagagagagacagagacagagagacagagacagagagacagaucuacuguaagacagagagaagaaaaauaagcuaaauuaauuuuugcuaauuuaauuuccauuagaaggagaaaaugaaacauuuuuccauuaauauaaugcuuuuuggugacgacaaacuuuuuuuuuuggagacagggucuugcgucggcugcacucaggcuagagugcaguguugcaauauuggcucacugcauccucaaacuccccaggcuuagguaauccucccgaguaggagggacuacaggcaugcacaaccaugcccagcuaauuuuuauguuuuuuguagagaugagauuuccauauguugcccaggcuggucuugaacuccuaggcucaagugauccagccucagccucccaaagugcuggguuuuauaggugugagccaccacaucuggccuuuuaaacaauuuuuuaauccggaaagguuuaauacaccaaaacuuugugaagccuuuggagaggggucuuaccuccagaugacaguuuucucacuguaauuacuaagaauuuaaauuuucauuuuucugaaaauacuacugaaaggucccaaaagccuguuaaugaccauaggccagaaagaaaaagaacugaaauauccauuucucauuuaucaacuaauucugaaaacuuuaaccaaauuacaaaaauauuuuaaggauaauucagaagauaugaaacuugucaaucuguuuaccaaauaugugucuauuauaauauccaaaugccuaaagcagauucagaaaauaugggaaaacauauuaauuccaaucaacacuauuauauuacaaguauaaauuauguccacaugaccugcaugguuuauuuauaaaauauauauuuuaagugacuaauauguacaacauuaauuuguauauuagaaguuuuugacaucucuagcaugccuguauuuucuuaaauaaacugugugcauguauggauaagcaacacauauuacacucauauauaaauacauguggauuuuuauacuuuuauaaaaucccccaguggggauucagaaugucuuuagagaagacuuuuaaagucaauuuuuuuuaauauauuuuauuuauuuuuuuuuagaaauggggcuguguuuuauacuuuuauaaaauccuccaguggggauccagaaugucuuuagaggagauuuuuaaagucauauuguuuuauacauuuuuuauuuuuuuuuagaaacagggucaugcucugucacccaggcuggaguguaguggcacaaucauagcucacugcagccucaaacuccugggcucaagcgauccucccacaucagaccccgagcagcugugucuauagauaugugcucccaggcccggcuaauuuuuuuuuuuuuaauuuuuuguagagacaggguuucaguguguugcgcaggcuggccucaaacuccuggccucaagugauccuccugccucagccuccaaaguauugggauuauaggugugagccacugugcugaaaguaaaauuuaauagaaaaaaaauaaauuuacuuuugcauucucaaaauaacuaaaucuuccccacuauuucagugccuauaaagaucucugaaaagaccuucaggucuuuugugaacauauuacuuuauuuuagacuuucaaggacauuuguacagcgaacagccuuggaagauaaagauaucuuucucuagaacaaagagcaaguuugaguacagccuuagaaaauaaacgucucucccuaaaaagcagagagcuggcccacuuaccuccucauauaaaaaauucagauuccugaaguucaagacccaccuccuauaacgccuggcccuccacacauuacccuguggaaacugggggaucggagaaccagcacaaauucugauacucuggcuacugcuguugcuaugaguaauaaacugcccuuuuucucugaccugagucuuaaauccucuguuagaauccaugauccaauggcuggcuuacacauuaguuugcaagcaggguaacauuucagacccuccacagcucuugucaaccuccaaaucucagggguuuauaauaacaccaguuuauuucuuguuuccuuacauuuuacucacuuuacauguuggucaugggucacgggggaucagcuuagcucugcuccacacaucuccuucuuuuggggauccagguuaaaagagcagcccccacugggacauguuuguucucaugacacaaagaaaagagcaauggaaaguccacaguaugauuuuucaacauuuuugcuuggucauggcauacuggcagacuuacauggaaggucccuaacuuauaaagguuugacucaggauuuuuccacuuucugauggugagaaagcaauaugcauucaguagaaacuguacuuugaauuuucaucuuucccccggcuagcaauaugcuauaucaauacucucucaagaugguggcacucucucucaauaguggcaaugagccauaggucccagacagccacaugaucaugaaguuaaaacaaacugguacucaacaguauacuguguggccagaugauuuuugcccaacuaauguaaauguucugaauacuuaaauauuaagugcuaaguucaauguuugguagguuagguauuuugaauguauuucaauguacgauauuuucagcuuaugaugguuuuauugggauguaacuccaucacaagucgaggagcaucuguacucuacugaccaaagcaagucacacugauaagcccaauaucaaugggaugcagacauauucucuucccacagggagaauugaaacaguaucaccccaaauaggaagaaguaaggaugcauaacauacuuacaaagcaaaggaguguauaauagaaacaauacauucuaccccacguaacacauauuuagaaaaagauaguuauguaggauuuguuauguuaguuaauaauauagcuaauuguauuagugcaaaaucaaaaauuugaaagacccguuccauguuucaaaaguuucuaaugucuugcauuauacuuaugauaaaaagaaaaauaccaaaguucagugauuacuuuuuaaaacaagaguagaaaugcauuugaugagaugacauauaaauugaaauaaaguuaguacuagugauuauuuuuuaaaacaacaguagaaauggguucaaugagaugacauaucaauugaaauaaagguaguaguacaguugguaugaauguguucaaauauacacagggacacacaagcaugaaaagaauauuuuuaagaguaauaaagagaacuauugcugcuacuauuaauagaaaaauauauuuauaaagcaaaaauuugaccaagccaucauuuaauaaucacaacuaauguuccaagaauuauuuaaagaguauguuuagcaucucucaugcucccuuuugaaguuuucuguuguuguuaucaaaaucacccugaagaaacacagagugcaaaaaggguuauuucuuauuuuuucuuuugaauuguuuuagauguaaucauccuuugagccaucuuuucaucaaauaaucucuuugaacuucuuaccuguguauugccauaugcuagacacgcugcaugaaauaaacaugcuuuacuuugaggccaaugaaccaauuaaaauugucuacuuaugcuauauuccuaauuucaaaucagaagucauaauuucaggauuccaaaaacuaugauaaccacucuccauucuaacaagucuuuucuucccugauuuucucuucaguuuaacaaucccaugugcugugauccauugacuacauccuuccuuuuuuaaguggcuaugcuccauuccauagauauuuaucuaaauaucuaaauauuuccccacugucaugcuagcuaccugucuaauauuauuuaggauguucaaauauuuaacuauucuuacccacuuuuaacauguuuuuaauucaguauuuaaaauuuguauauuuaaagauaaacuuuaccuauuuucuguauuauuuguaaaagauuauacgugucaggaagcgcauacauuugcacacacacacacacuguaacuaugcuuauucauucauuguuggguuuaauaaguauuaauugaaugggugaaaagauggauucugacaaacacuaaauuuuaaacauccucuaaaaguaaauaaaauuaagacggacuuuucugaauauuuucaaaaagaaauguaaauauguuuccugccuuucagcuuuucccaucuugccuacucuccaguguuagccuucauuucgcucuuaccaacuacauuucaucaacauuuacucugaguucuauaucuuaauuauaaaacauuguuugaagcucuagcuauggcugauauauuuuuaccuuacaaaugcuauucucuugaacuuccugcuggaagaaucuuaguaacagaugguggagcuucuagagauagauuaaauaaaacaaaacuuugcauaucaauacaaaucugacaagugacuuaaucacaaaagacacccuccuucaaaaaacaaucagguaggcagcaccgaugaaccccgagaaaagaagucacuguagagauaccccuucuguauuuuucccuauucauuaaucaagcagcauuuaagacagcuuuucauuuuuaguauuuaaccugauuucagcuccauuuuuaaugaggaaaauuauguaagaacccuaccuuuauucuccaaacuaauuuuuuuuuuuugaggagaacauggacaucaguauacuuaaguauaggcuaaaaauugauacaaagcagaacuucuucagaaauucucuaggcaugucaaaguacauucagguauugggagcuauaggaguaaaaggauacagauaaggcaaaaguaucucugaauaacauuaacuaaaggauucugucuagcaaacagauuucuaugaccuuugaguaauaauuuaaagacaugauugacauuuuuuuucccauagcaaagccugaucauaaaucuuauccuugaguaucuauuacauuuguuguuuuggcucagguuucagguucuuugcuguuacucuacuuuaggaaauuucuaauuggggugaagagaagaaaagauuaaaagaacuaccaauuucagcacgaagccucggugacagaaagagaaauggagauaggaauaaucgcauaaaaucugguaguugguuguggagaugggagugaguuuuaaaacagcacaaaggcgaugguuugagaacauucagauaagagggaagaggcaagcagaaggaagauuuuuaagccacagagaucagagaggacaggguauuccaggaacucaguaccaacuggcuucccugugccaccugagcucucucaggguugcucuucccucuauugcuucacucuugguagcacaucagggcccauccuccccacugugaaaccucccuaguuuaaucugcucuuccucagagucauaacucuccucccuaaaaugacaauuuguuaaucuuaaaaaguauuccacgcuuggaaaaauaacaguaaaguucaaguuaauuacucuuuuaaggauauuuacauuuuaccaaagguuuccgagagacacaaagccuugaacccaaaggaguaaaucccaaaucuuggguguuuguuauuuagugaucuguuuguggaagauuccaauguuuccuaaaucuaagcauacacacauagcuucaguucugcuucaguacugccauggcuguauuuuacaaaauguucaaagaacacgaaauacauuaaaagaaccuuaagcuauaauuaccaauugcaaacacaguggcagauuuucacguacaaaaaauauauauauaccucaauauacacuauugguuaaagggaauuuuacacagaugaaaucuuuuuuauucacaccaucuucacucaauaacuuauccauauaauuaucacuaugcacuuguauuagucugcuugggguaccauaauaaaauaccacagacugggugacuuaaacaacagaaauucauuuucucacaguucugaaugcuggaaguccaagaucagagugccugcaugguuagguucuggugagggcucucuuacugacuugcugauggcugccuucuugcuauguucucauauggcacagagcucuggggucucugccucaucuuauaagggcacuaaucucaucaugaggggcuccacccucaugaccucauuaccccgcaaaguucucauuuccaaauaucauuacauuggggguuagggcuucaacauauggauuucagaaggacauaauucagugcauagcagugagaaaaugcugccccaaguccuuaagacaauucuacaauaaaauguaugagcaagaaaguuuuuaaaauuaaacaacuaaauguaugaacaauaaaaugucuuuauguauguggggaccugaaagaugauaaauaacaugacuauuaccaagaaaagucccacguauuuuuuuuuugauaaguuucugugaauuuaacuacccuugagcaucucucuucuuugcccucaucucuagauuucaccuuggaucagguugaacagcagcaccauucccuuagauaugaaagcagcugccaauccagcuccuccaggccuuuguuugaaaacucuuuauuucaguaggggagccucaagcucuuacauuucaaaaauaagcaugacuacacucaaaugccauucucugaagcugguugauuucugaaacgccugaauucauuauccucacauggagguuucugaugcugacauuucucggccucuccaugcacugcucagucaugguguugucacccccagagguccccauaggucuuuagggcuccagauaaaaguaaucaacauagggagcaacaaaacagcaauuaacugaaggcagcucaccuucagagagacgcaaacucaagcuucaaaaaguuuuuaucuguagcucuuuuuauucugaauaccagguucuugugagguuuguguguguguguguguguguguguguaaccaagcugaaaauucagugauacggagagacaagcaugacguauuagaugagcaagacuaacuaaaucaagccgagacaaagaacaccugguguauauuauuuugacuaaggauuucuucguuuuucuuauuucccaagcccauuuuucuguuugaaacaaaagaggcaugaaauuuauagauucaguaauuacaggaauaguaauuauguuggaugaagacaacccuuugagcuaguuuagcgauaagcaccaaaaucaaucaccccaaguguaaaguggcacaguagguuauauuuuuauaauugugaucaucaaauccaggcccagaggcugggggguucaaaucauagcaaauuuaucacauauuuuauuccaaccugcucuagucuaaucuagacauucauuaaacuuuugagugucaggcccugggcuaggcaaaggagacauacacaaagauuacuaaaacauuuucuaucuuuagaaaaucucuaacagugaaaauaugaacuggcauugggcaggcauugcucuguuuacauaagaagucagccagcaacugucuuuaaaugaauaauugcaaugggaagaauacuccacuaagcauuguaucuggugcuuuuuacacauacaauuuuccuugaauccacuagccugucuccauuauucuuucuacaaucuaaucaauuucuuguucuggaaaacagccagguuuuaacaguuccugaacugaaugcaaaaagaaaccucugaaaaaggaacaaaauuucuugaaaaaaauuaaaacaaaaaaaaaagagggagacuccaauuauuuuaauauucucuuggaaaaggaagcuuuaaguuuuucuaacacaagaauauuuuucucuagagaaugcuaucacuuuuaccagggugcucauuuuuacuauauaaauaguuucuucagcuuuuacuuggucauacgcaacagaaacuguaauuauuuguucccagaguucaggaaaaucaaccagguagaaucaauuucagguggggcuauugaaacuuucuaauaaaauaaaacacauauuuaauuaacacacucuuucauuucuaccauccaauuucuaauuaaaaaucugauucuguaaauucagauuauuugaaaaucaucugaaacuaauuacauuuuuaaaacucaaccaauaaaagggcagauuauacauaagugcaauaguuguaaauaaagucaauagaaacgagaacgucuaaucuuuagaaugaaaugucuuuuuaguuaguuccacuauauccaccuaaucaacaauuacacacauacgugcacuuacauacacauacaacccacuuccucaggcauucacaacauuauuaaacuguguuuaaacaguaugugaacacagacaaaacuauaggccccuauaagccaguguuucuugaggcauggccuggccuugcauuugaacuguauuaguuucauuuggggaauacuugcugaaguacagcuuccugaaacccacacaaguucuacuaaaucagaaucucaaggaagccagaaaaucucuauuuuuuacaagcuccuaaggugauucuaauacacaugaaaauuugggaaacagugcuauaacauuuuagucagggacaacaaaguuucuauuuagauacucagaaugggaugagaagcuuuggcuccauccuucuuucuacuguccuaagauuucuuucuucccauggagauaguuuuacuacuagauuucaggccaucccguacuaaauuggacuuugccuuuuuaauaucucuuugauaucuugacaaauaucuuguaguccugcuauugcccuguagauaagacaauaauuucuuuugguguccccagauauuucuaccauucuaccccuccuccuaguuucagccagccuguucagcugaccuaucacaaaagcucugugcucugccuaaaggaaacuuuuuauuugguccuguuucuccuuguucuguuugcuuugcuugaaucaccaucuauuuuuaaggugauauccaucucauccucuuucugaaaagugcaucaugucaggagccuucuuccaaucuccacuaaccauuuuaagugcauuucauucucuuuuuuccaaagaugucagauguccuucuuguauacuuuccacugacuucuuauuucugaaccagaaggcaucgcgagugcuaaacucacucacagaacagaaauuuguuuauuuauuuaacaaaauguaguaggugccuauuaugagccagccaggcacugugcuacagcagugaaccaaaaggacaagguuccugaccucaugaagcucaauuuucuauuggaggagauaaaaauauaaacaugaauaaagaaauaaaacaagauagucauaguagcuagaagcaggugugugugagugugugugugugcacgcgcaugugugcguguguuccauuuuguuagaugcacagaaaaaacucuucccugaaguggggaaaauaaagagccaaccacacaaagaccuaaaggaagagaauucaaggaagaggaucuagcuaggacaaaaggccuuucaccuguucaaagaauggaaagaucagagaggugcaagcacggaaagggaagagauggagaggccauacaaugugagggcccuaaaggccauggucaagggaaucagagaaaacuuaacgcuuuuaauucuaauagcaacaggaagccacugaaguguuucauguaggcuagagaucggguuugaggauaacuguaagauaacugcagcugccacagagacgcugacguuuagaagaugaagaggggaagcaugcagcccaguuaggaggccccugaugaccugaaucagugaggcagcaguagagauggaauaaagcacgugacucuaggacguugguggaagaguaaaaggccuuaccaggcaguugagggcaauaaaaagugagaccccaaggaugccgccuaacuuuuugucuugaguaacuggguggauagugccaucuacugaaauggaagaaaucugaggaaagaagauggaaggagaaaggaagggaaugaagaauuuccuuuuagacauguuaaauucaagauguuucuugaacauccaagugugauaccaucuggagauacgaaucugagcacugaugcaugaagacagcacuuaaaaacacaggaucaauuuucuuagggaggguuuaaguauggaugaacauucaggaucaagcucaggggcaugccaaaauuuagaaaucuggcagagaaggaugaaaauguaaaggacgccuagaaaaaggacugguuauuuggguucaaggaagcuaaaagaagaacauucucaacauauuuuaaaaaggaaguggccaaccauaucaaauacugcugaaaggcuaagauggauauuuggaagagaucacagguuuuggcaacaugaacgugaugcugacaaagaaccaaauaaaugaguaaucuuucagagcccagguguuuagcugaccugcaaaagaaauauuauggaagguagaaaggugaaaagaaaaaagaaggggaugcaaagaaaauucuaccacagauucagaacuuuaauaguucuuaaucuaagauaaacuacagugagacauauauguugcaaaaguaugaaaaacaauauaguuuuuuuaaguaugaaauacuaucuggcacacauacuaaauuuaucuaaacaaagaccucagaauuuaguagcacaggauaaccuauuuauugcuccugauugaggaggcauaguagauuuuuaaaaagacuuauauuuaauuacuuaacaaagaauagccaagcaaagucuacaaauacacugcuccuauauacugcugcuaggaucacuuaucucuccucccucucucauggcaaaggcuccaaacaccaaucuccuguuuguuaaauagugcaaaucacccuuugucauuuuaguugcacugaauuugaauuugcauagguugcaaguagagaauagaaucuugaagccacauaaacuaaucacacuuagucuuaaaacagaauauaucggauaucuagccaaacaaaacugcucaaguacccaauacauauucuaaacacuuccaccuccaugcuucugcuaccuggcuuucuacuucucgaaaguuacuuuuccacuuguccuuaagucgaaauccuaucuuuucuucaagguugaacugacuaaugccuuugaauucuuucuugcuagauaucacuucuaagaacuucaugauauuguaccucugucucuggcuuuuauacuuuuuaccuuuuauuauaugacauuguugucuauucuuuugucugccuaacacccuguauuaucugggaacaacaaccccuuucccuguacuggcaucaacaagauaagguuuccauggagcugccauaauuuuucuauaacgcugccccuaggccagaauugguuggucuacagguagauaccugauccaaacuaugacaaccacaauauuccagcccuugacaaugauugacucuuccaggacgggcacuuaacucaagcuaggccaaucauagucauuucucaacuagauccugccccacuggucauagcuaauuggugcaggacuggaacuggaugcaagcugacucucuggauugagaacuagaggucagaccauucccugucccaugucugaaacugaaauaugcagcacuggaaaacugcucaugcucauggccaugggaucagccuuccccuuagccucagaaggccuuggaguggaagcaacagguaucugguagggguaaaugccaccucuuuagucucaugauugaaaccaccuucaaagcacuauucaauguugucuuuggagacaagugaagugacuugugauauuuggggggagcccccaccacaaaaauaauuucucucucugcuaggugauuucuuccauuuuauuauuauuuucuuuuuauggugauguugaauugaggagagauguuccugcuacauuuauuaaaaguuaaaagaaaaucccagcaccuugggaggccaagacauguggaucacuugaggaaggccaggaguucgagaccagccuggccaacauagugaaaccguuucuguacuaaaaauacaaaaaaaauuaggcuggcaugguggcgcaugccuguaguuccuaguuccagcuacucaggagucugaggcacaaaaauccuuugaaccagaggaacagguuucagugagccaagaaugugccacacugcacucaagccugggagacagagcaagacucuaucucaaaaaaaaaaaaaaaaaaaaaaaaaaaaaguuaaaagaaagcagcauuuguuggcugggcaugguggcucacgccuuuaaucccagcauuuugggaggcugaggcgggcggauuaccugaggucaggaguucgacacaagccuggccaacauggugaaaccccgucuuuacuaaaauuacaaaaaaaaaaaaaaauuagccaggcaugguggcacacaccuguaaucccagcuacucaggaagcugaagaaggagaaucccuugaacccaggaggcggagguugcagugagccaagauggugccauugcaccccagcaaugggcaacaagagugaaacucugucucaggaaaaaaaaaaaaaaaagaaagcaacauuugcaagaggugauauucaucucucugucucucuuuuucugugaaagguuacuagauuuccuccuuuuggggagaaguagaaaaaauaauuuugagagcaggagagaucuccccucuuaaggaggggcuacuacuuaaggggguaaaaaaaucaggggcugagaacacagaauguaugaugaguuuugaagacaauguauuuuacucuaagccuacuucacuuucaaccaaguggaaagaauauauaggguauuuuuuugugcauauacaaaugauuuuguuuugcaugauuugugauguuuuuggcuggcuuuuaaacaggauuggaguaauauaaaagcacauuaaagcagacauauuaggcaaaggaucaugguaauagucucauggccauuugggggaauuucaggaauuaaaaacagagaaugcuguaaauaacguuauuaagagggcagucuuccugaaccuaaaggaugggaauaauauaucaauuuuggguagucucuauauacacaaguauauccuacuuaaauucuuuccauaauggggcauccucuucauaauccgucuuaugaucaaauaccaaauuuacuuugaugugacaaaaaaaagguauugugaauaaugaacuucaaaagaaagagcagugagaugguuagggguaaucauaggguggagaagaauauaauaaaauuucacauuaauauaauauuauuauaccaaacauauaauaguaggaagauuuucuugcaauaaaacaguaguucaaauaauguucuuccaucuaaaaaaauacuucuuaaggugguugcuuucuuuaaauuaaaauauagagaaauauuaugugacuauaauaacaucagaacuuacucuuuaaaauguaccuaaaguucuuuauaaaauauacuacugugacucaacaguguaauacugucuuagucugcuugugcugcuauaacagaaugccacagauuggguaauuuauaauaaaaaauauauugacucacagcuuuagagacugggaaguccaauauuaaggaaccagcagguuugaugauucugauuucaagauggcaccuugaauacugcauccucuagaggagaauacuuuuuccacacagagcaggaggcagaagggcaaagaggaaaaaggggacugaagucacccuuuuauaaggcauuaaucccagccaugaggguggaauccucauggccuaaugaccucuuaaacaucugaccugguaauacuguuacaauggcacuuaaauuucaacaugaauuuuggaggggauucaaaaagucacaaauacuacuugaaaaaauauaacgguuuaaccaguaaugcccaucugggcaaaaaagcuauuuaaguaccaugcacuuugaugaaugacguuuaaaauagccuuccucauuuuauacuauuacuuuucagucagugcaggauaacacauuaaaucuaaaaacaauggcccagugaaaccaagcuaguagauuuaaagaauccauuaauuuaaugguaauuaucauuuccuauucagcacauauauuuucuuuguuugaaagacuaugcuuuguuuuuguguuuguguuuuuuuugugacagaagaaugcaauacaguguuuuaaaagacucuguaccaaauauuuugugaaguagaauuucuccuugacuagagucuacauaauuccauaaugacuuguagaaaugacauaauuuauaaucucauuagguuuuugugaaaugaaacaauuuauaugaacaacccaaauauaaucauggcuaauuugagaggaauguuucauuugccugcagcuucccagcaaauacuaggcagacagaguuuaaagcuucaguggggaauaggcagaagcauuucacaaaaaggaagauuuaagcagcuuugaaaaugguuuggucgaagcucuucaacuguaaauaaaaucacuggaggucuaaguaaaacuucagccuaauguaguugucagucuaaguagguccuaguuaaugacuauuauuuuuaugaaaaucaggcuuaguaaucaaaaaaguucaauauuccacaacuugaugaagccuuauaguuuccccuuucuuuccacugaguacguccuaauuuaaauugacaauaucaauauacuuauuuuaauacaguaacuucauuuaaaggggagaugaauguaacuugaaaguagugugaacauucuauaucauuucuucaaaaaaacggauacauuucuuuaugaaaauauuuuuaauuaaaacauuuauuuacaacuucccacaauguguugauguauugaaaauauuuuaauuuugaaaaauauauauuuguguacguuuuaaauaauaaugacaaagaaauuuuuaaaacaugcuuuucuaucagaugguuuaccaaaauauucgcccuucuauguuuccuucuuuuagccucuacauucugggaauugucuauaccuuuugaaacaugcgagaacuuuaccaaaaaagaguagaaaaggcuggugaaaugagugggggguuaguugacauggaugcuaaguguaacagaauggaacuuugacacuuugauggaauauuugccuauaagcuuaaggagucaugaacaagacuggauugccacucccaaugucagggacaaaaaucuaaucauuaccaggcagcacaauucucaucagguagccaagacugcugcucgugcuuaauuuuaagguuugacccaccagagauaagcaugaaguuaguucaguauuccagcuggugaauuucucugacagauguggugaguuaauacgagggagcagaaucuaacagacaucaaaccaauuauugguuccuaaggacucuuaugagucaaucuacuucauauuuuuauuacuaccaccuuugccuaaugccuaaucaucucccauuugaaccaauaguauuaucaaauaauugcauuuucuaccuauaucccauuuccaaucuaaucuuucauucauaauuuucccaaaccagucuugccaggauaccucucauaacuuauuacucuccuguuccaaaauguaaacggcuuuuuagucccuucuagauaauguucaaauuucugacuuuccuauuaacagccagacauaaucaguccuaaacuaaucuuucuaaaguuaucuauuacuaauucacuagggucagagguuggcaagcuuuuuaaauaaagagcagauaauaaauauuuuaggauuugugggauauaagucucucuugcaaguacuuaacucagccguuacagagggaaagcagccauagucaauaugaaagccagaguguggcuguguuccaacauaacuucuuuuauacagaaauaggaaugggccagauuugguucaagggccauauuucacugaacccuguucuagaugaaccuuugcugugcagaaauuggccauuagcugugucaugaaacagcuguuaaacucuguucccaguucugggcuacagggauacaaggaugaguuagcucccauaguugccuuggcaaaguucacagucuuuucacacacagaaucacugugcaauuauacugcaaaugcugugugggguaacuggcuuagucagaagcaaaacuucauguuagaguaggucugggaguagucauuguccagauuaaggugggcaggcacaagauaaugaaagggagaaaaaaaugacagccugugccaaaauacaaaaaugcaaaaccaaauggugaauuuauggaaugaucaaggcauaggcagguaagacggaucuggaaaauuuggcgggagacaggaucaaaaggguuugacugcccugcuaaugacuuuacacuagcuauuuugagccagacugcgcuuaggccucggcaagaggcacuacuuuuuuggugccuguguuuuugagaaaccugcacaucacaaguuuuacaaaaauuaaguuuauuaaagaacacaugggucccuaugccaaucaagaucuggcauucagcacuagcaaagugugacauucuaacucugauuauucaccagguauuuacucauaaaaaacuaacaccauuaaggacccagacauauguuuuuccauauauuuuauacucuaaaaauaaaaaacaaaaaacaaaaagcacaauggauugauuccaaaugccaugaaacuucaccaguugaucacaggcaggauuucagccaucuaagcacuuagcuuagaagugccuagaagaaggaaauuaaaugaccugacaagcuuucucagcuuggaggccacagauucuuguacacucaguaucauuugccaguagcugagugccccuguccuguucuuucugcucuucauguuucaacuugugauucuagaauucuagagauacucaggaaaacacaauauucaccacaguugugcauggugacagaggaaacauuugugacuacuuaaauuuacauguauguaguugaggguaugaaaugcauggagcaugauacucuuuacauugacaagcacguagaaauugaacccucaaaccuaugaauagauuuccuuucauaaaaauauguaauaaaauguaauuaauucuuuaaauacuuacaaauucaguucuauuuaaauaauuuugauguaauuuuauguuaauauuuauauuuugacuuuugguuugaaaagauacauuuugauauuuuacaaaaaaucuuuuggaaagacuugaaaaaauuuacuuuuaaauuuuuacacuuauuuucaucuacauuuucauuaacauauauuuaaauuaucuauacuaaauacaguuaaauauuauuuuaauccuucauaucauucacuguugucaauagaaugcauaucaugugaaaaucuugauuauaacaacauagugauugcugaaauggaggccagaaaaaaaauguaaaaauguauuuuaaaaaacugaaaaauaacagcuuggaauuuucauuuagaauauauauguaauuuaacgcuuauguauauuuuaauuuuauuacucuuccaaacaucacagaccuuucaacagaauacucaaguguguaauaauaauuaaauucagucaucuuugcugguuuuagccauauggagguauauuuaucaaguuaggaaaaguaacauauuucauuuaacaguuugcuaacuuaauuuauaguuaaauguuaaauauuuagacauguaguauuuagaccuccaugccuuaggccucacauauauuaggggacgaucuaauauuuauaaguaaugugaagucacugaugucaacuuuuaauauuuucacuuaugcaguuaugagaaacagucuguuauagcaggcgcgguggcucauaguauaaucccagcaccuugagaggcugagguggauggaucaauugaggccaggaguuucagaccagccuggucaacauggugaaacccugucucuacuaaaaaugcaaaaauuagccugcuguggugugcaccuguaaucccagcuacuugggaggcugagguaggagaaucacuugaacccaggaggcggagguugcagugagcugagauugugccacuguacuccagccuggguggaagagcgagaaucuaucucaaaaaaaaaaaaggaaguauuauuuuauauuuuauacauaaaaagauaaagcauaauguaaugaacaucuguaugcucccacucugcuucagauauaaguacuguaacuuggugucuuuguauacucacucuuccccaauaacauucauucucaucuuuuccagagguaaccaauccugaauuuuuuacugcuauuuuaaauggccaauucuuuaaaaguauguuuucuauuucuugauaucuagucauguuucaccauguauauaauagcuauuauacuacuaaguuugcauaauugucuuaauaguucugcagauuccucuugggacuucuaagaaggcaauaucauacuuacaaaaaauaacaguuuggaaucuucauuucccauuccuacaucuuuuauuucucuuucuugacuuaaucugcacugguaaugaccuuuagcauaaugucaaauacaagugguaagagagggcuuucuugccuuguuucuuuauugaauauacuagguacuguagguugauaauauuguuguuaggaagcaaaauaaugugaucaggauucuuuucagaaaaaucauuagugacagaaauaucuguuggagcagaauucuuuaggagucauauuacaaaaauaacuucuauuuaaugggaaagucauggggccugugaugaccuaucaauagaauacacauuauggcucugauucugauggcuauaguaaaaaacugcauuuuugcuuacuugauucaccaaguuagacaaaucuuaauauaccaaaaacucacaugagucuuacuaugaauaaugucuaaaaguguaguuaucaugauucacuacaggguccauuuauggcuccuuuaugcaaaaaagaucacccacguuacucaaaaucaaacugaucuuuuucaaauacaaccaauaagauacugacacagagcaaagucuuuuuaaagauuacccaacaaguuuucagaaaauuaaaaauuuccaaaaaaagcugucuuccagcucagucaaaagaacguuauuuacguaguuugguguuugcaaaguuauuuacauagcuugcuauuuauuaaaagaaguggagaguaaauaauuacccaucaaauauuuuauaaguauauauccauguaaaugaggcaauuuaaucucaaacuuugaaucucaauauauucaauaguagacuuuuuuugucuuaugggcgccucauauuuuccauuuuauuuuucuauguacacucaguuauguaggcaccaauuacaucuuacaaguaaaauaaaggcuucaaccucacuuuaaaaaaaauucuaagcacuuaugaaauugcuaaauuaauaaccccugcauauguuucacuaaaucuuggcuccugaccuauuaucaguaaauauauauuucuaauaaaaugaauguguuuaauucuguaauuaaacggcccaaaggaacaguaucugugauagcaaugaagucuaaugacaauucugcugacauucuucuaucuaaaaaugaaaucauguggaaaaugauuucuacacuagcagaauaauuaagacauaagacaaaauuugauuugguaggaauggaagcuaagacugccucuucucuuggggagaugggugacauuauuuauuucaccaccauauuauguuuccaagcucucuuuuuaaaaucauauauauuuuuuucaugucuuaauuacagcaacaaauccaacaaacaaugaagcuaaucuugagggacuuucuguuucauuuuacugcauggacauuucuugguguugaacacagcuucugagaaugggcucucuuuugagacuuaguuaucuuugguuacacaaauauuuucauuauaaugguaucuccuuuaaguggcuuugaucuuuuuaugagauguaugccuuugucuauaccagucaaaugaaaauuauaucuagguaaagcaugugagguugccagguuccagcacuguuuaugggaaccaugagaaacauuugaugaaaaaccacaagguaaggcuuuaugacuuauuaacaaaaaccauaaaacuauuguuaccaauauuuuucuauaaaauacagauuauuuuaguuccuaucaaaauuuucuaaagaauaagcauguacuacaagcaacaagaaaauauaaccaauuaaagucuaagcaccauuuuuucaaagaaagugugaagagaauacuucauuuggauccugucaacacugucuaaugaccuuuuuuaaaauuugaaauggcugauuuuaaauaaaagcuauucuagcugcucuagagaaguuacacaaggaaaaugcuacaauucgacaauaaaaaaugcaaugaaaauucauucucguguaucacaagauuauucuguauuguacaggcagaauauuuucaaugcagcugaaacccauuaaccacucuaggcauaaaucacuucauucacaaaacauacagcaucuagagugcuuuauguaaugcaggauuuuuaccaaauaguuauuuucacugauuucagaacacucuguucuaccaaauccuccugggagauuucauggguuuucauacacaaaugcucuacuucucgaagaggcucucucauacccccaucuagaguauuugcuacaauguguugugaaggacugauugucucccucccuuccauccuuccuugagaguggggauuagacccuaguacugguagcaucuauugacccucuuaccugccccuucuaggcaucagguuauguuuuaaugcuuagugauaguggcaaaagaauucagaaggcucacagguucagugcacucauuauuaucuaugaccugaaucucuguccuuaaaaucucugacuacuuuaaacauuucccaaaacucagucccaauuccucucuuugucaagugccuuccuuccuuccuuccuuccuuccuuccuuccuuccuuccuuccuuccuucccuccuuccucucucccucucucucucucucucucccucucucucucucuuucuuucuugacagaguuucucuguuguuucccaggcuccggugcaauggugcaaucucagcucacugcaaccuccaccucccagguucaagugauucuccugccucagccucccgaguagcugagauuacaggcaugugccaccacacccagcugauuuuuguguuuuuaguagagacaggauuucaccauguuggucaggcuggucucgaacuccugaccucaggugauccacccgccucggcuucccaaagugcugggauuacagccaugagccaccaugcccagcugucaagugcucuuaauauaaaaagucccauucuuucauccuuccugcaacuccaagaaucuacuguuuuuuuuuguuuuuucuuuuucuuuuguuuuuuuuuuaaccaaagaagcauuauauaggggaaaaaaucaaaacagguaugacuagauacuaaauugcuuaaaauguccauuucccacauauauuauagaaucuaguaaucucugccugguuacauguaacucuuauuucuccugacgcaucccacccaucagguuccacaagccaauauccaggugggcaaaucacaggugcucaaaaaugugucuugaaggcauaaaugaaaagcuucgcaugauuuaaaaacauaaaguuuacuuuuucuccuuuacuuuucacugguuuuuaaaaagugaacauuuuuuugcgcuuuauaaacuucaaaaagaauucuauggaauuuuaauauucauguuucauacuuuucuaaagacauaaacuuuacuuuucuacuuuacuuuucacugguuuuuaaaacgugaaaaauuuuuuguacuucauaaacuucaaaaggaauuccauggaauuuuaauaauucauuuuccacaguugucuguuuaucaucacuuucagaccaccaguucauuucauuaauaaauaauaguucuaaugcucauuuauugcuaaaacuaucaucuccuauuaggcauauuuccuucacaaaacacucuagggggcuaauguuuuaucuaauaagguaucaaugaaaaaagugauugaauuagcucuuuuccaaaugacuuggaacuaaaaagaacucauauucaguauaacuugaaguuuccauucuuagaaagaggcacucuaucauaaauaguuucugccucugaauuauucaguuauguuucauauucccugcauacaaauuguucacaaggucacacuaugaucacaaaccuaaaaaucaaaauacauuuauacaucuuagaaagguuauguuugccuugaaauguauaagccaaaaguucuucuucuaauguccuuuggucaaaguagcuaaaauaaauuauauauuuuagguguuaaauaaauaaauaauuuacuuuagauuuauuuuuagauacuagaauuucacaauucacuaugcaggaaacagugaaaguaucucaguugcucucaauuuaaagcuagauaaaaaugauagaaaaacuucaaaguggaaaguguacaagcuaacuggaggccauagaaagaaucacauuuguguuuucaguaaauggaacauauuaucuaggagaacaguucaaauauaauuacuaaaauuaauauuuauaauaaaugaaagaauugcugcaggcauuuuuaauugaagagucaauugaagagucugucagugugaaguaguuaaaaaucacuauuagaaaugucacaguuauauauacauacaaauacaaauacaaaauuuacuuuuuaugugcuuccaucuuaaagcaagcagaaaauuugucacuaucugcaauaaucaguuauuuugugugcuggugaagaacaucauggcuacaauagaaaauguauuuaucuacacagaaguagguguuguaaaggaaaagacacuaauuucuuucacagagaaagaaauuacugagagaaaugcuuagaaaauauucuaagcaacuauaaagcaacacauuagaaucaccaugucuuuaugauauaauccaguaaaauccaguaguaauaugcacugaacaacacuaccagacaauuaucacaauuuuaaaauaaacuuaugaaagauauuuaucacacuagaaaugcaaacuaaagucguaaauuggcaaauccauaucaugggacgauaggacauuuuccaucauugugcaaugaucauauacucaagaggguuagcauaaagauauuucacagagacaucacacgcaauggaaacauuucauacccaaucauaucugugaugagagagacauaaaauggcuuuuagguaaucuuuuucacuugcgaguugcuacaaacuuugucacaagagacacuucuauacuguaagugaccuaaaacauuuccaaucuguuuauuucaccuuuaguauaccuuacaaaaauuagauuauauuuuuguaauaauuacuauucaaaagcaagagaaggccuuaguaguauuuauuaucaucauugcaacuagaaaaaaaagaaguaggaguaguuuccuaaagucaucuuccacacaauuauauaugcuuauccaacucuagcucuauuacuguacugucagccaaagaugagucaaaguggcugcuccauuagugacagcaggagugugcccucauacuaugugaaagaaauuauuuuauuagagaccaccgacauuaaauuuuagaaaaaaacuauauggauaaaauuuuuucacaaacauaucuaaagguauucaauauuaacuuauacaaguugaauaucccuuauccaaaauacuugaaaccagaaguauuucaaauuuuggauuuuuuuuuuauuucggaguauuugcacuauacuuacuggaugagcauaucuaaucccaaaauuugaaauccaaaauacuccaaugaacauuuccuuugagcaucauauuggugcucagcaaucuaagaauuuuggagcauuucagauuucagacuuuuggauugggaugcucaacuuauauauacguuaaaaaguauagauaugucugccuuuaggaaaauguaaugagugaagauccaagcuuuuaaacacacuagauaaugagaagcagguguagugccaguuaacucaaagauucuucacuuuauauuauaagcuauugcagggauucauaaauacagacuuucuguauacauucaacaugaaaaaacccacaaaauaccaguuuagucucaauucuauggaguacaagcauggaaugaggaacgucugcauuucuacuauacacucaaugcuucuaacauucuacuuauaacgggugacagauuuaugccacuccaaaauaugccacuuugacguaaggauuacuuuaagcuaaaggcacuugacaaacagcagauguaagaagggcauucuaaucuuucccuuuucuuccugaaagcaggagauacaauuuuucaugugaaagaugccuugccuguaccaggaggaaaaaaaaacauuauuccaugggaagucauggcagggggcgcagaggggcuucuguacaaacacaccuuguuaaaauguguuaaaauaauuaucuuccuuuagccucaccacauaauuuagucacauuuccacaauuaggucucuuuguucaaucuaacauaaaaguauguacguuuuuccaccuauugggucuucauuucuuuaugagggcuccugcgccaccuaaaacuuauuuuaaauuuguuugcuuuucuccuaugacucugucuuaugucaaauuaauucucaggcccagcugggacccuaagaggguagagguaaaguuugcuuccuguacauuuaccaauaugauuucuauuacacuugcauuuuaaacuaaugauuuagaaaacugaugccuauaggucuuguacacauugucugcuaaacaucaacugaaaauauaagcuacaaaguauucccgugggagaaaaaaaaaaucuuccaauuuggaauaagguaguuggccaaaagcauuuuuugguacuuuguugaagugucugaguuuuuuuucuaagaaacacacgugcacacacauaccuacauacacacucugauaguguaccuuaucuaugauacuuaaaaggaaauuuucaaacauaaacuauuccaguauaaauuucaugaucagucuuggcugaguuaccugaauaaccuaucugacauaguuuuguucucaccuuugaaauccaauuacaucaacaagaagauaaaagaugacuuaccggcccaaaagaauuacugucaaaacuguguccaugaugaucaccuucaacccagaugugaccacgggggacuuugacauaccgguuuuuguguccuaugguucuggaaauaaacaguguaaccacugagauaugaguagaaaagagaucaaacugcugggcauacaaacuuaggaauggugaaaauauuauauagauguuacagacagguuaaccaugaagcuucuccauaauuucauuuuuaaggaagaugugguuagagcaauuugaaucuauucauagcauuuuuucuuuuuauauuucuauagguaagaauuuugugcuuagaugaaauguauuggcacuaaauauaauguguuguuauuuaauagaauucacaguauucuaaauauguauuuaugaaauccgguaagcccuaacaaaauauagaucuauuuguuuuuuuaacauuugcuuuuaagucaauauucaacuuuuucaacugauucaugcacaacuacagucuucauuuuuuucggucaaacuucucaaaccaauagacaacacuuuucauaaccucuuaauacucuaaauuuuagcauaaguaagaaauaaaggaaagaacauaaucugaauaacuucuuguuagauacaaacuaucaguaucaguugaaaauuuuuaaccagcacuaaaguauuccuaaaaaugaaauuuuuuuaacaauugugaagacuaaagaucgaugauacacacguugcaaaacauucuauauuaauguuggcaaggaaauggacuaagaaaaggcuaucucacgcaguuuuuguagcaauguauaaugguauaauguuuuucccuauacuuccauuuuaggccaauuuuugguacaguuuuaagauacuaaaauguuuaugccucuugacuuaguuauucuacuuguagaaauccauuugaaaaauaaaaucggaaauauagacaaauuuauucauuacaagggguguucaaacaaggcuuuuuauagcaaaaaaaaaaaaaauaauuuaccuaaauauucaacaacacagaauugguucaauaaauuaugauacaaccaacuaaacgaaagagacaggcuuacaauaaaauauuauccuaaucccacaauaagaaguuauuuuggggcagagacugcuuuuuuuuuuuucucucuuuuauccccuaaaaagcucaggaaaacgccuggccuaaagaagcuucucaguaaguguuggcugaaugaaggaaugaauaaauaucaccuccaaggcugcagaguucagaaauugagcuuggcauacauacuguucuuugagguggugucccuuugagacuauuuuuauuaguuagcaauuuguaugugugcagaauaauguauuuuaaaaaacuaaacauaaauuggugcuacagaaacugaaacuauucauuaucuaggaugguuuuuaauuuucaagauaauuucaguguugaauuacuuuacuuuagaucaguaaaucauucaugcaacgaagcaauauuguggcuguuagaaaagcccacaguaaguuaaugacugcuguuuauuuuuaauuacuauugcgaagaaaguuuucagcuuuuuaaagaaaagugaaaaacaaguugaacacaucuuaccaucauauacucuguaauauaaguguucuucaauuaaaaucagucaauuaguuccugacaucacuacagcuuuuauuauuagauugccucuaagaacuaauauucuacaugaaauguuaaugacaaagagaauauccuuuuacuuaauuguuggcaaggcauacucuccaaaucaguccaaacguuuguucaccuuauuaagcuggguauucuggauaaaugcucagaaagaaaacaauuaccaauuuugucucuucaaauaaccauucaagaauuacaaaggaaaaccagcauaaaaucauuucugcagugacacggugaguuuuaaaucaagcauauuccagaaaccagaagagugauaugaaaccaagauugaguuuuaaugucauauaagccaagauacuugugauagaaagcaacagcaucauaaaagaccagugacaguuacacguuuccuugcacugaccgucuuaucugaaaaauuuaaauauagccuuuauccuguuauuuucuagcugcuuacagugcuuuauuuuucuuuucugagccugcuaacacuugauauacauuuauggguuuguuuguuuauuuuuuaugucccuccacuagaaugcagucuuuggaacuuugccuuauuuguucauaagaguauccccagagcccagaacagacuacacagagugcucaguaaacauuuguuaaaugaaugaccaaaugaaugaauaucugaagaauaaaaaauacugccauaaaggcagaauaauagagugggaaguacauagguucuggaaacagacuaaaccaguuuuaauuuugauacgauuacucacaaguaaucuuuugcaaguuacuuagaguuucuaccucuauuugcccaucuuuaaagugggacaagacauacccuaacucagcaguccccagccuuuuaggcaguagggacugauuuaauggaagacaauuuuuucauggaccaggguggaugggggaagguuuuggcaugauucaagcacauuacauuuauugugcgcuuuauuucuauuauuauuacauuguaauauauaaugaaucaauuauacaacucacuauaauguggaaucagugggaguccugagcuuguuuuccuguaacuagaugguucccucugggggugaugggagauagugacagaucaucagguauaagagugucauaaggagcaugcaaccuagaucccucacaugcgcauuucacaacaggguucaugcuccugugacacuuuaaugacaccacugauuuggcacgaggcggggcucaggcaguaaugagagcaaugggcaguggcuguuaauacagaugaagcuucccuugcugcucaccuccugcugugccgcccaguuccuaacaggccacagaccaguaccaguccguggccuggggguuagggacuccugccccaacugggcugaaacgaagguuaguaguuggaugaaaauauaauggaaagauuguuauacaacauagucucuggagccagccuaucuuggcuuuuguaucuuacuuaacauuuucaagcuuacaugaucugcacaaguugaugaaacucugugucaguuuccucaguuacacagcugggcaaguaacaauaccuaacucaaaaaguuauucuauagauaaaaguggcauauauuaaacacuugauaaguggauucucuuguaguugagacuguuuuuaauuuaaguaaagcgcugaguauaguucugauguauagucagaacccaauaaaugguaguuauuauugcuauugucuuccuuuguccauuauuuucuuucauuuuauaagucagaauguguucagccucugcuaucuauuagcaucaguuuuuuaaaauuaccugaacuacgcuucaguaauuuccucucccuacgguugcacugugacuauagacuauuuuuaaugguacaaucaaucuuuuuuuucuuuugcuccuacguccuucugggacacucuaaaacuuacauguaaaaacacuaucuguguucugcauauucaaauaugcagagaguaguaagugaaaguauacucuauuuguguuuuuaccuacuagucucuuguauauuugaauauugcuaugcuaauacagagugguuuccuagauaccagacagauuugaaagaacucuucgagcuauagaagaacccugguaaaauucacgcuauauccuagugcauauucuguuucuuggguuucaaucuaacuuuuuaaagaauaauccaaaguagcuuuaaaaaauaugauguuaaaauauugggcuggucccuuuuaggacugccaaagaaauauaauacuccuaauagaauuucucuagagaaagaauuuuaaauagcuuugugcuccugaauucacauaaaagaaagacaagauaaucuuuuaggugauuuaacaguuaagugaggugucagccuacaagguuguauguaucuaugacuugcaaauaauuuugguuuugacagucaaaaaugagcucuguaugguacucuaacuaccugucuaaaagaaaaggcauuuuuaguacuaccuuuaccaagacaaguuaccuaggucuuauaaauggaauaaagaaucauuaccuccaguuugauuugaccuugaaaacaauguuuuuaagucucugaaucuuuugagugucaucgggugaauacaaaaguauugucuagguaauucuuguuuccacaagaaaggaagaauuucuucuuaaaaguauuucccaaauacauauacacacacacacucuuaaguaggucauuuauauuaauaauucaugauugauuuaagguauucuuauuucuuuauuuuucaaauuauucucuuagcuuuucucauuuuccaaaauaguggcugcccugaggauguuuacugcucccuggauacuagauccaugguuuucauugucuugaaggaccagaagucaggggcucuggacccagaaauaucagcaguuagaacuaggucucuuuaucauuguuaacagauagaaccagaaaaaaaaaaaaaaaauccaccaucaggaaagaaaacuaaaaggaacacuugccuaugcaguguuggccucugaaagagaaaaaaacucucucuugagaauccaccuuccgcucucaagugaaacuaagguucgaauucacacuacuuggguagucugacaaaguuaagaaucaacuuuaauuggccccaggcaucuggcagagaauaaucccucaaaugugguuuucagguuuucuauagauaaaucccagcugacaagaacccacaauccaaaauuacaaaucucauuuggaaauacccaccuuagugagucaggacaaacaauaaguagcaaaauuagacucccacaaacuucaaauacuggauuuaugaauauacaugcuauauuuaaauauuuuaaaaaguauaaagggaauuaaauacaugaguaaggaagaauauaauauuuuaaagauagacacuugaaaaagaaccaaauagaaauucuaaaaauuaaaauauauaacuaaauaaguggguuaaaaagcaaauuaccaugaguuaaagaaagaaguaaugaacuggaguagaauucaauacagagagcuaaagaaauggaaaauauuagagacauuagaaagauaugggaagcauuguaagaaaauguaacaucuguguaaucaaaguuccaaagaaagagaauaaaaagaaacaaggaauagauaauauuugaagagauagugguagaggauuuuccagaauugaugaaugaauaaaugugcugggccucagaaauugauaucccaaaauacggcacuuugaugugcuaaacugaagaagccucgaggucucucugaccuccuuccaccuccuguuucucaacccauugucucuccuaaauaaagcucaugaugaagcuguucccugacguucccuuaucucccugaaguccagacuggcucagaagaaaaugguuaccucugguccguucccugaguuuucauuaacugaacucauaucgcaggaaaaaagucugaagucucaacauaccugaacagacuggucacaaaccaucgucugcuuuguggguccaacuugucucaggccauuguauguucaaccccauugaauucccauaaaaaccaucuauuaccacccuaaaauuauccacacuuccccaucucccuucccccuaaaaagaaggguauaaaauggucuguacuccgcugcaugguguacuugcucugugacccaacccuccacggcacuuuguaugccuucgcuccuauuaaucugccuuuugucagucacuuuucagucaauuuucagagggcuaaagggaaguuuuccuuugaccacuacaaaugcagguucuggaaucagugcaaauaacaagcaaaaaucaaacuaucauacguuguaaugaaauuguagaacacugaagucucacuacucccaaccucaaauucugaaaagcuuccagagaaaaaacauggacuaccuuaaaaaaauaauaauaaaauuaaauugacaauagaguucccuuauugggguauaauuuacaugaaauagaauucggcaaucuuaacuauacaacucaaugaauuuaaaaaucaacagucacauaaucacuauuuacaucaagauaugaaacacuugaguuacccaaaaacguuucuucaugucucucugugagaaaucuaccccacccucauccuuggcuucaggcaaucacuguuaugcugcuuucugucacuacaguuuugccuuuucuagaauuuuacauacaggcauacguucaauauauugucgguucaauugcagaccaccucaaucaauaaauaaagcaauauugcaacaaagaaagucacacaacuuuuuugguuuccuagugcuuacaaaaauuauguuuacauuauacuguaguuuauuaagugugcaauaacauuauaucuaaaaauacauaccuuaauuuaaaaauauuuuauugcuaaaaaaugcugacagacacacaaaaccaacauauucuuuugggaaaauggugccaauugacuuccuggaugcaagguugccacaaaccuuacauuuauaaaaaauuuaauaucuacaaaguacaauuaagggaagcacaauaaaacaagguaugacuguaaaugggaacacacaauacguauucuuuuauuucuggcuucuuacuuuagucuaacgcuuuugagaucaguucacauuguucaaaccaaaguaguuuguuacuuuuuuaaaaaaauaguauacuacuauaugaauguaccagaauuugucaaacaauaguucaugaacacuuuagauguuucuaauuuuugacuuuuuacacaaauaauuucauauuuuauuuaagauucaggggguacaugugcagguuuuuuacauggguauauuacaugaugcugagguuugagaugugaaugaauccauuauccagauagugagcacaguaccccaaauucuugaauaugaacacuaaagcagcuaugaacauuucaguauaaguaugacacauuuucauuucucuucuauaaaugaaaugguuggcucacaugguacgugaauguuuaaacuguaaaacuguggccaaauacccuauuuuuaaaaggaaaaaaugauuuuuuuucuuuuucuuuucccccaccuccuacucgguucuuaaugaaggcaaauguagccuuuaccuucucuccaccaggcauggcaaacuuaucuaugaguuuacuuagaagucccagagacccuaccuugaagcaaaccaggugccuccagaacucucuuccaccaggagguagccccaauuuacaaccugacucuacccaccuuggugccaaccagaccaccugacagguaagacauccgaagaccccguaccuccucacccccuccccuacaugucauucaugccaaacccccuuuaaaagccccugccuucuuguccugaagacugaagugguacccucaaggcaggagccuauaauaccuccccucagcuaccucaggaguaaaguuacuuucuaucagaucucacuauuguuaauuagauacugcaaggggugagggaugggaccuguguuugguuacagaacuguuuuccaaagcagugggacuaccaauguuuaagaguuucuguuguuccacaucucaccagcacuugauauuaucauucuuuccauuuuagccauuuuaggggcauauaaugguuuuaauuugcauuuuccuaaugacuaaugauuugagcaucuuuucauguuaucugucauuugcacaucuucuuuggugaauuaucuauucaacuuuuaaaaauuaaauuuagugauuugucuuauugcugaguuguaagaauucuuuauauaaucuggauauaaauuuuguauuagauauguuuuguaaauauuuucuccuaaucucugugcuuuuaaauuuuuaacaguuuuuuucuacaaagaauauacauuuuuaauucugaugaagucuauuuaaaacauuuuucuuuuaaaauacauguuuuucauaagaaauuauugcuuaacccaaaaaucacaaagauuuuucuccuguguuuucuucgucugguuuuauacuuuuaggcuauuuauaauaauuuuuaugcagucugagguaugguucaaauuucaauuuuuuacauaugguuauccaauuuuuccaguaccauuuuuugaaaaaacuauucuuucucccuugacuuaccauuggcaacuuuguuaaaauuaauuuacccuauguauuaguccauuuucaugcugcugauaaagacacacccaagacugggcaauuuacaaaaggaagaaguuuauuggacuuaaaguuccacguggcucgggaggccucacaaacauggaggaaggugaaaggcacaucucacaugguggcagacaagagaagagagcuuuugcaggguaacucccacuuuuuaaaaccaucagaucucaugagacucauucacugucacgagaacagugcaggaaagaucugcccccauaauucaaucacuuuccacuggguuccucccaugacaugugggaauugugggaguugcaauucaagaugagauuugggugggaacacagccaaaccauaucacccuauauggaugagucuuuuucuagacucuauuuuguuccauugauguuuauagcaauaucauacugccaugauaauuguggcuuuauaggucuugaaaucaggugcaaugagucccccaauuuuguuauacuccuuuccaaaccccuuuggcuauucuaaguccucugcauuuccaaacagauuuuagaauccccuguccaugucugugcaaaggagccugcugggaguuugauugggauugcacugaaucuauagagcaauuuagguagaaaugacaucuuaacaacauugaguguucugauuaaugaacauagcauaucuuuccaauuuuaaaggucuuugaagauguuucuguucuguugugggacugauagcauaacugucuugcacauauuuucuuaaauuaauaucuaaguauuuacuguuuuaauguuauuuuaaaagauauuuuaaaauuguaacucccaguuuuucauuguacuacauaggaaggcaguugauuuuucucuauuggucuucuauccugcagccuugcuaaacucucuuauucuaguuuuauuuuguagaguugucagaauuuuaugcaaacacaaucauguuuugcugggacuacaggugugugccaccaugccccgcuaauuaaaaaaaauguuuuagagauggugucuugcuauguugcccaggcuacucuugaacuccuagccucuaaucauccucccaccucagccuccugauuagaugagauuugugugcaaaaguaauugagguuuuugacauuuuaaaaaguaaugacaaaaaccacaauuacuuuugcgccaaccuaguaaaauaguaaaaauacuauuguaauuauagcauaauuacagacauuauauaaguugacucaauauagaaaagauaacuccacacuguaaagaaaauauauuuaaauuuaguuuuugcuaaaaugaugauagauugcauaaaauguuaaagguguagauaccauaauuaguuuaccuauuguuaaauugggcuuuaucauggauacaaauagugaaucauaucauuauucuauggaugacuucuggcaagccaauuuaaauacaauagugaacuuguuaaguauaauuuuauuuuucaaaaaaaauauuuauccauuuucaauuggauuguuugucuuuuuuaaaaaucauuucauuauauaugcaacaucuguacaacauuuaccccccauagauacuguuaaucuguugacuucuguauuuguggcacauuuugccuuucaaaaauuuuuaauuucaaaauacugagguauuuucguauguuauuuuacauauaauugguauuauugcauuuguuuagaaaaucuucucugaaaauaauuuacuggguguuugcaucaucuucauuuaguuuguaggucuuuugcauaugcuaguaugauaguuauauagggaaaaauacauuucagugcauucugcuuuuuuuuuuuagagacaaggucucgcuucguugcucaggcuagagugcaguggcaugaccauagcucacugcagcuguagucucaaauuccugggcaugcauaauuuucccaccucagccucccaaguugcgaggacugcaggcaugugccaccaugccucaauuuuauuuuuuauuuuuuuguauugacagggucuuacuauguuaccaaggcuggcauccaacuccuggccucaagugauccucuugccaauuuuaaauaaagaaucuggaagcuacauguauaaaguaggauuggggaaagccuuuuaaaguaagauuaaaaagcaaaagguaugcuguaaaauaacauacgaaaauaccucaguauuuugaaauuaaaaauuuuugaaaggcaaaaugugccacaaauacagaagucaacagauuaacaguaucuaugggggguaaauguuguacagauguugcauauauaaugaaaugauuuuuaaaaaagacaaacaauccaauugaaaauggauaaaagauacaaauaggcaagugacagaugagacaggaaaaacugcuuaaauucacuaguagucaggaaaauacaaauuagaguaaacaugacucuauagccaacagcugaaacauauugcuggcauagguauaggaaacauguacacucacguugcugguagaaauaggaagaguuauaaucuuuuuggaagcaaucuggcagcauccauaacauuuuaaaaauucauuugccuuaagaucuagcaauucugcuccugggauagugccauaacauaacuauguaaggacacagguacaauaauguuuuucauaacacuguucagaguggcaaaaaaucuggaugcaaagauaauacuuaaaacaggaugguuuaauaaaugaugguauguccauaccauggaaugcuauauaacccauaaaaagaacaaauuagagccaucaauuaacuucagagauuuuuucaaaaauuaucgaauagaaaagcagaaaagcacaugauaugauuuauccuuuguaaaaaggaaagguuuaaaagccacuauaugcaaaugugaaugugaauaugggaaucauuacccuaguauaaagaaaauuauauugaagauacacaagggguuguugacaugggugaaggaugaaagaacucaauaagaauaaaagaaaguaaaaaagggaagagcauagacaaaaaaaaagggagaaacaaucauacaacacuuccaaagaaagcauuaugauguuaccauauuuaugcuuuuguguaaauuauauguggauucauauaaaaaguaauuacaauagacauaaaauauuuuauauauacauauauaaauacaauauauaaagauuuaaagaccaauaauugugucauagcagugaaauuagcagaaauuaaaaaagaagaaaacaaacacuaacuuauaaaagcuaggaguauuaauuaagggcaauauguccaggaauccucccauuuguuuuuucccucugagacugaaugcaucaguaaauaaauguuagagggcaagaacagaggaugaaucaaguucauggaaauauccuucauuuugccguugcuaagggcccucaacuggcugcucacuacgcuaagcuaaggauuucucaaaugcugguucuaacaggaugccuguuaaaauaaucacuuuuguuuaaguaauauacuaaaaugucuucauacuuagaagucuaaaaaguuugcuauuuauugcauagauuggggaggcaaaagaaaacacaaaaacaaaaacacaaacacaaaagccagaacaaauaaaacacauuaucuacuucccuggagauugcuccccaucugugaguaaaauuacaagugaaagauuuaagaguuggggcacauacugaugggcugagucuacacuggcucuuccugucauauaauucauaaagaaucagaagguacucuccagcuagaaaaucagcucuuuuuccugaguuuguuuuuuuuuuuuuuuaaauaaagaacuuagcaaccaaucuacacagucauuacaauaaaguuuguuauccucuucuaggugggaagcucaggaaaccugccuuugugcuccuauuucagaguuaauaauauuuuuaacuuuuuaggccuucggggccacaaagacaacucuuuaaucaagacauaugaacugacugaugugcuuucuuuucuuuugaucuuuauagagcuuguaauuuuauuuuuuaauaauuucucuguuaacucaacucauuauuuauugccugcaaugauuaugaaacuauuugaucuucaaaguacagaacgauacaguaucuuuugaaugaccuuugcauuuggcuuuuuaacccuucuuuuuauguuuuaauuaucuacuaauaacauuucuauauacaaaugcauuacaagaacccacuagaaugugguuaaauuugaauuggaauccuucguuuuacgugaccaauggugcaaaauaauagagcuaccuuaucaaagucagcaaagauuaguuugcuauuaucauguauuuuucuaacugaauauuccuuuauauaaauuauuccaacaguuucacaagaacaauaguacuacagaaagagaauacaaugacuucuuaaaagaauugccauacuacauuccauauuuggcagcuauagauuauucuucauuaaauauaaauaagaauaaaauaaguuuuauagaauaucaaauaaggaauucuugcuaauucaagcccaaauugcuucagccuacaugaaccuauauuacaaacccauauuacaauacccagacuaccagcauucauaugaauguagggcagugaauuguuuagagucagaucuauuuuucuuucucaauauaggacauuuuuguuuuacuaguacauggcggguggcagggugcuaaccuaugaauucucugggcuacaaagcaugaaaggaguuauggaucagagcaccuguauguuugcuauuaaacauaaagcucacauaaaauguucuaggcuauuuugugccuuguagaacuuugaauauuuuuguuuaucuuuguauguuuuugaauguuugcuaucaaucaccuaagccacaauaauuggagaacaaaguucucaacuuccaagaaauaugcucaauuauaagccugacuuuuucuuuaugaaagagaaaaaucagggaauguuccauucagauaggaagagcaggaaaucauuuuugauaauguuuucaaacuuuaaauguaaccccaaauaauaauaaacagcauaaaauugacuucuaucuccacuggguucauaugguauaugucugacccauaagaaauuggauucaagaggauaaagugaaucguugaaagaugcaauuucucauauuguugugaagaucucaacugaagagucaauccuccguaaauacauccccuugacacccugccauguaggccagcuguuguccucuaaauguaaauuguuaaaugaucuaaaucacuucaugaaacuuuaaagccagacagaaaaccauagcaaaaaaggcaaaaaaaauccaggauucaauuuacuuauaucugaagaacaacaaucucgcuccuuuccuccuuagcguccaugcugguccaagccaccaacuucuccuuccuggacucuugcagucaccuccucacuaguuuucaugucucucuucuccuccaucuuuagucauucuccacacaacagauccaaccaugucauccuucugcccuacugaacauuuuccaguggauucccaucacaguuaaaauaaaauacgaacugcuuacuuuggcuuacaagcccuguaucugagauucccaaccuuaacauuauggacauuuugagccaaacaauaguuaggaggugcuucuguccauuuuacgauguugaguaguaucgcuggcuuccagaaacuagagcugguagcauccauuuugcuauugugacaacuaaaaaugucuccaaacguugccaaauguccagagggugggucgggguggugggaggcgguauguguggauuguuccuucugggaauuacugucuuauaccaucuggccauggcuacacuuuuggccucaucgccucuugcucacuccacugaaaccacacuggccuuuucaauguuccuccagacauaccaagggcccuucuaaauguggcuguugcuucacuugcuguucucugcuuggaaugcucuuucuucagacuuauuuucuaaccuaauuuauguucuauauuccuauuuaaauaucuucucucuauuuaaaauagcuccuccugucacacucuacucuucagcauacuuuucuucauaguauuucacuacuccuggguuuauaaucuauccacuguuuaccugauauuuugucugucuuccucacuuaacugcaaauuccacgaagguagagauuuuagcacugucuuccugauuccuaaaacugugccuguauguauuuucaauacauauucaauaaauauauacugacuaaauggauauucauugaaugaguauggauucugguaguaguccucuagaauaccauaaacaauuaaggguugcuauuucccucauuucgguaacaguuucauauacuaucuuaaauugaaaaggauuucagauaucuucagguaacacagucauuuuauagauaaaaaauuugaggcuuggagagguuaguuugucaacagugcuacacuuacuuugugaaaauuaagucuaaaaaccaaaccgaugacuaacacauuucaggacuucuuuuuauauucucccuuguggacauuuuacccauacugauggaagcuucauuuacaauuacauuuuuagaaaaaguggaauucaaucuggauacagauauugcauauaaguaauauuauuuaagaaggcuauuuguugcuauccugauuaagugaagacuauuuugucuugcauauuuaguaggaaauucaaucaguaacauaacagauuauuuuuuuaaaaaugauggcuuagauucugauuacaaacuaaaauaucucaaagaaauuuuagauauaucugaaguagauauaaaguacagauauuuggcagaauuagauacauggcagaaguacuaucugaauggauucauuuuacagacuuuauagacugauuugcaucaaagcuauaagacuauaugaaagauaaacauuauugaaagacacaguauuuggauuugccacaaguuaugguaauuuuaacaugauuaguaagguagaauucuaucaagucaacucagucuacauuuauaaaaaaagauaucuaaaauguacaugauuuuggaggguuaagggggauuaaaauuuuaaguaugacaaagcuucugaccucaaaaaccuuauguuuaagagauaaguauagaaaaaacaccaaaaaaaugugauaaaugguagauucaaaauauaauaaugauauuaacagccuacuauuaauuauagaaaaaauaauaagugacaguaaauuagguuuugugaaacaaacaaaaaacaguaauuaaacccagauaccuaaaagccuguacacuuaacuaaugguccauacuccuuuaaaaaaaaaagauuaauucugauugggcugauccugaucuggaaaauuagaaaaauaaaauauaaauaugucaugaaugauaaaauauauauauauauauauauauaguaucaaggguucauguuggaaaaacccugaguucuuugguuugucugaaaugugguuuaauggaaaccaccaaacguagguuguagguuggggauggaccguagagagacuuuaauaucaaucuaaagaguacagacucggccgggcgcgguggcucacgccuguaaucccagcacuuugggaggccgaggcgggcggaucacgaggucaggagaucgagaccaucccggcuaaaacggugaaaccccgucucuacuaaaaauacaaaaaaaaaaaaaauuagccgggcguaguggcgggcgccuguagucccagcuacuugggaggcugaggcaggagaauggcgugaacccgggaggcggagcaugcagugagccgagauugcgccacugcacuccagccugggcgacagagcgagacuccgucucaaaaaaaaaaaaaaaaaaaaaaaaagaguacagacucuauuuuguaggcaauggggaacaucugaaggguguuaauaaaaaaagugacaagauuauacuuaauuauccuucugaaacuagcagccugagggccaaauggacucagcugaacagccagcgacugaugaaagccauucuucaauaaauucaauacaauuagguucccccagaguggcacccuugcuugccacacacaccaggcuaacacugauuacggggcaauauuugaguauacgugguauguggcuguguauuucuuuuggguaaauuuuauugugguaaaagcacuuaccaugagauauacucucucaacagauuuuuaaguguaggauacauuauuguugaguauagguacaauguuauaugucagauuucugaauuucuagaucuuauucaucuugcuuaucugaaacuuuaugccugcagauuaguaacucuucauuuuccccucuguaaacuccuggcaaccaccauucuacccuuugauuccauugauuugacuauuuuagauaccucauguaagugaaaucauguaauauugguucgucuuugugugacuagcuuauuucacuuagcauaauguccucaaguucauccacguuguugcauauugcaggauuuccuucuuuuuaagaauaguauuccauuguaugucuacacaacauuuucuuuauccauucaccugcugauugacaucuggguuguuucuauaugcugucugaugugaaaagugcuaaaaugagcauaggagugcauauauuucuuuaagaugcugaugcuggaucauauaguagcucuguuuucacuuuuuuuuuuuguaggaaccuccauacuguuuucuauaguggcuguacuauuuucgauucccaccgacaguguucaaggguuccaauuucuccacgccuucaccaauauucauugccuuuguuuuuauaauagucauccucacaagugugaggugguaucucguugugguuuugauuugcauuucucugauuugugacauuaagcauuuuuuuuuucauguaagcgguuugccauguguaugucuacuuuggagaaacaucuacucaaguccuuagcccauuuucugaucaaauuuuuugguuuguuuuacuauagaguuguaggaguuccuuacauauuuuagagacuaaccccgcauuugugguuugcauauagauuaagcccagauauauaguuuguaaauauuuucccccauuccacagguugucuuuucauucuguugauuguuuccuuugcucuguagaagauuuuuaguugacauagugccacucguuuauuuuuguuuucauugacuuuacuuuuagugucauauccaugaaaucacugccaagaccaaugucaugaaguuuuuccccuauguuuucuucuaggaacuuuacuguuuuggguuuuacauugaauucuuuaauccacucugaguugacuuuuguguaugguacaagauaagggcccauucauuauuuugcauguggauauccaguuuucccaacaccauuuguugaagagaauaccuuuccccauuguguauucuuggcauccuuuucaaagaucaguuauaugcauggauuuauucccaggguuuguguucugauuuguucuauuccuagcuauacgcuuguuuuuauuccacuaccuuaaacaaaacagauuacuauagcuugcuucuuacugagaccuaauuacauucaacucauccccuuguuuuaugggcuugccauagaaggaucacuaggaaagcaaagcauguaaguacuucagcuuuacagcucuagugcaucuuaggcuaaauugcgauuugucagugaaggugaguccaagagaggccuguuuuacuucuuaagcaccggaaccacauaauuaauauaaucucuauaucuucugauuggauaucuaucucauuugaacaaaagcaauccuguuucacccuuaucaaaaaucaucccacuuagauaauaaaugcuuacaauuauauucuuuucaugguuacaaaauaccacuuugaucagauaaaauaugcuuacuauggaaaccucuacaaucaccuaaacucuacuuaccaccugcuguuucacuuaguuauguguucacauuuagggaccugccuugcaguaguguaucuauuacugaugggacuucucuccuacaaaugaucaaccugaccauaauauguaaaaaauaacaaguuuuugggucaaaucauuuccaagucaaaauuuugcaagauucccuugucauaugacuuccauccucagcacuacaauauuaucauuaauguuuaaaucauugucaagucugugauugccuuagagauuuauuaagaauaacaugcuaggauuaggaaaguuuaacuuuuuaccauccuuaaaauuagauuuuugaaaacugucuuauccccauuaaagaaaaaaauaaaaaggaugaauacacucauucuuucccuucaauuuuuuguuacauuuuuuuuuuccugaguaguuguuucaaauauauauaagaggaucuagcuggucuugggaggucugcaaaaauuuuagagcagguaauauccaaaacuaaaggauaaauagaacuuaucagguaaagaaguuuaggaaaaggcauuuugggcagaaggaaagcauguucaauggcaaaagaugagagaucauaaaguacaucguagguuaauauuagaagaacccugaauucuguacuuuggcuggacuguaagugugaugucacauaugguaccauaccucaacaauuagaaauccucucauucaaaacaauacaaacugauaguugucagcuugauuuuuuuaaaguuggcaaaggcauggaauuuaucauacucucacuucuuaaucauaacacugaauuauaaaacaugaaauacacaauuuauuuaccaaucuuuugaaauaagaagucauucucuuuguguaugaauccauaaguugaaguucugaaaaaucuuucugucauacaccacacccauacugcacuauuuaccacugccaguuucaguuucuuuacguuggaaugaaaaagauauuugugaccaaaucugaguacagaacgauucuagauuuuuacaaauuuuuccccagccuuucacaguuaucucaccacauuugacagccauuuaaaaaaagaaaacucauuaaaaguuagucuuucaaaacauuuggcuguuuuuuucuuacucauguuucauauauuuaauuacacuagauugcuacaauaauagguacaacuagcauguuugggaauaaucaccacugauuuuuuaaugcaaacauuuuagcugguggaaacaaaaguacauaguaugacuacagaguaaccuuuuaguugugaacauucuaggucacagaccucagacaaauguuguacagaggaauaaacagagugcuugaauuagucaagcuggucuaggugaagaauccauuuaagacagcauuuguuuaguuccgugugacagaauaaaaugcaagauaggcaaauguaacccuagugaauacgagguuggaaaagagaaccaaaugugcacugugugccaggcuacaaaauuagggagcuuacuuggaaaaucaguaugaacagcgcuucggaacacagacucuggauggagguaaauugccuagguuugaaugccaccucucugcuuagccauaugauggugggcaaguuauuuaaccacuacuuaaugauuuaauuaauuuauaauagugaaaaaaaaaccauaccaaaauaaccagacuuaucugguuauuuuuagggauacaugaguuaauauuguaaagugcuuaggacagugcuuggucaaaauaaacacucaauuaaugucagcuuuaugauuauacuaauaugaugacugauagugaagccagauaucgcccugaccccuuugcgagccuugcaacaggggugccuugcuuacucagcccacagcucucaaccacuugcaggacagggagcacaggugagcagguacaggagcuggggugaguacuuuugggugccagcaggagcaaaacuccaugagggcccugcagcagcauuaggcaagggcagugggggggauggggguugggggugcccacgaccccugaagccccagaaggaguguuacguauaguaacacuuuaguuuugccauuuguggauggcuuaaguguuaacagcucaguggagggucagugugacagccuuuugcgcccacacuuacggcacccaaguuuuugcccaacauccaggaagaaugaggucagacgaauaaacugaauuugguaaauuuaggagcucucaguguaaaggggagcugaaaggaggauacaacaggaagguaaucuuuuccugaaguccagcuguccccgaccagacuccucucugaagcuaugccaucaagcugucccucugaagucaaguugcuucucuucaauggucaaacuguagucuccaacauccaacugcuucuccuccucucuacuggcugaguccaggguuuuuaugggcacaugaugggggauggggcgggccaugggugguuuuggaaaaggcaacauucaagugggaaaacaggauguaaguucucacuuugggcugugguaucaggcuuuggggcccucacuagggacccacccucuucugcccagaauuuaccugccuccugucccuaucaauaguuucuagauuuacuguuccaaggcauaaucaugaguucauauauaaaaaauacuuggaccaguacuugcuauauaguaaaaauuuuauauucauuuuuugcuguuaucauaagcaauuuaaauguuuuaaaugaaggaguacucagauuugcauuucagaagcaaccaugccaacagugaguggggcaauuggugggggggaaaugcuucagaaguuauuggugcugagcuaggauauucccagggugaacagguagaaguaaaguaggagccaagccuuacucaugcgacacaacggucaguacuugcugcuuggcuggauaugucucaugagcaagagggaggaguuaaagacauucaucauggauacauuuuucucugcaguugcacucaaauauuauguaguuuuugguuuauggguaaacucagaaaagaaguaagaaauucagagcagguauuucuaagaaauucacaaaaucagcuacaaagggaggaaaagccuuaucuuuauaaacaguaucucugcauccagcaaccucaguguccagaaaaaaacugaccccuuuuuuauuaagccaucaaacuucucucucuccuucaaauuauuuauaguuuaauaucacuaaaccacgcagguacacuuugaagaucuagguaugagaagccuguggaauaacucuuugaacaucuuuccuuuaacaugaacuugccggauaacugauuuagcauucacucuacugagaaaacucuguauaacaaaguugccuaguaaaaucauuaggcucccuguauugaaaugaaaaaggcuuuggggauguuucagacuuuucuguguauacucuugcuuggaaguggguauauaaugauacuaaaaguguauuuaaaguucccaaaccaugcagcgugagaaaguuaccauaucuuuaaagaacugucucuacuguacaaaagacaaaagacaaacaucaauuuuugacuaaacagauaacuauauuuaugcuuucaacuauuuaugcuuagaagcccuuucagauguguuugguuucuuuuguguuuuagaagguuuagauaacagggauaacaauguaacagaauaaaucuguaucuaugaaguaaauaacuggauucacaaaugaaauuuaaauucccaguucacugaauuuaauaguuauuuauugagugccuuguaggugccaugcacugggaugcaaaaaugugcaaaaaccaauacacucucaaggaacuuuaaauuuaguaggaaagauagacauuaaucaaguaaucauuuaaaaauguaauaucauacccgugguaaagaccaugagagaaagguacaggaagccaaaaauacuuacaauaggggaauaugaccuagucugagauaguggagagagcuacacaggcaaggaaagcaaaguuucaggcagauugagagcguaugccaagaucccguguucagaagaaaccuagugcaucugagaaacugaaaggccagaguggcagaaaggcaaaggcaguaggaacacaguaugaaaugaggcaggaguggugagcugggaccaaacugugcuguacuuugcuggaagaacaaaggaucuuaguccagugguauuauuuaaucaauugguuaggugccuaaauaaauaguuuagucaagauaguucaaacaauugcuuauucugcgacaagagacaugaguucauuuuacacagaaauucagugacugauggcccuaaaauaaauaccuuauaagccagacaauguagcauggcaggguguaaugaaguuacaugacuuucaccuaaagguacuugagaaaacuucuaaugcagugaaagcacgagaacggugcugugagauuauucuauuucuccugcccaggaaacaucaggcuaggcuauauuaaggucaaauuuugaagaaggaaacauucaugucugcagucuuuuuuugugaacuuacuucccucucucagaggcuacucucugggguuaacaaaaacucucuccacuuucaggcccucuugaguugagcaccucccuauccaacaacaaccgucucccuccauucaucuagccguuucauccaucucuauccucuaccuacagugggcucauaaacucuaccuaccuuucccaccauucauuaaaguauaucuguacucuccaagagaagggaagggauucuuacuucugugaguuagaaaagcaucaguguuaaacagaggagagagagagagagagaaagagagagagagauagacagagagagagagagagagagagagaccauuaaaacaguaaaugugccaaggaaggagauagaauacuacuauggacuaaaguugacuaauggaacuuuuaaguacagaaacuucaguuaagccuaagguuaggcuuagggagggaggcuagacaugauaggccauuucagaguaagcaaaccaggcaugaaaacacaguauacaggaacgaugcaugcuaggcuugggaugaagcgugaaauacuaagggaaauuuuaaagcagcauaaaugcaacagagagcauucacaguuagagcagugauaaaaguaaaauuaagagagcaagaucuuaaagagcccuaaaaacuaaggugagaaguuucauuuuuccucucuugauagcugagaugaacuagaaaucugcauucagcaaaguaaccugaugagagcugcauuuuaaucaaauuaauaaaaugaaucuuguaguguuuauguacucauucaaugaauauugauucaauuccuaccauguggucaaaugcagugccagaugcuaggauuguagacaaaaccaggaagggaaauuuucauuaauagaagcguugaauuuugauguaggauggcaacagugugaaaagaaaggaagaaucagagagacuuugacuuuguuaucauauuauuacauguuagucacugagucaaaagaagggcaucaaagcugacuccacaguuugaagucugcaggaugaaaaauuggguuguauuuggggggaaggugaugacacuuaucuaugaaauauugaguuugaaguuguaagugauuucgucaaguggaaagguaccauggacagaugaaguucauaugugagaccugauaauucucucuucuuacucauuauuuuuaguugacaacucauaauucuaaaacccugguauuugcgacacauaauauuaugcccagccaucggggaagauauuguugaucuaggagaagccuguauauaaauauucucccuguauguuaauguuauugugauugaacagagaauguagcaaaugggaaggcugcaggaugugggaaaaaccaagauauuuagaaaagaacauuauaauuuacucuucaauauaugugaagcauauuuacaaauauauauaaucacauauauguauguauauaaauguguauuuuugaaugcuuuucuacuuuuuaaacaaaugauaaagaugaacaaccagacauuaaaauuagaauacguacacaguuaaaaaaaggaaauuacacgacugaaaauggugugcacucucauagccauuuaccuaagcuaucuuguauaguaagaaguuuacaucugaaagacaaaaguuacaaaaaugcaugcauucaaauucagcuuuaaaagugaaauuaaaaauauauuacaaaauguaaaucaaaaggcauuaauuuaugcuaaaauugccuuucccuccaaggguuucuaaauacucagcaaacuuuauuuuagcagucaugcucuaauuucaauuauguggaaauuauucuaucuucaugaacaugaaaacagaagaauaaauaauaaauggcuugucuuuguuuaaauaguacauugaaacaguacaaauaaaaagauucauacccacacauguaaaugcuaagaacuccuaauaauccaaguuggcuaaaaagaggcugaaacaggaguuuugaaaaauuaucugggggucagguaucaaacucauggcauugaacagaauugcaaauguuuuuccuuucccauuuugacagcaauauaccuauucucugcuucuggcaacacaaacaacauauuuucucuagcuuuacccauauuuaucaaggaagaaagagacaacuauuacugcuaucuacuuuaaccugucuaaucuuucaauuccuauucaagauuuccuggaaaauucauguauguauuucaagcauuugacgggacaguaaauauguaucaaaauaauuuccucuacggaaauugcaguaaaugcauucagaauuuucuccuuuuaaaagguagaaggaguuccuagaggaagaaacuuccuauaguacaugcaauguuuaaaaaaauauugaucaggcaacuacauuucaaaggugucugucuugccuuaagugagaggcuucuuuccaguauccaguuauaaugucaaaggagaaacaaauaaacaaacaaaccuaagacaaaaaaaacaaaaacaaaaaccucucaaacacauuguaaaugaaagaaggcgaguuaucuaucuccccauugcccuuuuuuuaguaggcaauuuggcuguaccuaucagaaucuuacagccaguaaauuuagaauucuauucagcaaaaauaauugcaaaacacauaagagcauguguaugagaaugauccuuagagcauacagccaaaaauguaaacacaauguaaguguucagguaaguaacuuaaaaauuauaauacauucaagcugugggaugcugggcagagauaauaaauaauuaguuaaauuguggugauaauguuugugauggaucucagacuggaaauaacacauuaaagaaaauccaagcucuagauuaaaaaacacaaacacacacacaaacaagcauacagguacauguauguuucugugagcauuaaaaauuauagaaggagacacauuuaaaguuuuuuuuuuuuacuucauggggguaggauaauggggcaauuuuacaaagaaaagcccugaucuuuauaaaauucaguauuuggguuuuuauuuacaaugcccauguaaaaacaagaaagcaaacacaaaguuugacuaaaugccaguggcuucgugaaaaguaguugcuacuugcuccuaaguugauaaucaaggucuacaucuagccugaaaguaaaguagcaaccucucuuacugcucaggaacugaugccugagauacccucacaacccacacuaugagaacuugugauuuugcaucuccucagcaacuacaacuuccaguaugcagaauggcagaaaggacacacauggcuagagagggaauggauaguggcaaacgacauuguggaagguggagaucaucucaugauaaagacagaugagugaagaguagucaagaagaacccugggaacaauaaacuuuggagguuguaguuuccaugcuuuguugucaaauaaaauauaaagucugacuuaggauuacuaggauauguuuagucuuucuuauaauuaguuaagaggaaaauaggagcaguuuucccccuucuacccaggaagguaccaguagacuaauaaccacuggguacuggacaauagguaagaggcuauguacaugcccagcuaaaaauaugacaaugagauuugaugcgcaucaagggaccaaaagcaaacuaauacuuuguugguuagcaaaugccaaggagcuaaaugugaacuuucucaagaauucacaaaauaauugacauccaugaagacauucugcuauauaagagcagaaagggguuaccaucuaaaacauagaaggaacucauacaacucaauagcaaaaaaagaaaaaagaaaaaaagaaaaaaucugauuaauaaaugaacaaaggaccugcauagacauuuuuccaaagaagauacacagacgagcaacagguauaugaggaaacuucaaaaaguucauggaaaauaugaauuaaaagauaaaaauuuaaaaaugugcaaacuuauuucucaacauaagcuccaucaagguuaaggcaacuugcuaaguaaugauaccagccauuacuuggucucugaagaucugaggguccugggaauuuaaccauguccaugcagcuucuuuuacacuguuaacugaagaaaaauggguguccuuuaaaauuguuuaacguuaggaaacaaaaagaagucagagggugcaaaaugaggacuguaaauuagaugcuuaaugacuucccauugaaacucacaauugcccuuguuugaggaaagagcagaagcacuguuggguuggaggagggaucucagguaaaguuuucucagguguuuuuuugcuaauaauuuggcaaacuuucucaacacaauuucauaauaaacagauauuaucauuguuuuggcccuccagaaagucaaccagcaaaaugucuugagcacucaaaaaaacuguugccaugaucuuugcucuugaccagccugcuuuugcucuuccuggaccacguccgcaucuugguagccauugcuuugacugugcuuugucuucagucacacugguaaagugauguuucaucuucuguuauaauucuuugaagaaaugcuucaggauccugaucucacucguuuaaaauuuccauugaaagcucugcuguugucugcaguugaucugggagcaacgguuuuggcauccaucaaauggaaaguuugcucaacuuuaauuuucagucagaauugagugagcucaaccaauugcaugugacaucuaugaagcugacuaccauuucuacuauuaaucaucaguccucuucaauuagggcaugaacaaaauuaauuuuucuucaaaaagugauguggauggucugcugcuguggguuucacuuucaacauugucuuguccugucuuaaaaugaguuacccauuuguaaauugcugauuucuuugggacaucguccccauaaacuuuucaaaaagcaccaaugauuucaucauucuucuacccaagcuuuaccauaaaugugauguuuguuccugcuucaauuuuagcaaaauucauguugcucuuuucaaagugaugucuuauucuucucaaugccucaaacuaaguucuuucagacacauuacagcaaguuuaguaugaguuuaauuugguacaauaguuuuugaaauaugugcauuuuuuuuauaauacauauauuccaugaacuuuuugaagaccuccuauaugaaaacacaaucaaaaucacuaaucaucaagaaaauacaaaugaaaaccacaacauagcaccucauaccuauuaggacgacuuaucaaagacaaaagauaacaaguguuggugauggugaggagaaaagggaacccuuguacacuuggugggaauguaaauuaguacugguauuauggagaacagaauggcgguuucugaaaaaaauuaacaacagaacuaucaaacaauccagcaauccuauuccuggguauauauccaaaggaaaugaaaacaguaucuuaagagguaucugcucccccguguucgcugcagcauuauucauaauagccaagguacugaaacaacuuaaguguccaucuauagauuaucagauaaacaaaaugugaugcacucaugugcacgcgcgugcgugcacgcacacacacacaaauauuauucagccauaaaaaaggaggaaauccuauuugugagaacaugaaugaaccugaaggacauuaugcuacaugaaauaagccugacacagaaagacaaauacuguguaauaucacuuauguguggaaucuaaaauagucaaauucauagaagaagagaguagaauggugguuuccagggcugggagggugggggaaauggggagauguuggucaaaggguacaaaguugcaguuauaagauaaauacguucugaagaucuuaugcacagcauggcaacuacaguuaauaauacuuguauugcuuacuugaaacuuauccagauaauagauuuuaaguguacucacugaggaccaucuccccacauacaguagcuauagauagugacauauguguuaauuaauuugacuguggcaaucaauauacaacauguauguauaucaaaucaucacacuguacacuuugaauguacauaacuuuuacuccaauuguuuuaaaauuaaaaaauaaaacauuauacugcaaaaaagagaaagagagaaaagaaaacuguugauaggcuuuagaaaagcuauaaggaugaaaaaguuaacaacacauuguagacuauuugugaaaaucaugccaucuccugagacauccuaucagauaaucugacuaguaaauuaaagacuaauaaggcauuucuuagccaguguaagguuaaguguuuaacacagccaauacuuuucuaacucugcaaacugaaaacauguuuauuaaaaggcucacgucacauugaauggccacaucuacauccuugauaugguuauguagaguuuuugggcuaaucaauuacaaaaaauaaaaagaauuaaaagaauuaaaaaucauugcuucguuguaugauuuagucaugcgaaaguaacaggacacugcagucacugugaugauauugguaguugaaaugcagcuuuugacaacauaaaguguuucugucugaaugcuuguaacgcaaucaugaauuuucucucuuggaaauggugauucuuugaagcagagucauauggauuucaaagaaaaaauuuaacauuuugucuacuuuuucuguuccaaaagauauagagaaaaugcaucugguguuucuaugucuuccaacucuuuugugcuacuacagaauagauaagccauucuacuauuauauaaaaguggugggacaucgcugggauagaaaauuuacaacagagaguaaaagugaauccuugaagaugugaaaagccaauucaaguucuguuauaaaaugggaccaaaaccauuaauauauuccuuauuuuuuuaccuuuccuacacuacuuccuuccuccauccccacacagaugcaaauauagaaccaaagucuggcaggaaugccaaauaauuguaagagcaaaaauaauguauguuuucuuugcuuguggcaguuuuauuaucaucaacuugcuaauuuuauauuucauaguuuacugguaaacuuuuacuauguguaaggcugaucuaaaacaaaaugucaaucaaugcuucuauauuugaaauauuauaguuggugauacauuaaugguucucaaaacauauuuucucauuaauagaucagucaucacaaaaugaaucacaaaaaagauguuugcaguugguauagugguccccccaaaagauaaauccacauucuaauccccagaaccuaugaaggugauguucuuuggaaaaagggccucuauagguguaacuuaauuaaggauuucaagaugagauaauccuggauuaucugggugcauccuacauucaaugauuaguauccaugugacaaaaaacacacgugggagaaacaaguagggaagagaagucacauaaagauggaggcagagaaugagugauacauccucaagcucaagaaugcugauggucacaagaagcuggaggaggcaaggaagggaaucucuggagggagcacagcccuuucaauaccagacuuguggccucuagaacugugagagaauaaauaacugguguuuuaagccaacaaguuugugguaauuuguuacgacagccucagaaaaccaauacuacauuuuuuucuuuucaugccuuuccugucauucaaagguuaaaaaugauaacaauaaucacacccacugaacacuaucugcaugucaaaauagugauacguuucuuacagucuucuuauucaaccuuuuuaaggacucugugaagaugacauuauuauuaacucauauuuguugaugaagaaacagaacuaggauucaaugccaaguagaucugacuccaguccaugcuccuccagcaaaaauaggaaagaaugaagaauauaaaguaaauaaauccuucuuugcuugcauguacauucuaaaagucccuggaacgaaggcaaagaauagggagacgggaaacaagguggacgggucucuucugcugcacuacauuuuuaaaaaucucugaaccauguuaauguauuaucuacucaaaaauaaauuacaaaagaaaaacaucaguugccuggcaaaaagaagcugauaaauucccaauuggauaauaagaaauuaaugaaaauauuauaaauuuaugggcagaaugaacaauuuugagaauacugcuaaaauuauaucauacauagaaaaauaugucaagaaauuauuagguacuacuagagugcugcucaaauaaaagucagucccuucuuauaauauuuccuaagucucccaccuucuacuucacuuucaaucauccacuuuaccaccaacaacaggccaggaguaaaugaaauuaaugaaauaucccaauguucaauguacaagucucucccucaggaauuucuuuccuuuccuauuugcuguaguuauucaaaauuugauauuauagccuaagauaguguaaaccauuagaugucucaaaacacagauuaugaaauuauuaccaagggagcuauaaauucuuauuuguugaugauauuuaagaaaaugaggaacuuuuuuuguuuuaaguaauuugcauuuagacuuaguuaggagaaggaaguaauuaugaccucugaugacauuccugaacuuacagcucuaaaacuuuagcgucuuucaccauaauccccuuauuuaagaugugugagcuauaaaaauaccaaaauaaauaggaauuucuuuucuuuuuuucuuuuuuuuuuuuuuuuuguugaaauggaguuucacucuuguugcccaggguggagugcaauggcgcgaucucggcucacugcaaccucugccuccaggguucaagugauucuccugccucagccucccgagaagcugggauuacaggcguguaccaccacaguuggcuaauuuuuguauuuuuaguagagacaggguuucaccauguuggccaggcuggucuugaacuccugaccucaugaucugcccaccucgcccucucaaagugcugagauuaaaggcgugagccacugcaccuggccccagaaauaggauuucauuguuauauuacucuuccuuacaucgcucuucuugucauuaaaaauaauuucucuaauaauuuuaaaaagauuaagaaaauaagucuuuaucaaaauagugacucaguuuuucauuuuuaucaauuagcauuuuaucaaaucuucacaacuacucuacaugccaauagaaauugaugguucaucuuugccagagacauacacaaaccccaaaagauaauugaguagauuagagugaacaccaauaaaaucuaggucaaacuuaauaaccuucaaacagcagcagccacagugcauacuaaauguaccaaccaugaacuagacauuuugaugaagucaaaaccaauucagggccgccugaggaugauccauuuccauauacugacuuuugcaugacuuucccuuuucaguauauuuacuuucaaauguaacuuuuauuucacuacuuuaaguguucaaaaugacaagcugaauccugguaauuaauuucugauugacuuuuccuaauaugacucaccaaauuaagccauaagagacagaaacuggcagagguagaaacuugugguuaagguauaacaaacuaacugaaaccugcaaauaaccaggauuucaauauuagaaaucacaaaugaaacuuagaaagagcagaaucagcaaauuauacugagucuaugccaaccaagaccuuucucauagagacucuacuuguuuucaggaucauuuacauuuaauucuauggagcaaugcggguaugcuuucaagcacccuaaaguugacaagugcuucugcaaaauauuuucuuccuuguuuguuccuuguuugcauaccggagaggagauugaaccagaaauucucuuuuaaaaaggguuuugaaaugugcgcauuuucuucaaucaaauucacuuauuucuugaaaaaaaaauauucuaagaguaccauugugagcuaaggcauuagggaagauaaacauaaacugugaugauugcauuaaccaagugucaacuugauuggauugaaggaugcaaaauaguguuccugggugugucugugaggguguugccgaaggagauuaacaauugagucgguggacugggagaggcagacccauccucaaacuggcuggguacuacguaaauugcugccagcuuggcuagaauaaagcaagcagaaguugugaagacuuggcuugcugagucuucuggccuucaucuucugugcuggaugcuuccugccuucaaacaucagacuccaaguucuucagcucuuggacucuuggacuuacaucagugauuugccaggggcucuugggccuuuggcuauagacugaaggcugcacuguuggcuucccuacuuuugagguuuucggacucagacuggcuuccuugcuccucagcuugcagacagccuaucguggccuguuguguccaucacaccuugugaucacgugagucaauacuccuuaauaaacuccccauuuauauauacauguauccuauuaguucugucccucuagggaacccuaauacaguagguuucuccuuuccagagguaugcacccuagguagggacacagaaagaugugguaagugacagugaaaugugauguaccaggugccuauggagaacaggguuacugauuuauucuggggaauuagggaacauuucacagaugucuuugagauagaaggccacugaagagcuaaugcuuuaaaguuuuugaaagugauuuggcuuuuugcuuuuuucagaaggagcuucccuuaguaugcucuauauuuuugacauuauugugaggcuucuguuaauuugaaaguccuaaugcugagaauugaucuuauguguuucuacauuuuugaaauaguauuuuauauuuaugugcuuuaccaagcuucuauguaucauuaucuuuguacauuuuaagaaagcaaugaucacuaugggguaugucccaauaauaauuaugguuuuauucauacuacuucuuugccccaguaacuggcaggaauuuuuuaaaacauuuugagauaauuuuagauuuacagaggaguuacaaaaauaguugaguucgcauacaccuuucacccagcuuucccuaauguuaacaucuuauauaaccauagcacaauugucaaaacuaagaaauuaacauuggcuuaacacuacagacuuuauuuagauuucaucaguuuuuccugugaaguccuuuuucuuuucugagaucaugaccuuuuuaaaaaaauaauuuacugaaugacuaguuauuuaagagagaaaaaagaauaagaauuagaacugccagcuucuuaaaugagagauucauguugaauaauauuuauuuuuguuuauguuuugaagcauuuaagugagauaagcuuuguucaauguuguuuuauaugcuacucauuguauaacauuggcugaacucugacaaauaguagcuacacaaaaauacauuuuuucacgauucaauucuccacacuucacuguuuuaaaacugaaggugguuccuuaccuuggggauggaagggucaguuccaucugaggagguuucucaagacaguggcaucuauaaauucccuucucuagugggagagugguagcugcaggcacuuauauggagauguucaucugcuagaaacaaaagcucuuccaccaucuaacaucaaagcaagaggugauuugucauagggaucauuggacauaccucauuauuccucugcauuauuucuuaucuaauuagccaauagagacaagaugcuuuauucaaauuacccucccuuugagggauaucacuguaaagugcacauaagaauucuaguaaaccaggccaaggagagaaaugccugagauaacacuccccugcuuguuucuucuguucuccuauucagacuggaagcauuggcugggaucacauuauguuuucaucuauucaguaaugugaaagcuuggaucuuggaauaacaaaugugcuuaacuacccauggcauaccacaaagaacauuauuuugacauauauaugaaaacuggaaauauaaauugcucuggcacaaggaggacacuuuaucucuccuagaaguuaacaguagacuacuccaagauaacuuuucagagcacugcauuuuaauaauucuccagaguccuuggcauuagucagaaauuaucuuuucuugcaguggcaugucuaaugucaguguacugcaaagagcuugcaccacugcuggaacuuguaugcuuauuauagauuugguucauuagcuagaaaaaaacauuaacagccacaguauuuccuuccauuaagaauaagcuucagcuaguguguuucacaacucucauaugacagagugccaagaugcuacaaaaacaaaaauuccacuuugcuuugaaaauagaagcauuuaaagaacuguagaaauagcuguuaccuauuuaagaggucacuggaaagacuaguggucuggagaaaauguauauggcaauguuuguaaacuguaaagaauuaugcauacaucaggcuuaagugcaauucuacuucuuuaugucuuccacaaauccuugcauauaaaaauacuaagauguuugucaauugucuauuauguucuguccaaaggauccugauagauaauaaaugacaaaaucauuaguuauaucucaauaaaccuaauugaaacauacauguaaaauacaaaacuccccaucuauucuugauauacuuugauauaguauuuuagcaggguuuuuguuuggaacuaucuaaauccacuugacauaaucauuuccucaugaacggauuuuaaaaauuaagugacucaaacuccaugauaaaugcuuaaagccuuaaaauauuguuuuucuucucuucacuuaaucuacugguuggguuaggcucaaggaaccacagagauuagaaagauucugauccaauaucacuguccucuuuuauacacaugaagcugaacuuagaaucaugaaaaauucugcagccaccgauuguaagaauaugaggcugauguugcuucaaauguauaucaugagcaaacuguuucucgcuaaagucuggauguaauguuuuucucaucagauugauugucaagaccuucauuugauguguaacaagauaaaaccugggaagugguggacucugauugauuuucugauuugccccgcugcauggcacagucaacaauuagauugguuguuucaaagccuuuuauuucaccauuacgaauuucuaccuguaaagaaacaagccuauggcaguugcuguggugaucgugccuauggcuaggccccaggcauaagcaaacacauacuguccugacauaccaguaacuacaaguuucaaauuuuaguccuuugacuacaaaacagaaaaagaacauguaaacagugagucauuugccauucaugaaucagcuuucagugaugaagaaacaaugaauacaacuauuauuauuaauguccuucuuaagaaaaguaacucuuauacuaucaagggaacuucuauggcuugaccauaaacacaggaaaaagagaaacuccgguaaaaagcauuguuuugagaauaaauuaaaauaaagcauuugauagggacacuuacccagcaaaccaaucuucuauauaaagacaauguauauaugcauuuggugucauuaauagcaucaaaaacaaacaaacagaaagucuuaaaagaaaaauagagagugaacucauagaagcauaaaaggugaacucuuaaauauauuggauucucccugaaaggaggcuuuauuauaugucuacacacauuuuacuuuuaagggagguucuaaccuuuuauuaguagaauauuucaaaagaauucacuaagccuuuuauauuuaagcauuacuuuuucauaaaauaaaaucuaucaaauauacuuuauacacaaauauuuuggucacagcucauuauuacuuaauuaaaauaaauugccaacacacuuauaauuugaucuaaauuaugacucaaaagaucucacuuuuaaauuagaguaucacuccuauaaauaugacauuauucuuuguuuaggcauuccuucaagguagacuaaaacugauuucucagaacuuaccuuuuugaaaguuauaucccaaugcccuacagguuaucucacauuauagccugauugcuagugauugacaagagaagcccaggaauagccccccacugaugcacaggggaauaaaaagccuuccuccuuccuuggcccuuaaggcagcauucagcucaccuuguagcucagucucaaguuuaccugagucuaauguaugacaaaggaaugauucccaugauuauugaaaagucugacuucuaccuaaaaugcucuuuuccucacuuugugauuucacauagagcacugauucauuugaacaggcaaccuuuaucagcaugaagccagguuugggccuauaagaacauagacagcacuguuucuccccagugugucuuuaauuuccuuuauuacagcaaaauugagaagaggcuucuggugaaaacguuuguaguucugcaggcagauaaaaggguguggauagggaucgggauuuauuuuuguuucucuucuaagaaguccucuggagguuccauuucagcgcuaccuuugccaacggaguccugcaaugacauaccagacucauuaaaggggccccauccuucuggccagucacaagguccucuugcugcagguaccagguuuauccuacguuucucucacuauggggaacugggcaggccgguuuuaauauuagauauucuaauaauguaaauaaagggcagauaauaacguccucacuaggaaacaggauucucaaguuagagaaaaaauaaguagauaauuggaugucuaauuuuuuucuucaaauagcuucuuuuuaauacuuaaacaccagugcugagacucaacaauuuaaauggccucauuucuucuuucagugcuuuggaagguacaggaacagcauuucccaccuuuuaucccaucuacguguucuaguuauugcuccaaaguagaauugguauacacagcugauuaaacaauuugaaaaaauguucugguucaugccucugccacuacacugccuuagagccuuauauuucaagaaaaugguauauucaaaaaagguuauuuucuguuaagagaaagauaacaaaaggagcuauuaaaaacuuucaacuacaucuaaccauucauaguuaugcaugauaagggaauaaaaaggaguaugaugaagaaagauguucuuuugaaacuuguauugcuggggugaaaaauggaaucguggcauaagaugugugggggaaaagauuauagcaaagauauuagcgcuaaaacagagagaccaaggaagauuagcuuuuauuuuucuauauggauauagaaauauggauauagcuuuuauauuucuauacggauauacuguugagugaacagaaaauaaacaguugaacauauauuuggauauguggucuuaaaaaguuaacucuaacuucacgaguauggccuuacaaacagacaucaaaguccuucuaggcauaaagcaugucggaggaggcaucuuuaaaaaugaaaacaaacacuucaaagaaccuaucccccggauacucucauagcuguaccaggacacacacuuguuuuuauaacuuaaaaauaaauuuuuuuuaauuauacuuuuuagaucaaugcugcauucaauuugcauguagaucuacugacauucugucugagaugaaaagauacgagacuacuugacaggcauucagaauuucuuuauaaucuccugcuucauuagguaggaaaaaacacaucaauaaucaaguauagauacuuaaaugaaagaacauuaaaaaguuggugaauuuggcuauuaaguaguccauguaauuaucuuuuauucauucauuucacagucuguguccuauauugcuuaauuacaaagaaaagaguagacugcucauguguacacuaacugcuaaauguguaagcaaacgaaugaaugauccuguucucaauccacgagaaaagaaaauauuaaugaagagaauacaaagaaggcaaaaauaggaggauauaaucaacaaaauuauuuacuacccucuuaguaaaacaugguuaugaacacauaguauaagaccuaauuuagauaacucccauacuugaucuuacucacuauauucauacuccaaguuuuuuaaaaauauauuacaucagauuuaaacaucugcaaaaaauauacuaaugaugaaaagucaauuaaugcaaggaugggagcccuagaguagccucuguauauuuucuaagaggcuaugauacuaaaacauuaaaacaacaauuuuuuuggugauuuucaguauucauauucuacaguaaaaagauuuaaauuguuuaaguauauaauuguacugauauauuaccucuauucaggugagaaaauuccuuuaucccuauuuauaaagguguucuuuuuaaauaggaaggauucacauuuaauuuuaucagauguuccuucugcaucuguugaagugaccauauaacaaguuguaaaacaaccauuuugaagcugauacuuuucaucuucuauuuaaccaagagaaaugguuucuauauauuuaugucugaaguguuuucaucuaagaaguaaauaccaaacuagguuuaaaagccuacagaucugcccuuauauggccaugcaauuuacuuuuauucauuauucuugucaagaaauauaauccucaucucuuucaugccuaagucuuuuuaaauuuuuuauuacaauauacaauauucauggaacaucaauuaaaggauguauauguauuccguuaauuuuucucaucuuuaaguuuuugcuuauauucuuuuuaguccauuugaaaccuguauacuuggaauaaaggcuuuugcaacuuguagaaugauuuuuuuccugaaacaugcuuuggugcuagcaccuagaaaugcuauaauaaacaucucuaugaauuuuaucauuacaauuuuuuuguacagauauuggugaggccaucaucuuuuauaucacacacaguguccuuuuaugagacccaugaaaaaaguuuuauuuacuuguuauccccaagaaaagcuguucaggggacacuguaaaucuuuuaagugacugugcaguuuuaaaacaugucugcaaguucuuugacccucuuucaauauaauuccuugcccuugaauuuggucucacuuuagugacucacuucuaaugcacagaaacugauacaagugaugcugcagaauguuuggagguugggauauaaaaaacaacacagauucuauuuauuucugccuguugauuuccuuucuccuccuccuacccccacuucaccucuauucucccgcccaucuuuuucuuccuucccccucucucugucucuuugucucucucucccuccuguccaacaugcuuuggagaccuuacccaacauauauaaggaguucaacuucaacuaccugagccguauagacauagagagagaugcucuaggaauaucagauuauuuguuacucuugugcgaaaggcauaauaauggcuccccaaagcuguccaugaccugauuccuagagccggugaauauguuacauuacauggcaaagggaaauuaggguuggagauggaauuaaguucacuaauuagcugcccucaggauuauccaggugguuccaaggaaaucacacaaauccuuaaaaaaggaagagggaggaaaaagagagcaguagagagauaugacuguagaagaauggucaaggagauggaaugucacugguuuuauauauggaggaaaggggccauauauaaagccaaggagccaaggaaggugggaagcuucuagauucuggaaaacgcaaggaaacagguucucuccuagaacuuccagaaaagaaugcagcuuugcuaacacugaggccugauaaugucuaugcuggacuucugaccuucagaagaguaagauaauaaauuuguauuaagucauuaaaguugugauaaauuguugcagcagcaauagaaaacuauauacccuuguuuuaagucucuaauguaagaaggcuuucuuacacauuauuuuauaaaugaaacagugaccuugcuuaauuucaguuuuggccaguaggaagcucacuuugcaguaucucuuaucuccacucuguuccuuuuuucuugauauguuuccucuccuguguugggguuauuuuuguauacuaucucaaaucuauuuuagagcagggccagaaauaaauaaauaagauuagcuaaaacaauauauaugccaugaacuaccagaacgaaugaaguagaagaaaaaaagaguuucuucucuugccucuauuaaaaacacaacaaaccccuaaaacagauaaaucacuauggagggcaucaacugaagauaaaagcaaaaauacauuuaauuaauuugauauuuucuaaaaauauggaaauauuagcucuucuguuuuucaauuuaagaacaauaaagaaaaauuuauuauccaaaauauaauuaaaaauauauguguguagguacauauguguauauguaccugcacacacacacacacacacacacacacacacacacacacacacacacacaguuucagcuuccuauuauaucugguuaaguaagaggauaaaggaaaugaaaaccagagguuaggagagaaaaacaaaaaaaaaaaaaaggaaaacgaugauuuuuaaaaguucaguguacacacacauacacagaauaacagaaccucacagagacacccaggagauagagaaucaaacaguaauacacauaaaaugcauccagaaacagacaaacauagaaagaaaacaaagauacuuucauaacaacacucccagcacaugccuuuuggagacauucucacuugagauuucuguuauuacacuagauuuuaacauucuaaacacacuaauaggaauauaaucuaucccucaccaacugcucuauaaacuugcugaauccuuccuuuuucaggucuucuaagcuucagaaaccaaauccccugaaggcagcucagccccuccagguuccugagcagagguagccacuacagaaucuauguauuaagcaaagccacaaaauguagugaccuagccacagauuccuggugcugaucuccaccuggccacaguuuuccgcucccuuucaauauuauaauuuguauauuggacacccuguugaaaucacuagcccaucucuguguuuuacuuuauuacuuuggugguaaaagaaguagcagaaaauuuuccuuauguaaggggagaagcaaaucacucuguuugucaacugaaagucagaaaaaaaaggaauaaagaugagacuuaaguguacaugaugccgccccaucaaauuugcaagcuauuuguuuacugggaauaaauguaguaggacaaaaucuugggaauucuuaaguucuguaucucauaauuaguuucuuguaucuguagaaugguuggcauuuaaugcucaugagaaguugcuuucaucauaaucaacaaacauaguacacagaauuaaguaacacuaagauauuucccuccguuugagaaaguaaggucuccuaugaucuuuggcaucaauagaaacucauuauccuugggauaguuccacccacugucacauaaauguugcaugugaauuccauuuuauaucaguagaaugcuuuauaguucauaaagcacuugugcauuaaucauauagaaagaaguugcuuucuguucaggcuguuucuauacaaguacugagcauuauuugcagauaaugugcuucacugaaacugcacugaauuguucacguaacagcuguaaaucaagauugacuuuuugaaccuaacuuugcauaauucaacaagguacucaacaucuucugccuaagcaggcucaugacuuacaagaaucugcaaagcuaaauaacuauccaugacugucucaaaaugauuaaauaacaaaaagguuuugcauuaacaaaucaggaaugagucacuuacuaauucuucucugaucaagaagugacagagaaggugccauuuacaaagagaaaugucaugaaaugauugaguugugaauuucaucgaguucccaauaauaagcaaaugaccacaaaaggaggugguagaugggggaagauaacugcuauuaaauacucguuugucaagagacaaauuuaucagaguuugggagguagauuuagucuuagcucaggagaaguaaucaguucugaggcuaaugaguauacugugcuuaaucauuucaucauauauaagacugagcagcguaaaucagaaaccuuguuaagucaguacauaguuacauggugcuuuaacauggcacaacaaugaaacuucauuauucugcugaagccuuuacuuccuuuucauauguccuuugguacaauuauuuggaaagacagugauccgcuccuccaccaaguuauuccaccaagguuauccucuuaguuuuguccugugguuuuggacaauaguaaaccuuucauuaacauguuuuuuuuuuucccuaacuugagcuucuccaaggagcagacagccuuguaccuguaaacucucauuguuuacaccacucauaaaagcaaaugauagugauauaggaaggaggaaaaggaggagagcaaauguuuaccagguucuuaccacacaucagguaauuuuucacacauuuauuauaauagcuauauagguagguuauauuauuucuacuuuacuaaggaggacagauagugagguuuggaauaguuaagaacuugcccugggucacagaaaguggcccaguaauggcauaaacuauaacauaaaacccaaacuacuuaauuaucacauuaauaauuugcauugcuagugaaguuugaagucauagaagaugguagaauugccaucacaucacuguaaccauacuggaguuaucauaccaagcuagaugagaaacuuagcccugugguuuccacaaaguuuaacuaccuaacuuuauuauuuaguuauuacaugggaauguguuuuauagcuucaauuauacccuaaguucaugaaaagcaacagcuauguuuauacacauuuaaaauuuauccuuuaguacccagcaaagugcuauccacauuaucaauauacaaugguugaaucacuaauaaauuaugugaucuuaaaauaccccauucgggccagaaaauguaccuaaaaucuagugaguguaaaauuguaauuuuucugcaggcugaggacaggagugagaguuauaauggcccugacaaugacugaagugggggaugagaggugguaacuauggaugguggaaaggagaacauaugagggauuggagaugccuaagagauacacuuuaccucauucuauauguuuugcaggaaaguuccaaauauuucuaugagaacaaaggagagaaucagagauuucccuggccugaaacauaucaggcucuccuguaaacaaauggaugucauuaaacccugagaugggaagggaugcuauuggcagcagcaaaaggaacucuucuucauugaguauaguguucagguaauuuaucccucacagucaaugacccuuuuuccugccuaacuuguucuccucucuaccuuauauuccucaucuccacaaacauuuuuucaccauguauuuuucaguuguucagauugaaauccaaagagccaccucugauuccucuguuuacuucagcccguaugucuaauccucagcuaaucuugacguguucuucagagcauauccagacuccaucuacuguaguuucuuuccauuuccauucuaucucccuggcccgagucaccaucauugcuucccuggguuacuacagaacccccacacuggugccaaugaucacuuaaacauauuaaucaaaucaugucaccugccuguuuuaaacccucucguggcuuccuaucuuacuuaaaguaaaauauaagcucugccauggucuagaauuuacauagucugauccuagugcauucucuagccucaucucccacuacacuccacuucauauccaccagaggaccccuuuuucccuuacucagacagaccaaucucauuagcaccuuaagguccugcuuuucucgcuaccuuaaauacagacccuauguucucacaggacuacaucuuucuucuacuccuuucuucuagccugggucgacuucccugacuaccugaacccucaugcacaccuaccccacugaaaccagucaauggcuagccccacacccccuucuauuuucuucagaguacuugccauuaccauuuauuuauuuauguguguggucugccuuuauguccuauuucuggccuccacaucccuacacuacuguugcauacagacucacgagaguggggauucuuaucgauguccacguugccuagaacaacaccaguuacauaauaagagcugaauaacuauuucuagaucgaaugaaucccaacagaagucuuagauguuuaagcccuuucugaaaucgcugcuucagaaucuacuuuccuaguguguauuuauugagaaugcaguuuuuuuuuucuuuuuuugagauggagucucacucugucgcccaggcuggagugcaguggcaagaucucagcucacugcaagcuccgccuuuuggguucgugccauucuccugccucagccuccugaguagcugggacuacaggcgcccacuaccaugccaggugauuuuuuuguauuuuuaaguagagacgggguuucaccauguuagccaggauggucucgaucuccugaccucgugaucuacccaccucggccucccaaagugcugggauuauaggcgugagccaauggucccagcucaagaaugcaguuuuuacauucuccagugacauuugagaaaauauuugauauuuuugccuuugcaaaaaaaggggaaaauaugucaccuacauuuuccuuguacacacuguuuuaauacugagguacucccuaugggaaucuaaccucagaauuauaacauggggaugagagagauaauugaaagaauaggguaaaaaauuccauguugccuuucuggagaaugcaauagaauuugcgagcaugauauaugaccauacaugccugcaauaggagggugaaccugcaaaaauguuauuucagaauauuacaucgcaaagagcucuaacucucuuuaguuuugccacaggguuuugaagauugcuauuacugugcuuacuugaaacauaaucacaaauaagaagcauguggaaacgacagcuauauuaacuuuaucauguacaguuaaguauucaacacacuugaaagcacugcuccuucauuuucauagugugcuacacagagaaacagaccuaaaggaagagccugguggagacauagcuggacugaggugaacaagguaauaaccagaugcccaaauacuggagggggguaaugaggcagugauuaaacacuggguucucuggcuccuugaauaccaccuugaacagagauacaugaucuagaacuaccccaggcagauauaacuggagggaagguucaguuaaguuugugagguuuguuuuuccacuuucuuuaaagaaaccaucucugcuccucaccuauuucuuucucccugcucucaggcacuucacucugaauauccuacucacacaacagagaaggcauuaaauuaagcccucuuaugauauuaaacaagagaaauuauaugaugcuuuuauaaaagguaugugcuuuuuuaacacagggcucaagaaaauuuucuuuaaacucuuugguguugcuuuaugcguuucaucauugaugcucagccuauuccaggcuguauaggcuguugguuuaggagauguuuccaauuuccucucaaaucuuaauccauggauaaugccugugggcucuaacuuuuuagaaaacuggcucugaucccagagacucuuuuuauauaaggagaaaguacagauuuucccuuuucagauuuauuuuccuauuaaugaugaaaacaaacacagaaaaagaaagacaauaaaaaauggaaaacacugaucuuaguuacuuuuugucuuuugcuagcuuuugaauuugucuggucuugcuucucuaguucuuuuaauugugauguuagggugucgauuuuagaucuuuccugcuuucuccugugggcauuuagugcuauaaauuucccucuaaacaccgcauuagcuguguccagagauucugguacguuguuucuuuguucuuauugguuucaaagaacuuauuuauuucugccguaauuucauuauuuacccaguagucauucaggagcagguuguucaguuuccauguaguugggugguuuugaggggguuucuuaauccugaguccuaauuugauuguacuguggucugagagacugcuuguuaugauuucuauucuuuugcauuugcugaggaguguuuuacuuccaaucauguugucaauuuuagaauaagugugauguggugcugagaagaauguacauuuuguugauuugggguggagaguucuguagaugucuauaagguccacuugguccagagcugaguucaaguccugaauaucauuguuaauuuucugucucauugaucuaauauugacagugggagauguuuccaauuuucucucaaaucuuacuccauggauaaugucugugggcucuaacuuuuuagaaggcuggaucugaucccagagacucuuuguauauaagaagaaaguauagguuuucccucuucagauuuauuuucauaauuaaugaugaagacuuuaacacuaaagucuucuacuauuauugugugggagucuaagucuccuuguaggucucuaagaacuugcuuuaugaaucuggguguuccuguauugcaugcauauaaauuuaggauaguuagcucuucuuauugcauugaucccuuuaccauuauguaaugaccuucuuugucuuuuuugauauuuguuggcuuaaagucuguuuuaucagagaccaggauugcaaccacugcuuuuuuugcuuuccauuugcuugguaaauauuccuccauaccuuuauuuugagccuaugugugucuuugcauguaagaugggucuccuaaauauagcacacugauaagucuugacucuuuauccaauuugccagucugugucuuuuaacgggggcauuuagcccaucuacauuuaagguuaauauuuuuaugugugaauuugauccugucauuaugauaauagcugguuauuuugcccauuaguugaugcaguuccuucauaguguugauggucuuuacgauuuguuauguuuuuucaguggcugguacugguuguuccuuuacauguuuagugcuuccuucaggagcucuuguagggcaggccugguggugacaaaaucucucaucauuugcuugucuguaaaggauuuuaauucucuuuugcuuaugaagcuuaguuugggugaauaugaaauuuuggguugaaaauucuuuucuuuaagaauguugaauauuguccaccacucucuucuggcuuguaggguuucugcagagagauccacuauuagucugaugggcuucccuuugugaguaacccgaccuuucucucuggcugcccuuuacauuuucuccuuuuguucaauuuuggugaaucugacaauuacgugucuuggaguugcucuucucgaggaguaucuuugugguguucucuguauuuccugaauuugaauguugaucugucuugcuagguuggggaaguuuuccuggauaauauccugaagaguguuuuccaucuugguuccauucuccccaccacuuucagguacaccaaaaaauugcuaugcacaucaagcuacuacuguugacuuucuucacagaauuagaaaaaaaugacuuuaaauuucauauggaaccaaaaagggcacauacagcuaagacaauccuaagcaaaaagaacaaagcuggaagcaucaugcuaccugaguucaaacuauacuacaaggcuacaguaaccaaaacagcaugguacugguaccaaaacagauauauagaccaauggaacagaaccgaggccucagaaauaaugccacacaucuacaaccaucugaucuuugacaaaccugacaaaagcaagcaauggggaaaggauucccuauuuaauaaauggugaugggcaaacuggcuagccauaugcagaaaacugaaacuggaccccuuccuuacaacuuauacaaaaauuaacucaagauggauuaaagacuuaaacguaagaccuaaaaccauaaaaacccuagaagaaaaccuaggcaacacuauucaggacauaggcaugagcaaagacuucaugacuaaaacaccaaaagcaauggcaacagaagccaaaauugacaaaugggaucuaauuaaacuaaagagcuucugcacagcaaaagaaacuaucaucagagugaacaggcaaccuacagaaugggagaaaacuuuugcagucuauccaucugacaaagggcuaauaucaagaaucuacaagaaauguaaacaaauuaacaagaaaaaaacaaacaaccccaccaaaaggugggcaaaggauaugaauagacacuugccaaaagaauacauuuauguggccaacaaacacauggaaaaaagcucaucaucacuggucauuagagaaaugcaaaucaaaacugcaaugagauaccaucucacaccaguuagaauggcaaucauuaaaaagucaggaaacaacagaugcuggggaggauguggagaaauaggaacacuuuuacacuguuggugggaguguaaauuaguucaaccauuguggaagacaguguggugauuccucaaggaucuagaaccagaaaugccauuugacccaaccaucccauuacuggguauauacccaaaggauuauagaucauucuacuauaaagacacaugcacacacauguuuauuacagcacuguuaaaacagcaaaggcuuggaaccaacccaaauuccuaucaaugauagacuagauaaagaaaaugugguacauauacaccauggaauacuaugcagccaugaaaaacaugauuucauguccugugcagggacauggaugaagcuggauaccaucauucucagcaaacuaacacaggaacagaaaaccaaacagaaaacugcauguucuuacucauaagugggaguugaacaaugagaacacaugaacaaacggaggggaacaucacacaccagggccgguaggggguuugagggcuagcggggguuagcauuaggagaaauaucuaauguagaugacagguugaugggugcagcaaaccaccauggcacguguacaucuauguaacaaaccugcauguucugcacacguauccuagaaauuaaaguauaauagaaaaagaaaagaaaacauuacgcuaagugaaaaaagccaaaaauaaaagugcauacagugucaugugacuagagauaaagguaggguggugaugugaauauaugugaagaucccuucucaggcugugaauauggcauuaagaggagugggcgugggccacuggguuuauguacacccaguuuggguggcacaguuugggggugaagaggcuuacagaguaagugacuccaguucaaagagcuuauguaucugaaggcaguuuccggguacuccaagcuuaggcgggauucacacuucuaagacuuaaugucaacaguuucuauuggaugacugcagucauucuaccccagaugucacaaaauugcuuauauuucaugauuuuugaguuaaaagauggcaauauuuuaugguucaacccccauacaacugggaauaagaaugggaguaggagaaaggucacuuuuugacucauuauacuucgcaaagccagcuaagcuuggcuuauaccaccaaguucuuguuugugaagauacaaaacccauuuuauaccuuauacuauguccuggcagaagaggcauguuaugcuuucacaguaguaucucagccucugcuggaucuuccuucagugaaucuugucucaguuucaacuguguuaagaaggaugcauacaaagccacugccaauuucuacaagaacuucacauacaccaagcaacagaacuucaaagacuuacugaaacauuugaaagucauaugaaguggccucuguucccugaguggccuuuuuuaucuccuuggucccccuaacccuaucucucucccauucaugcuccucacaccuuccucccaggccucauucuaaguuccucucccaguaugcauaucaguucagcucuuccuggcuuccaaacucccaauuuucguguuaucgucugucagguacauggcaaaacaacuuaauaggaucuaccauccuuaaaaggcagucaggguuaucaauaaaugauucaauacacauuuauggcauacuaaucuguguucagcauuauguuagauucuaguagggagggagggguaucaaacaauguccgcaaaugccuccuggcugagaaauucagucuaguugggaggcaaguauuucauaauaaaagccauacagcuaagggauacauaaaaguagagcugaggccucaagagggaugguggaaaaagugcagugugacagcauuuucugagcuagacuggacaggaaacacauuucuuuacugaaaauauguuuccaauaacuacccuuucuccaaaugaaacaacaagaaauccaaacauacccuccaaaacuauucaucuauguaugccacuacagcuuaugcauuugaauaagguaagcacugacggaguuucugauuaaaaagauaacugaucuugugcacaauauucaauauuugggcgauggguacaguaaaagcccagacuucacugccaugcaauauauccauguaacaaaacugcacuuuuacccccuaaaucuacaaaacaauacaaaaauaguugcucuuuuuuuaauggucaccuaaggggaagaauaucguuaaauguaauaugcaguuccuaccagaagaugagauagcagggagugagauagaaugaagauauuaauguuggauccuuuuauaugcaaauaauuuuucuugacucuaucaugaaguuugaauauaccaaaaauuuaagcuucuaauaguacagauucugcaacugacuuccggaccacuucacauaugaacauacaaaugacaggcagacucuauuugccacugagaagcuaaguuuacauugcuaaauccucuaaagcagaaaauagagcucccaaagcugacuucuaaagguagaagaaaguauagagaaguaguuuucaaccaugguuauauaugagaguuaccuggagaguuuuuagaaugccugauccuagggcaucaccccugggauucugauuuaacuggucugaaaugggaccaagacuuuuugugucccagggaagcuuuuacaaauuaccgaucccugggcugcauuccuggguguuuccaauuaaguuguucugaagugacuuccagaaaucuguguuuuucagugucccaagagcuuccauguuuggccagauuuuuaaaaccauugaucuaaugcaaaauugcaaaaaaaaaaaaaaaaaucaguuguuucuaaaauuguaaagcgaguacacagggaauaaaaaaaaaaguaauaagauuuuuugugcuguggcacgaagucuguucuacggccccaacuacuucacaauuuccugggucaccuguaaaguuaguguugacaacagcaugaagcacugaaugaagcuccccuuccugaaccuucaucccuaggaagguaagccaaaugacuuuuacugucucccuguuuauggaagauaacaaauauauguccuuuagaaaagcaugccuauaauuaagcagucaucuaggcuggcaguaggguacagcucagugacuaucuuuaaacaaaauguggguaucucgcuguauucauugcaucaacaauagaacauagcaggcuguuagaaaagcucccaagugcagcaaaagagggcuuacacagaaaagacuguugaaguucugacacagcaaaagaagggaacccaaugcuauauuuugcuaaaagguaaaacacauucugacauuauauacucaugugggcaaaacaguaguacuacauuacuacaccauugacugagagagucuccuuaucuggaaauaagggagaucuaauuccagagauaucacagugggauaaccauuuaaaaaguuaaaauaauguggcucauuccuguaaucccagcacuuugggaggccgaggugggaggaucaugaggucaggaguuucagaccagccuggccaacauagugaaaccccgucccuacuaaaaauacaaaaaaauuagccaggcaugguggcaggugccuguaauccuagcuuauugggagggugaggcaggagaauugcuugaaccugggaguuggagcuugcagugagccaagauugcaccacugcacuccagccugggcaacagagcuagacuccaucucaaaaaaaaaaaaaaaguuaaaauaaacauuuauauaacaacauagacaaauaaaaacaauuccaaauaugcauauuugaugguuauucauuaguaaucaaaaaauuauaaaaucucagaaauagaaaggaucuucagagaucucauucagccacucagccacccaacagaaugaaggauaacugcacugaaguuuauagauuuccaauaagcauuggcacaucaagauagacuaaggguuaagggaucugaguuuuacuucauuaggcagcuauggaaacuugggaagucacauaauuuuucaggccuuaaucuccucaucuauaacgugagugcgaaugaacugaacucagcuuugauguucugucaucaagguaugcaaauguaugucacucucuuuuaguaaaucaauaaugaaacaaacacaacaaacaacaaccugaaguaauuuaccuggcuaucaggaaauaccugaggugucaugggaaagaaaaaccacaagauucuguuuuauuuacuaguuggcuuggggaaaaaaaaugaaagaacuugcaaagucuuuaugauuaauaugcuuauaaguggugguuuaaucacagccacauugcuugcugauagugugcugcaugaaggaagacagccugauaaaauucuuaggggaccaaucaucacugcugacauucauccagcaugacagaagaaaucacuacuauugagaguuaugcucagcauaaucagugauaauacucucuuuaaaauggaaguaagaaccuagaguaacaauaccccuuuagguuaaaugcaucucucagaagagugguuugugcauuucgcaucuccagcauaaguaaaacauauuuuuauccagaaaccuacugggagaaacaucccauauucagggauauucuguugauggcaguauuauggcuauucaguauaucagcugaagcaccacaaaguaacaugccauauaacuucuguugcucagcauaauuucuuucuaaaucuucauuuaucugcagcuauugugacugucugggaaaacuauagauggucucaaauaucuuccuauucuuuggaggucuucugaaugaacaguaucugugauccuuuugcuuuacacaaacaaaagacaucucuucaguuauuaaguaacgguuugaaauucuuauaauuauauuaaugcauuuaagcauauagucaauguuugcuuuaugcuucauaguucuauuuagagaauaaugcaggauauuuauugucgaaugagagacaagggguuuaaacuugugaguaauauaaauaaaucacaaucugguuuuauuuacugcauucauucucagcagacuuaauugaaauaccuuuaugcuuuucaaguuuuuccuguaugucuucccuauugagaaagugaaaucuaauauuaaguaauguuccuucagaguccaugcacagaagaacacaaacgaaaaucaugaacucaauucaauaacugaaugcaucugcaaguuucuuagcuugugacagugugguaacaaauucuaauucauugggcuuuuuuguucuuccuccacagaauuauggauguacuggggagcucaauuuuugucaaaacgaaacagcuauccuuuaguacauuuaaaaagaaaucauacccuaguuaaaggacugaaaaauaagcugaaaaaacacaacugaauauuaaaucuguuuugucaguuuuguuuuaguguacagaaucuguugguaauaaaacaauuuguuaauugguugcucuagguuauuugguggcuaaccuaauaaauucuacuucuaaaguauaagcucaccacuuauuuuugucaauuaauuacauuucauucaagaguuaaguuucuugcaauaaauauuaacauaaugugggaagauuuuauaauuuuccaacugacugggaaucuuugacaaccaaaugcugaacuuaaauugaagaauaacucaauaggaaauacacaauagcagugucaagauuuacaacaaauacacuggaaguguuuuaaaaauuaauaguaggcugcuaugcuuggcuuaauuagcuuucuuuuucauguacaaagcauaucugucuaguuuuacgaacuuggucuccaguccccuuuccuaaaaaccuguuuaauuaaaguuuaacugcuguguacgcuuuagaaacagcagaaugauuuuuucucccuugaaauacuuaauccuuucucaaaauaugauccuucugaauauauauuuaaaaggcaaggggugaggaaugaauaaucuuccaacagacaaacacugacaguuuagcucaucaguuccagguauggguagacugaaaauugucucccaggccaccaagaaauccaaaaccaacauuuggcaugagcagauuuuuguucuucaaaaauaaaaugucagauagagaaaaugacaaaugaguaaauagaaaauuaaguagaaagaaggcuacaaaauacuauaaaaacacuauacuuaaugauuuuuguaagacuuuuccauauacugcuauagauauccagcacccaaguaauaugacaaauaaggcaaugccagcuaucuuuaucagugacuugcaaagucaguguaauacuuuauuaucaaacaugcaaauauuuuaaaaauaaugacauauauugaccacacaaucucugaaaugaagacaacaauuaaaggacagauggaugugaugaaucccugaacaguauaccuuuacuuaugagacuaaaaaguaauacuaauagaaauuuaguucaggaucacuagcuaaggcauacaguuucacgcugucccaacuccagauuucucuccuccaaggguuucuccagcaaugcuggcaugacuacugugcaggaaaauaucauagguauuuuuaggcccuuuugacagucagcuccuugaaaagagaguuucugacuuagccucacauucccuacuguggucuguuugugguacaugcucauucgauguguguugaauaugcaccuugauacaagugcaaaaccaauucauuuuuaagagaacucuaaaaaagacuuuaguagaguguauccuuguucaaaauauuuguuucccaucccugacagagggauaggugaguacaugcccacccuguugauuucagacuuggucaugcagcggcuucuuuuggccaaugacauguauguggaaauaauacaugccacuuuugaguagaagcuuaagauccaucccaucguuccaccaugcuuuuguucuccaucuccccugagacuauuaauaccuugauagcuuuauucccugcaggaaaaaaaauauggagcagagccucaugcaacccauggggaacauauaauggagcaagaaaccagccucuauuaacugcaggcuauugagauguggggguaggguguuaccacagaagaaguuagucuaagcugacugacacggggcccauuuaagacuuuucaauaauaaacaagcauauccucauccccuuugcuaugcagggacaaucccugcagcacuuaugcugcuggagagagaaaaaugaaaacagauggcugagacucauguucuuuacuacuugcuuuccuuaaccuucagcaacaugaaaaacuaauguucagcaaauuagagaguuuacauuuuuaaagauaaggaguugggauugguacuaauuggacuaaguugaaauauuuccaaaauaaauagaaucauuucacagagugauacucaggauugaaguuuuauaaauauugcagagagcuuucugcagucauuaaauuugacaaauacuuagugagcaaacccuugguaugcuagauuucauaaggcaggauuguucugggcuccaaaaauaagucauugcuccggaccucagggagcucacagauagagaaacacauguacuacucguucuaauauaaucagauguauguuacgucugucagaucaauaaaguauuauggaaucagagaagaggacaaucauuccugucaggguaaggauacaggauguucuuagauggauggggauggagaaggaucugccacauucaggauaaaacaugaacacaagaagauaagcaugaaaguauuuuuuaaaucuggaauaguauagcucaagcacauagagugugugugugugcgcgcgcacgugugugugugcgcguguguguguaaaacagagagagacagagagagaaugagaauguaggcaggguccugaggauuaaagaguauacacugaaaaaucucccucauucuccugacccuccaguuccuucucuaaaggcgaaguuacucauuuacuacuaacuacuaguuaguuaccaguuuagauuacaaagaaaguggaaguggacucuuagaaaaaugacugggauggaaguggcagucagaaucugacacuuuauguuaacuaauuccagagacaguuuacucauauacaaguguauggguguuuguguguguguauauguauguguguacauauagauccuuuucucuuaaccauccuagagaaauucuaacuuaugaauguacuauaauguccuuaacugcacugacauacauuuagaauguuuucuguccuuugcucuuauaaauaauguuauaauuaacucccuuauacacauuccuuugcaaucaugugaaaauauaccuaccugauaaauuacuagaaaugaaaaugcugaguaggaauucgccaggcaaaaacaaaacaaagggaacaagacaaaaggaaggugcuuucuacaaaggcaacgguaugcaaaacguuacauagcugccaagaaaaugcaaacuauagguauggccagagacaguggggagaauguggcuggagggauacuccgaggccagauugugaggggccgcaucugcagggcuccuguuuauggaaggcauaaugagauuaacauuuuuuaaaaagcaggaaugcauaauaagauuaacauuuuuaaaaaagcauucuuguggaagugugaagaauggauuggcauggguaagaaagggaaaucaguuaggaugcagccacaguaauccggggaggaaauaaugaaggccugguaacccaucuuccugggcucugugaaggaaaauacccaccucgcuugcuucuugcacuuucccuuuuugggagaccucaaaggccagugguuaacaugccucacgguaaaguaucugccacugagcaugacucagcuaugggauccaccccuguaccccggagugggagaacagucuuccuucuaccaaaauguauguacugacagcuuccacuuuuucuauagaaaaaguaauuauuauagaauuuaggagcuggaagacauggaaaucauuuaguccaaagguccucagauuauugucagccgcuuuccauuuuucuaaagccuuguaaucacggagaggucagagauugagaaaaaaguggaaaugaacuccuaaagaaacaauuaggguggagguugugagcagaaucagacccuuuacuuuaaaguacccaaagggaauaggaggaccugacaccaugguguguuuucccaccaaacauuccaaccaaaauccuaaugcugggaauuuaagcuuaagcacggagacaguggcagcucacuugaagacgacuuugagauuugugaucuagaauguuccaaccuauccugugggaagauagcaccauuuuauaccugauuaaaccaaaauguaaacaaauuaaaccacucaccucaaauucaagcaguuaauuggugagaggccaaauacgaaaacagguucucaaauuucagcaugcaucagaaucaccuggagugccuguuaaaaccuagauuucugggccccaucuccaaaguuuccgauucaaaguggagagagugagaaucaauaauguauuaaauacauuucuaacaaguucccugcugacucugaugcuucugaucacacuuagagaaacaaucuacuacaacaaugccacccuucaugugguaguuacguugccuauagaauguauauagacauauauaugguccucuacaauaaaguauuucuagguuuuuuaaauuuaaaauauugagacaaauauauugcaacauuuacaguaaacucccaugucucuauaucucuaaaacccaauagauuaauauuaacucacuaauaacuacaaaaccaacagguaaauguaucaaaguuaugccagauguuucaauuucuagaguucuacuucagggaucuaaaaccaccaaaaauaagauuauauaacuuaaaaauuauuuuaccuuuguuucuuuaaauaaucuaugagaaugaguagaacuaaaaggcaaaucacaaacugaagauauauuugaucuaaauaugacacgacauuaacauauuaaaacuguuaagaaaacauuuaauaccuuuuuuuuuuuuuuuuuuuugagacggagucucgcucugucacccaggcuggagugcaguggcgcaaucucgacucacugcaggcucugccuuucagguucacaccauucuccugccucagccucccgaguagcugggacuacaggcgcccgccaccacacccggcuaauuuuuuguauuuuuaguagagauggaguuucaccguguuagucaggauggucucgauacccugaccucgugaucugccugcuucggccucccaaagugcugggauuacaggcgugagccaccgcgccuggccuaauaccauuuuuuaaaauggacaauucuggaauagcuuuuacaaaaggaaauaaaaggauaauaaaugcauaaaauauucauucuuuuagcaaugaaaauaauacaaacuaaaacaacaauaagaauuuuuuucaccuuucauauuagcaaagauuaaaaugauuugaauacucauuaguggcuuacucuacagugaaauuuucguacaucgcuggggaacuuucauuaucauaaccuccuugauuuccuuccacuuuauuguuaaggauguugcagguuuuaauaaaaaauaggcauuauuuuuugaaagucaugugagaauacuagggcucaggaacauuauaaagcuaggagucauuucaauuaccaucaugcaguaaacauucucuugauuuuaaugauagcuguauuagauuuagaauucaggcuucauuuacauaauccucaaaagacggccccagaaauccauuaaaggucaccuuacuuucccauacauaaaccaaauucuaaucuguucauuggucuccucaaaagcauauuccaggguuuuguaaagcuuacugcuuauuauacuuucaucucaaauagaaaaucuuuccauuuuggcuuuccauccuacuaaacuccauuccaguauguauuacucacuccucuucauguuacaguaaaagauuaaauagucguuuacuuuuugauguauguaaaauugaaaucuaggcuucagaaguauucuuuggaaguaucaguacaccuagagcugaagcagcgugggaugcagcaauuuucacugucugcuccuggcuucauauuaaaaucagguaucacacaguggucagggaauauaauuuauuuguguaauaaacaaaguagaaaaucucuuugauucccagauguccaguugcagagcccaaaguuaaugacuugcugcucuccauaccccaaauauacagguuucacuacacaauuuacucuucugaaagaaaauaucaacaacugucagcccccuaaauaaggaaaaacauuuaaucauuuucacucaaauucucauuugaaucccaaccaggaggaugaucaauuucaaaaucugauuaguucugcugaggagaaccauucagacucucaugcaagauuacuuugcagaagaaaacuagagauacuuuuuuuaaaaaauagaaaucuaucauuaauauuucuuucaauaaacauuuuccaacucuauaaaacagcaaacagauuuuaguuucauaucaacauuuaaauauggaaauaauuacugcuuguuccugacacuauuacauacauagguaucacucacaauguguuagauaauauuugaauauuuucuauaacaaugaaugaauugaggaauuaaauugcuuuuuuaaaaguuauuagcuccauuuucucucuacuauugguuugguccagcacagucagagcaagcuaaaauagccaccaaaacauaacuggaguugggcugggcuuauaaaagaagcuauaaauaacauggaauaguauucugauacagaauuuucucaacugcagcuauuccuuuuguguuaagaagaaacuguuugggcaaugaaauuuaguauucuuuuuugugagcuuugucacugcucuccaguuaaggugcuaugcaguguucuuguaguauaauagcucuucccccuugugauauuaauuuuaggugccaauuuaacuggauuaaaaauuacuaagagaacugguaaagguuuauuucugagugugucucugcagguguuuccagaagagauuggcuuugagucagugaacuaaguggggugaauccacccucaacguggacgggcaucauccaaugagcugggggcuuggauguaacacaaaugcaauuuccucucucuccuagagcuaggauauacucuucuccuguccuucaacaacagaacuccaggcucuuuggcauuugcaccccacaacuuacaccacugcuccccugcccccaccagguucucaggccucuggccucagauugagaguuacaccguuggcuucccuuguuuugagacauuucggcuuagacugagccaugcuaugggcacuucagggucuccagcuugcagguggccuguuauggcaguucucagccuccauaaucacaugagccaauucuccuaauaaauccccucucauauaucuguacaucauauauauguauugguuuugucucucugaagaacucuaguauauccauccaacuuaagacauauaucuucauggucuagguguacccaugugguuucuagcaauucaggaaaaucucacuuaaauuaacaacucaauauuuucucuuuuguugcucucugccucaaccaauauauaacuaacaaauccauggcuuuuagacuaauuccucucuucuguuuaaacuguuggccaagacuaaaaauaaguuuuguauuuucuacugauuuccaaguuaaggaaaugaaaguagauaauauagcccacaggucagcaaaacuacagccuauggaccaaaucuaguccaacaucuguuuuuguacauaaacuuuuauugggaauuuauuuauuuuauguguugccuaugguuguuuucaugcuacaauaucagaguugaauagauuucucagauaguauggccugcaaaaccaagccuauauacugucugucuuuuuaaagagaaaguaugcugaucucugcugcagagacaagaaaaauauauuaaaaaaacaguaagugcaauuucuugccaacacgucgcaauaugcaggaagaagcagguuaagauuagaaagauacaguagauagcauuugaguacuuccauggaaaguuuuaaaaguauuuacacuagaagucuaacacccaccauuaugcaauauacccauguaagaaacaagcacauauacccuaugaaucuaaaauaaaaauuuuuaaauccccugaauaaugagggaaaaaaguguuuuuguauacuuuugcuuauguugcaggcugcaugaaaucauugcaaaaaccacugucaugaagcuauuucacuacguuucuuucuagacguugcacauuuucaggucuuacuuuuuaaucuaaucaacuuugaguugauuuuuugugugguguaagauaaagguacaauuucauucuucugugucuggauauccagguuuuuucaacaucauuuguuaaagagacugacuuuuccccauuguguauucuuggcacccuucucaaagaucaauugacuguauaugcauggguuucucucagugucucuauucuguuucauuggucuauagguauguuucuaugccaguaccauauuguuguaauuacuguagcuuuguaacauauuuugaaaucagaaaauauguugccuccaauuuuguuauucuuugucaagaagaaaaggauauacuguuguuuggguuauucaggguacacuguugguuagaaugcaaagugguucagcuucuauggaaaacacuauggagguucuucaaaaaauuaaaaauagaacuaccauauaugauccagcaauucuacuuuuggauauauauccaaaaaaauuaaaaugagaauaucaaagaaauauuagccuucccauguucuuugcaacauucuucacaauagccaagauauagaaucaacuuacugacaaugagggguagaaugauauaguaaugguguguuauacuuggaguagcaugacaggaagugcagucccagcucuguuccuuacaaagcuguugaguucuaugaguuugauguauuuuuaaccauuuccguagacagaugaauggauacacaaaauguggcauauauauauauauauauauauauauauauguauauauaugcaccaaguucauguauauauaugccaaauauauauauauaugaacuucaaauauuuuucaaguauuaguaaaagggaauccugucacaugcaacaacaugaaugaaccucgacaguauuaugcugaguuaagccaguuacagagggacaaacacugcaugaucccacuuacaugaaguaucuaaaccacucaaacucauagaaacagagaguagaaggggguuaccaggagcugggggagguggugauggggaguugguaaucaaugaguauaaaauuagguuaagcaagaugaauaaguucuagagaucucuguacaacauugugccuauaguaaacaauacuguauugcacauuuaaaaaucuuucaagaggguagaucucauauaaaguauugaaaucacaauaaaaaaauuaaauuaaaaaaacuuuuaauuuguuuguuucuuccaacuuuacaauuuacaaaauuuagagcuauucauuaaccugggagaacauucauauuauuucaacaaucauaacaaaaauuugauaaucuaaaauaggcaaggcauucuguuaagcucugaagaagccaaacggaaaauuagucaauaauaaauuaaauguucauuguguguuaaagcucacaaaguauugcugcauguauauaugguguguguguguguguguguguguauguguguguguguauacauauauauauuuaauuuuauuuggucuucaaaauaauccagaaaauagagagauacaaauacaucaaacucagaaaucaauaacuuugccaagguuacacagcuuuguauggaacacagcagggacugaacuuccuauugccuuacuccaagcauaauaacaccaucuacuauaucaugcuauucuucauuguccauaaacagcuaaaaaaucuuuuauacacuuuuuuaauaaaaauguaaaagcauccauaacuaauuaaaucaauaacuugaauguaucuguucccuacauaaaauucuuccucccaauaucuuaaaagagaaaccccggucaacguuaaguuaaacaagguuaacugaaguugcacaaaaauagaagagcuguuucuuaauauuaaguaacuguucaggcugaaauauucaagacucuuucugacaugcuucugaagcucagcuaaaaacaguggguauuuuaaaagacaauuuguaagcuucuuacugagauaauuauacuuacauguccuuuccaaauacuugacagacuuacauuaccauugacagagaaaaaaaacauaaauuaauauuuagaucaaaggaagguacaaaaguuacuguuucucuauaucacuacuuggaguucauaccuuuagaaaguuaugcuacuaagagauguaauugagccagcaguaaagaaggcuaauuaacccauuuaugcuagaguuugcgauuuuuugaacuuuugcaugagugaaaaaucagacguuggcaauaaccuucaggaguaguacauaaaaaacucccacacauuuagcauuccaauaauggaacacugggcauaaguggguuaauacacaaaugcacuaaccagcuccaagugugaucugcuuccugcuaggaaacaccagacuccaaaggagaacuucauaauguccaucuguauugggggaaaagcugagguucaugguagaacuaaggaguaauguuccaaagccaguccaagaagugggaaagaaguuuugucaaaaguaucaaaaguuagaaacugauuaccaucuucagauagaggcauggagauguggauaaggauaaagcuggauuagucauccugcuaggcucuguguugaagagauucuuccuauuuaagcuaagucaauguguuucccaucuuagguaccucaguuauuuuagcccauggacuaccuagagaggacaugaugguucuaauauuucauuuuagauauagugaguuuaauauaaaaaauauugaauaaugaggacacuauucaauauucauucuccuucccuuacuuuucuguacauuugucuagaucacauaucauugcuacccaauaauauagucaugauaucuugguguaugcuacugcuaguacgauuccaagacuuacuaagcaggcaauucuggaauugucaugucuuccaauaccuaccuagcaaagguaugcuaguguaacagauauggggaacuccccacagauaaacaucugauuccuuagaaauauauuucaagugcauauuuucauuuuggaauauucaagauaaaaucugguauaaaaucaacauuuuucuaaucuuuuuuuauauacuuuaaguucugggguacaugugcugaaugggcaguuuuguuacauagguauauacaugccauggugguuugcugcaaccaucagcccaucaccuacauuaguuauuucuccuagugcugucccucuccuugucccccaccccccgacaggccccagugugugauguuccccuccccuguauccauguguucucauuguucagccaccacuuaaugagugagaacaugcgguguuugguuuucgguucuuguguuaguuugcugagaaugaugguuuccagcuucauccaugucccugcaaaggacaugaacucauccuuuuuuauggcugcauagcauuccaugguguauaugugccacauuuucuuaauucagucuaucauugaugggcauuuagguugguuccaagucuuugcuauuguaaauagugccacaauaaacauauaugugcaugugucuuuacaguagaaugauccauaauccuuuggguauauacccaggaaugggauugcgggucaaauaguauuucugguucuagauccuucaggaaucgccacacugucuaccacaaugguugaacuaauuuacacucccaccaacaguguaaaagcauuucuauuucuccacauccucuccagcaucuguuguuuccugacuuuuuaaugaucgccauucuaagugacgugagaugguaucucauugugguuuuuacuugcauuucucugaugaccagugaugaugagcuuuuuucacauguuuguuggcugcauaaaugucuucuuuugagaagugucuguucauauccuucgcccacuuuuugaugguguuguuugccuaaucuuuucagugugacauagacuagaagaauauauaccagacauaugucuggaggugugauuagcgagagagaaaugagaccuuuucuuuuuauguuuuaugcuuuaguguuguuugaauuuucccuacuaagcacacauuauuuuugcaauuaagaaggaggcuacagaucuccuucucaucugaaacuccuacacaaaauuugucuccaacacagcugggccacucaggcccaccagauguuccugcuaagcuccagggguuuuagugcaucuucauaguggcaauucucuuguuauauuccuuuucuuuuguugccuuuguugucuuuccaccagacuauaaacuuuaaaagggcaagaauuaaucuuuggcuuuuaauauuuauaaucccagagacaggaacaguguuuaacacacaggaaauauucaaggcacucaauaaaucaugauuaaaucacaacaaaaacuaucacuaucugauacuuacugaacacauuuaagagccaggcacuguguuaaccaaauuauauccauuauuucauauaauucucaagaaagcaccguggaguauacacuauuacaauuuccauuuuauugaugaggaagauuuaauuuacagaguuaaguaauuugccaaaguggcaaagcugggaucugaaccaaggcaguuugaguucauaguuugugcucauggcuucuacaucacaccaaauaaauaacuaggcacaaauaaauaaacaugcaagauuuucauagcuaaagaugaacucuauucacgagagauagguggacuaagguagaaaauaaaaccauucaaggaaaccacugacagggguggggagaguaucacaaaaauaggugucaccauuauuggaaaaagcaauucaaucuaaauggccuaaugacuuucuacagcugucacacaugaaagcguaugcccuauguuugauguauugccuccagaaaccucccuauacugcuaaacuguuuacacaaauaaugcguuuuuuaaucgacauuuuucacauuuauuaaucuugauauaaaaucaagauucuauauauaaucuuaaauauauguaaagagacuauauaugaacuuaaggugacuaucucucuggugauuagaaacaaauaccuauugcuaagacauacaguuuuuauuaacaauuccauuuuuauucacugauacagcaauaguauggaaaauaauccaccuacaacuuuagaaaagaaagaaauauuuccauaaagguauagguugucuacuaaucuaugauucuucaguaaggaaaaauuauaauucuuuaacaagaaaaagguaagaauauccauaauacacuaauaauuucuagagguaacaucagagggauacugaugauuuuucacaaauggcucuuauuuggugacaacuaaacccuuguacagagccuaagacauuuaauuguacugcucaaucccuugucuauuaaacagcagcaucggucagaccccaagcaguaaagacagguguacaauacuauuuuaauuugggaaaauucaguguucaaauuaaaccaggcuaaagggcuucaaagauuucugaacaccuucugcucaagcuaccaacaacucagaaacaguguacaaauacccucuguccucaaaagaaccaccuacuggacucccauuugagaacuauaaaauaaaacucuuagcugccaugcucuaaaacauuuuacucaucaaauauuuaacaggguccuggacaugaguuucuuuucauaucucccuccuuucaggacagaaaccaucucuaauuauuaaucuaccaaaaaaugacauaaaugaaugcaugaucuucaagaagaagagagccauauggauacauuggcuucuauuauucagagcuacugcaccaaucauuaaaaaaaaagaauuuauuaaacaagcaucauuuguaguuuuacuggggaaaacucaauuuaguucuguuuuucuuccuauaaagauucaucguuugcuggaaccuaauaugauucaaccagcuaugauaggcuaauauugauuuccacaucuucaauaguacauuuaaaaucaacaggcuuugaaauguucaauuucuagugacaaauggauuuuuuugcuaauaccagaaaguuguuuuuaauaaauuaggguauuuugacauuuuacaauauaguccuuagacucaaagacaaauugucauuuaaauauuuugcagugagagaagacucaugauucucuauuuccgauuagucugcaauaucaauacuaguuaaagaaagccuugugcuguacucaccagcacaaaaugacugcgucaugagcaguacacacuucuugacaacagcaucgauccuccccugccugauuccucccuggagccaagaagugauucuguuuucucugaauacuucuuggaauucuccugaacagucaggcccaugaacuaaacaaaauccaauuaugugaagugauuuauaaagcagauuacauuucuuuaguagggcaaccauuuguuucugcuuguuuuggcagucccaguuuacauuaacucccucauguaacaguaaauucaucuuuuuucacucucaaaguguccuaguuuagaugauaaguuauauggucaucuucuucacuagggacuaaaaagaguccauucccuuacuucauugagguugcuaaccacauggagcccgagauuccaaaauucuauaaaaugguauuucaccaagacagaggaaaaaugaugcuggacuucauuucugacugggcagagaagaucuaugaaacagaaauacaagugucccaauaaaaauguugaugccuuaacaauuucauuugugguugccucacauugacuugcuggaguuuagugcuuugcauucauuuuaugguuuucuaaaacaaugcuucuauuugagucauaacaaauuaauaagaaaaagcaauuaacuaaaaauaauauuucgguggaacuaaugggucuaaguauuaguagaaucagcuuauuuuuacuguuugauguuauagauaagcauacccauuuggguccacauuaugaaaaugacugcauuccuagcuaugagauccagagaaucaagcaauugccuugugauuuuaaucaaugcugacaucaagguagaaauuucaggcccuccccagucucaucuuuuacaacauuuauuuguaaauucagcugaauucucugaaaaaguacucugaaagccuacuuuuugccuugucaauauaaucuaaaugacugugacuauaaauaacguaacguaauacaaauaauguaacuauuuuuaucugagucauuuaaaauaacaaauaaaacuaucaugcaugucauaaacaaggacacaacuauuucuacaagaagcuagauauuauuuucucaagagaaaaacacuuugaccagugauuugagucagauuaucccccuuuagucuauucuccaagcagcagaaagagugauucuuuaaaaaugccaaucagaucauacuacuccauggcucgccauccuucuaaaaugaauccaaaguccuuucuaggacccacaaggcucugaaaaccucucagaucuaaucuuacuucaguuucccuccuucaguaaagucccaaccaugcuggcuucuuguacuuccuugaacucaccuauccauuuuagguuugcauuuguuauuccuuugguuugaacucuccuuuccucagagauuaguaugacucuuucccugucuuccuuaauucaugagucucuucaaacaucuuuuuguuacagaaguuuucagugaacauccuacagccccagacccuuaccauuucucucuacccccuuuucugcuuuguuuuucuucauagcacuucuuacccaugacauugcauuauguguuauauauuuguuuauugucugcuucuaaccacuagaauguaagcaucaugagggcaggaacacugucucuucuguucacuuacgucucuccgguaucuagaccagugcuuuuuaaaugaauggcacuaaggucuacacggucagugaacugauuaaaugauauuuaaccugaucacccaaaaauuuguguuacaauguuuuacccuguaaaucuaaaguccaaaauuuccccauugcacaugaacuuuaaaucaauuuucucuaaaacaguuuuucaugcuguguugauaagaguauaaacguacacaaaccucuugagaggaaaauuuggcaguauauauuggaacuaaaaauaacaaccacaauaacaacaauaacaaacuugacccaauauuuccacuuuuagcuaucuauucuacaaaaauaaacacacagguguacaaagguaugugugcaaggauguucauuaaagcauuuugaguuuuacaagcuuguguuauuuccauaauuucaaacaaaucuuuaaaagaaguugauuuuucccagagaguaaugccaaagcaauucuaaggagagcagaucacaguuuuauugaaauguuuuuaaagguaaugcugagcaaagugacugcuaauuguaaugccccauucugggaugucucaucuuaucugucauaccaacaagcccuuaccaacagguuccuuauaaguacaagguaugcagcagaugacuggucuaucuagccacagcugacaggaccagggaaggaugccuaccccaaagguaguagaucagcugguugaccagcugucugucauguggauagguccuagaucuguaucucaaagggugauacucagauuucucucagguaauucagacaugaggcacauccaagaagucagcaguuggcaguggggcaaaagccaaucaaagcacagaucggcaaaagcaaugugcaaaagagaaugcaagugacagaaaauggaaguccugcaacacugucauucccauucugcaguaaagcuaggcugagccuuggcuccuacugcccuacuuccccagguacccuuaagugcucuuuaagcuauauuucacuacauaucugcuuuugccaccuaaaggaguguaacuaccagaacauuaaauggaagauuggauuaauccuucaauuaauccuucaaggggucuaaccucaaauacuacugaaaccuacaguaaguauaaauaaguccuaaaaaacaggacuguuugcuugaucauuuuaugaaauaucaaauucuuuccaagaaaauauuuuuggugaccuauauuuuaguuuagcuuaccuaauaauauccaguaauauccagaggaaagaugggacugaaaaauccacagcacagaccaaagcaccuugccugucacaagucaggggaccaguagacuaagggcuucuaguaguugacagcauauuuuuauaauuuuuuaauauacucuggcauuuuaaaaaaauugagucacagagaaaagauguacaugcaucaguaaauaauauucuauucccuacauaccccuuaacauuugacauuguuagcaaaucauuaucagacuguauguguucaauuauuaauauaaaauccaggaagccaaggaucuucaggugccaaaguuucaaagggaaagaaguuuuuaauuuucuuuaaaaacaucaaaugcugaaaaaugauuauuuuugaaucaauuaucaaauaguuuuagaggccacacaguuggaagguccuuuauuuacauuuuucauugcuacaugauagagguguaccaaagggggacagauagacccauaugacccuggugucaauucgcagacuuuacacauggggugcagcaguggaaagagaggaggcagaccuuuuacaucauccaacuccuguucccucaacucccaacuuugcaucauuaacccuugcucuggcucuguuucugcuguaaacccaauauuuacaugugcugaggaaagcaacaacuuguacuuuuccucagaaaggucuguuguaggauuucugauugcacaaagcauuuuaugucugaucaagcauugcaguuucacauuguugacuguucagcuagugaccaauaaugauccaucugaguuaaaagcuguguuaucuuuggauuuauaauauaaaauggaucccuugguauuccuaauccuguuagauugcuuuauguagaugaaauuuuugccugcuuuggugcugcauucuuuuggguuuuaaaaauagcuuuauuaagauauaauucauauaacagagaauuuauccauuuaaaauguacaacucaauguuuuuaguacaguauguucacagaguuguguaaccaucaccacaauauaauuuuaggacauuuucauacucccccaacacaacaaaaaccuuauacucauuagcaguaacucucauuucccuucuuccauaccucugggaaucacuaaucuauuucuguuucuaggaauucaccuauucuggaccuuucauauaaauggaaucauacauauguggucuucugugacuggcuuucuucaccuaggguaauguuuucaagguuugcugacauucuuugaaugggauuugcaucguaucuauauacuguuuugcaaauacuaaaaauguauuuuggauauuugugauauauaucaaauggcuuucuaaauguacugcucuucccaguuucugccacaaagcaaaaggcuggauaggcucuugaaaaaaaaacagucaccaaguucuucuaguuuagaauguacauucuauaagaaaugauagcuaaguuauuuuauacuaauagacuuaccccugacuaaaucauagcauuauauauccuccccuaaaugcucacuccauuaaaauaaucaaaaucaaagaaccucuuauaacuuaaaauauaaacaacccaauacaaaaugugcaaaugaucugaacaguuaucucacccaaaaagagauaugaauggaaaguaugcacauggacagauacucaauaucacuagccuucagagaaaugcaauucaaaaccacaaugagauucuacuucucacccacuaggauggcuauaauaaaaaauauucacaauaccaagugcuggcaaggaugcaaaaaaaacuagauuccuuaugcauugcuggcagaacaugaaaugauacagccacuuucuaaaauaguuuggcaguuucuuacaaaguuaaacaugaaccuaccauaacacucagcaucccacagauacaguugucccucuguauuugugggagauucauucccacaaauauagauaccaaaauccccccacagauaccaaaauccacagaugcucaaguucuuuacauaaaaugauguaguauuugcauauaacuaugcacauccccaauauccuuuaaauuaucucuagguuacuuauuccuaauacaauauaaaugcuauguaaauauuuguuuuacugcauuguuuagggaauaaugacaagaaaaaagucuguguuuuuuuuuuuuuucaguacagacacaacuaucauuuguuuucucucucucugaauauuuuccaccuucaguugguugaaaucagggauacagaacccauggauacagagggccaacuguauacccgauagaaaugagaauauguuuccaccaaaagacccagauguucauaguauuuauaccaauaccuguagaauuacucauaauauccccacacuggaaacaauccuaauaugcaucaaguugugaauggauaaacaaaaugugauaagucuauaaaauagauuauacucaggaauaaaaauaaacuaauaacaugcacaauauagagaaaccuaaaaaacacuguuagcaacagcaacaaaaaaacacagacaucaaagacuauauauuguauaauuccauuuaaauaaaauuucuggagaaggcuaaacucuagagacugaaagcagaccuguggcugucugggguugggaguuaaaguaggaguuuaaugcaaauggacaagagagaacuuuugaagguaacagguaagagaaguguucaaaaacuagauuguuguggggguugcacaauuguauacauuuauacuaaaacucauugaacuguauauuuuaaaugggugaauuguaugguaaauaaauuauaccucaauaaauuuuuaaaagaccuucacugauaucauguaggcuacuaaugagcacucaauccugacaugaaaauuguugcuacgaauuucuacagcaauaaguucucacauuauuugguaucaggacuccuucacauuuuacaaaauaauugaggaucucaaaaaacuuuuauuuauguggccacuauuuaccaguaauuaucacauuagaaauuaaaauagaaaauuguuuuaaaauuucauuuauugauucaauuuaaaauaccaauaauaaacccuuauguuaacaaaaagaauacgauuuaaauaaaaauuauaguccuuuuccaaaagcaaacaauaaauaguaaaaauaaugauuuuuuuuuuuuacauuuuugcaaaucuuuuuaguuucuggcuuaauagaaaacagcuggauucucauaucugcuccugcauucaaucaacuccaauauuacauaucuggaaaauuccacuguacacucacaagagaaugagagugaaaaacggcaaguaacacuuuaguauuauuaggaaaguaguuuuaaucucauaggcccccaguggggauccccugggauccucuggccaugcugugagaacugcuagccuagaaucugcucuaaaacugacugagguucauuucagugagauuaguuaauauguguacuaucauuaauacaaauacuuuaggaucaaguuuuuuuagaaaacagggucagaaaacuuccucaauguaguagucaaagcauuuuggcuaccacauuguauaggccuggcuacaacuuguuuaaagaaagcgaucacaaugagacacaucaugccacacaguauuuacuugcugaaugucaacaauuguucuugauuuaucagcaaguacaauaaauacgacauuacuaaaggcugcuuaaacaccugauuguuacaaucuuaucaucuaaagcuuucauucuugucacugauucggaaguuucuguuucauauccuuuucaguuuucucccaucucuaugaguacaaaagaguccucuuaguuucugcauuugcuucuaaaauaguuaaauguucuugaauuuuuuuaaaugaaccuuaacaucauaaucuuaaucuuaaaauagucaugcuacuuuuaauaucugaucaauaaugauuuaaugaucauuuuagacuauaugguuaauuuaaauuaauauuuauccuauacuucacaauuaaagaauaacaauaugaucaguaaguuuaucuauauuccuuacaaccugaaagguuaaugaugcucacuaaagauguaccagcucauuuggaaugucuccaaaacuuuggcccucauggacuucagauguauuucccaaguaauguagguaacagaacucuagauauuuaaaacuugaacucagaaacaacaguaaauacuuaccugacaauaucuccuucaagagcaaucacucucuuaaugaucuucuguucuggguuuuuaggagaccuagaacaagaagauaacauuauacaaucaguuaugucuauguuguuuuaggaagaugaaaagaaauucuauaacaaaauaggcuauauuaaagucuuuacagauuccuuugcaccccaugacaugacaucagucucacuucgguuccaagugacaugaagugacuacugaaguaauucucauuuuaaauaaacucugggggggaaaaaagccauguuaaaacuuuacaaaaauaaaaaauacagaggaauaaaacauuuucuuauuaaggaauaaaguuuauuauuaaauuauuauuguuguuaaagauagguucugauaugguuuggcucuguguccccacccaagucuaauuucgaauuguaauccccauguguagagggaggggaccuggugggaggugacuggauuaugggguuggauucccucauguuguucucccucauguuguucucacgagauuuuaugauuuaagaguguggcacuuccccuucgcuugcuugcucucucuccugccgccaugagaagaugugccucacuuccccguauccuucugcuacgauugcaaguuuccugagaacuucacagccauguggaacugagucaauuaaaccucuuuucuuuauaaacuauccagucucagguaguaucuuuauagcagugugagaacuaacacaaguacuuagaggaaagaggauuaguacauaagaaaaugcuuacacauuucuuuaaaaugauaacauacuucaguuuuuuaaaauuucauuuaaaauuaagaaaggaguuuuuauuuaaaucccauaaaaacaaugaagaugcgaagcauuuccuuuaaaaaauaaagaauuagagaauucuuugaaacuacauuuggguuuagccauuugaugauuauagaauucagagcgcuaaaacagggcuacugacaguuaaaauaaauugacagguuuugauauacuuaauacagacaucauuuauuucaagcuacuugauuaugguaaauuuuaacuuagaguaauacucuguacucuaaauaaaucucugccucuccugguauguauauccuaugcaguuccuuuccagacugugauaggauucaucugugaggucaauaguuuaugguaaaacugauggugcaucacuuuugagauuauguuauaaaacagacuuacaggcucucccucuuucucuccuucucucucuccccuccuuccuuccucuuucuauuuuuuccuccaacaucucuuucauggaucacucuagaagucuggucuguccugagcagccuaaggagagacucguggugaagaaggaaggucggcuaacagucacauuagugagcuucaaagcacguacuuagucaagucuucagagacuguggcucuggucaacaguuugacugcaaauucgugagagaccuugagucagaaccacacagcuaagaugcuucugguuuccucacccucagaaaauaugugagauaauaaacguuuguuguuuuaagaugcuagacauugggguaauuugucauguagcaauggguaacucuaucuuaauauggucaauuuccugccaauaacauuuuaagucuuuugauuuaacagacgcauuucaagaaacaucucaugcaucacacaaaugaucauuuaauauguauuucaaaaucaugcauagauaaaaauauuuuaaauucaagucacauuuugaauugaaguacuuuuuaaaaggaauguaaaugugcaaaaacugaaaagaucaaauauauucaaacuguacauuucaucaaaggaaaugugcacuuucaauaagauuuauauuucacaauaugucuugcagagaaaaugaaaucacguaagcuaguugcauuuauuuguaacaauuaguuucacaguuuuucacuaaguuaacuuuuuuauuuuaaaaugaaauuugaucagaguuuugauuggccucaucccuuuauuaaaucaaguaaauauuauauuucuauaacuuuaaugucauuaauguacagcugaagugagggguaugggcauauucaagcuaaugaaauuaagauacucucugcaggguuacuuauagaccuuuuagaaaagugccccucccaugucuccuauuuuaaaaacuaggaaaguauaaaauauuauucagccucaguggucaucaaauaauugcauaucaaaauaauggauauuaaaacacuuucuuacuauauugacaaagauguacuacuaauaauaaaaauaaauugcuguugagggauuagggacauugguacucucuauauaaacuguuuggucauguaacaugccuuucuauaacacaauaucaagauuuuauauucuuuuaaacauaauaaucauacuuccagaaauguauccuaaugagaugauuacgaauguaugccaaauuuuggccacauggauaguuaaagcauuacugucuauuuuaaaaaagaaaaaaauucaacaagagcagacagguuaaauaaaccauagucccacucacaugauaaaauacagucauuaaaaaugauguuauagaagaauauuuagugauauggaaauaucaacagaauguauggauugaaaccguauguuagaaaauauuauuuguggcaugacuucacaucuguaauagcagagagagaaaugugcauccauuuuuacugggaacuaagcaagaagauucuaaaacaaaaggaaaaggaaaaguucuguguggauaaaagcuuucaugcccagauuuuugguccacauuauugggauauccuuuagcggaugacaacuauuuguguuauaugacauuacccaagaagacaugcuccaagauagagguaagaccugaauuaauuaucaaguuuacugccuaauauugaggugagauuaacauuaaugaaauaauauaaaaagcaacaccuaucaguguaaaaaauauuuuaugccaacaauguuuaagcuuuugagauucuuaaaagguauucuauauuuuaaaauaaucuauauuuuaagauccugaggcaaaauagaguaugcaaagggagcuaucuauauaauuaaaguuuuacaaauuacuacuucaaauauaucuuuaaauuuuaauguaauauuaaacucaugaaucuaaucaaauaauuucagaaugaaaaaagcuauuacuaacauuaauuccauuacugcucaaaaucuauaucuauauuuuaaucauuaggcuguugaaugcauuacuuugaucucagcagaagugcucagagaguuauacagauuuacaucaugaaacuuauuaaacuucucuucgucuuaauuuucuuggccacuuuccuaucuccuagaaaaugugaagaauaacaagugaaggauuauguuuuacuugaggaauacaauggauguuccccaauaaauacuaaaauuuacauuuaaauuuguaaguuuaguguuuucauaauaaguaauguuuuacaauauuuguuucugggauguggauuuuaaacauucuguuuuaugcuuaugauuuaauuuggcaagauuucuccagagacuuggaugaggagccuagaauuguuucuuuacugcaugagucuuagcagcucugugugguauggcagagaaugucuguaaccagaaugguugcaggccaaggaguggggucuaauguagacauaauagaauuuccagucucugucacuaauuucauguuuuuuuauguucccaaaaaguuauaauuuucacccuguugggagcacuugaaagcuacuuuggcauacucaagagaccccucuaguauuguggggauggagagauuagcauaugucccaccuucucuuuuccugaccacccccacccugauccuggugucacauaaauaacuuaacccuaggucuaagcauucucuucucccauuuaugauaaaauuuuaaaacuucccucugugacuuggguagauuuuuauauucauaugguucagaauuggcccagauuaucacagaauuaaaguaaccuuagccacagucuaauguaaucacugaaccuuuaaaaauacuaccauguauuggacacuauuuacauugcauauaucccaagaggccuaaaucuaaugcuuuauuauugaggugaaaggaaaaacgaauauucuggggauggcuucuauuacaagagaauguuuuucacuauccuaaaggauaaagcaugcauuaagccauauaacuuuacaucauuauaauuuuaaaaauauauguuuuucuauucuuuuaucaugaaaguagaacgaaaaguccacucaacacaaugauaaaaaguauuaucaaaugauagcuuaucaccuccuuucccugucaaauuugaaaaaauguugccagaguuuagcaugguuuucacaauggcuagagcuaaaaggcuuuggaguauaucuggcucuuccucugcuucuuuuaauauugcccauucucuauuacccaaauuuuccacuuggugaccaugugaugguccucuugugcccugcaaauccauggacuggagagaaauggaaauagagucuugcuguuacuauuccucucugcuguaagugagcugcucccuguaggcaagcuacauaaccuaucugggacucauuuucaggaagguaagauuagaucagaaauccuaaaccaguggccagaccaucaaaucuggcuuacaggaauauuuuguuugauucaugcauuaaaaaaaaaaaaaauuuggagcuagcuaagcaaauaggagacgucauauaaauuuauuucucuugaaaaaacagguagaucuggcaacccuaguagcacauucuugcaugagaaaaguccacuggaggcugggugcaguggcacaugccuguaaucccagcaguuuggaaguaugaggaggauggauggcuugagcccagaaguucgagaccagccuugggcaacauggugaaaccccgucucuacaaaaaauacaaaauuagccaggcaugcugacaugugccuguagucccaguuacucaggaggcugaguuagguggauugcuugagccaaggaaguagaggcugcagugagcaauguugacgccaaugcacuccagcuugggcaacagagugagaccuugucucaaaaaaaaguccauuagaauugagaagcagacgauuugccacagucccgccagcuuguuucacaaauguguaguaccugagggcauaugagucuagaaaucuugaaaaauguuccuaccuagagcaucauguaacuagugagagaaaacgcauaaaaggucuagcaggaauucuaucacaucguagguacucaguaaauuuuagacaccccuuucuauaauaaauucauaaaggagaucaauuaacugggccuaagacaagaguuacaauccuuuuuuaagacuuacauggauagacuauauuuaagcccucuaauaaaagaauuuucagguucucuuucaugggagaacaagaaaagcauuguaaagguuuggucaacuuuuauuacacaauuagcuaaagaaacagcaaaacuaaauauaacugaauccauauugaaaagcacagguuuauuuuaaauuagauagguauuaucuguaaaaucaagauaaaaacgaauaauuuuuaguuuuggauucuguacacuugcuucacuaucaguagugugaacuuuguacauacugccucauuuuuaaugauucauuuauaaaauucaauaccguuucauuaauuagcacucucaaaauuuuuauguaggucaguaguauuucagcuaccuuuuuccccuugcaucauguaaaucuuucaaaauuaaacaaaauaaacuauagacuuuaguuguuuuugggguucauucauaaaauccucucaagcacggagcuuuguaguuucagaaaaugauauauguauauacaaugccuaacaaucacuuuuguccugauauccccgagaaugcucccaaccaagagccucauuacuggcaaaaugacguacagaugaaguggcaagaacccauguuaauguuucaaauuugucuuauuuucuagaaggggaaggaaagaucaugggaaaggaaaccucaggcaggggcugaagauuuuuaaguguauagaaaacuuuaaugaaaauagagucaaauuucaagcaaugugacuuacacagucucauuuugugggguggggauggaauaagaaagguaugguuuaucuacauuggccauucucucagagcauacccuaccugaaucaggcuacuaagcagaaauagaaucuuucaggacacuggagagauuccagucagguuucuagagaccuaagaaggcagcagcagaaauaucaccuuuauguuucagauuuaucuucuacaauuccuuacacaggaaaauguauuuuaacaguacugaugaaacaacaacagaaugaacuuuaaagaacugaacuguuguuuauugauaaaaaguguucuugguuaaauguuggaguuauuucacuuucaccaaaugugauuaggaaaaauuuaauaagcaaauagugacaacuggucuuauuagugaaucagccuggauuauguaaaaucaauuaaauuuguauuuaugacucuaacuucuauaauugaaaagagcuguguaauugaguauuuuugauccugaaaaacaaaugucuucauuuaacuaugaaaaacuuaaggaauuuaguauaaucauaacaauaaauuaauuuccaacaguuuguuaacucaagcauuucaaaacacagaauagugcaaucuucaaguauuuaauauaauuacaauuuaccucaccaucuagaauaauuuguauguaaaugaauauauacagcacagaaacaauauacagcacauauguaaaaugugugugugugugcacauguauucuaccacguaacauggaguuauggcuuuuaaaggaacuuuaaaaaggaucuauaaagaaacuucugguugugaaaaucauauucccuaauuuauuuuguaaaacuugauuuuaauauauugaauaugcuuaaaguugaacauaucuguggaaaugaaggacgugaaugcuaacauaaauuuacauacugacuacucuuucaauacagauucccaagugcagaccuucauauagaagcaccaccgcucuguucccaaagauggacaugcacucggaagcauucuuuccccuuagucaagcuagguuucaaccccucauccaaacuaccucacugaguauggcuuugcauggaauaccacuuaacaucauggaauaaaacaaaauuaacugcucuuccaaggaauaaauccaucaaucuagccucauaaccguaacacuucaguuaagcuaaccagcuuuagauauuugguuucagucagguugggaaauaguaccacauauuuuugguagguuugaaggauauucauaccacaaaacacccugaaagagcaagcuauuuguauuuucuauaucaaaccauauccauugccaucuauauggcacagagaaggcaaaccaacugaauugcagaaugaauacuaguauacaagaacugagguugggaccuuuaagucaauguccaugcaaaauauuagaaguaccuguagccaccuggagaauguuauugaagaauggcacagcagucagcuugugcccaacacagcuuacucgccaguuugccaugauaucagugauauuguaggguaugagaugccaagcuuaggguagaaagcaucuugguaaaagugaagaaaguaagcauaaggcuagucuugagcauuuuaccuucagcauuuuaugguuaccauaugauauuuuuucagggugaggaaagacacggaugggaacggagacacuucagugguugccagcauuggggauuguuaguaaaggaaccuuuacaacugagaaucagacaggccaacaugccaucccauggaugccagcaaggaaagguguccaucaaggugcagggucccuccccugaugccgucacacaauaaacuucuggagcuuagauguuguucugacaagauaaagaacuauaaacagacuuaauuuguuuugaguugccucagaaagcucuuacauuuauccugaauugaaaagcauuguuugcaauaggacacuuaagucuugcuugcaauaggacacuuaaaaucagcaacagcaaaauaaaguuauauauuuuugcauaccugauauuuauggccugaaaauuuguauccauuccauugucuuuauugcauaucucuuuugauuaauaugcuuucuagugacaaucgagauaugcauuauuaauguuuaaacugugcuacuggauucaaaauuuccuaguaaaacugaguuagguguauguguggggagaggugagaugccacauaaucaaugauacuauuguaauuucucaaaaaugcucacucuccuggagaaugcugacaguguggagguuagaacauaaguagaauaugaaguauccugacacauuucuguuccaacccuaaugcuauuguuuugcaaaagagcucucaggcaccaguaacuacacacaauuuacuccuuugaaaaggucaacuuuaugcccccaauuguagacuggaauaguauuagcaaauuguuuccagaaaaaaaaaaaauacaugaugcuugggauuuuaaaaaaucaacucaacugaucaccucuaaaaacagcauuaccauuuauuugcucagcuugacagccacucauucagcuagcuccaguugcuacauuaucagaaaguuuuucuauauauuuaauuuucugcuauuuauauugcaauaacuuguacuaugauaguuugucaaugcuuuaaccuaaauaauacuaaaauuaaauuaaauaucuccuauucuuaauguuaugcauauguuucuaagucuuccaguauuaccuuuuuccuuucugcuggauaaacuacauggagcuauagagaggggggaaagagcuagagaagagguuaauuuggaaaggauuuuuggcagcugagaauaaauaucuuuuggagaauggagguaaguuaagaauggcaaaauuuaggucagggguuaaaaaagacugugaaagaucauaagggaacuuuggcaacaacagaagaaaaacaggggagauuuacuuccaaggacgaacagaaguuaucucacuaggguaaaccaagccagagagguacagagcagugaguagacagaaaaacacagccaggugacuaagaagagagagugcugccuauggauuccacaaagagaacacagaagcacugacuuggagaagacagaucuucaaaguugcuauguuaggguucuacucauuuaacaggcaccucagaaugagggaaaguuugguuaucaugcuguuacucacucuuccuauguuuguccuuucccuuauuagguuagccugaaaaacuucuauuguuuguaagaaaaugcagaggucaaaauauucccagucaauagaauagaaugaugguugccagagauuguugguggagguugggggcagaaauggggaguggcuggucaaaggguagaucuauuguacaguguggugacucuagucaauaauaauguauuauauaccugaaaauugcuaagaaaguagaucuucaauguucucaccauauacacacaaaaagauaaauauaugaggaaauggcuauguuagcuagaguuaaucaucucacaaugugugcauaugucaaaucaucacauuuuauacuguaaaaacauauaauuuuuaguugucggucauaccuuaauaaaucuggggaaaaauuccuagcugccaguguucuacacauagaacaccaaagaaaucccuuuccaaaaaucacaaccauaucucaaccugugaugcauccuuucaagaagcuaaagauucugaccugcuauuuuuaguugacuguacacagucagcaauaacuauaaaauuuauugaggcauguguuuuucauaaaaacagugaguauguugaggcuauaauuucuccgaagauuuaccuuuuucuauuauucuuuaguacacacauccuauagccacuuuuuuucuaguucauaaaaucuuauuccaaauaauuagguacccauuuaaaauggaaacagaccaugugugcccgcccacaaguguuguuccuugcaggaagcugcuuugauucuagguugaaagacauugauuaaugugagaaggcuugccugcuuuucagagcaucgguccccuaauucuguacacauacaaaauggacucuaaucucuacagcugucauguugaugcucuuugugaguuguacauuucacagacucugaaaccaucauuccauugcucaaacaugaccaacaacuuucuuuaaagaaagagugggagauuauuaagucaaaauggggccaaaccgucaucuucauguguggacgaaauuugcauggguccugauagcuaugugguucccacagcugaagcuuaauaagucucucccagacacagguauaagaaccauuaauaguccucaaauaccucuacaauugaguaaaaauaaggccaaaaagaauuaauggaaauaaucuuuaacuggucuuaaaugccuguggguuaaauguaagaaggaggcuuugauuuaaauaaaagcaacuucucagaaacauaugcucaccacccaccauucuucaucugaauggcagaaacuuggggauuucguuucacucuaacaugggagcuuugccaagagacaugggcacaaacaucagugauuaagaaagaucuccaguaugaaauaugugggaucuaauccacauuagaguggguuuguaggcaauggcaccaugcuuuggaaugaccacauggauagauauuuugauuuacauaacaguguuaaacucuauuuaaaacuuuuaaauagucuaaccguauuaccuaaaauaaaaugccuuucugaaaaagauaugaaaucaaguaaauacuucucacaaaauccucugauucaguuucguuuuaaaauauagagccccaaagccuuacugaugcauaccaugucucucccacccuuuaucaguucuuucucaccgcugccaucuguuugccuugcuuuuuccagcacaaugcccaucccuccaggcuguucacuggcacucagaugucuuccucuaauucuuuacauccccauccaagaaauguuccaggucuuuuccuauucuuccucccaaagauuuucuucagcaccacccucuguguauuuuggacacuuauuuucagauauuauuugucaauuagaaaauaugcaaguuugcuuuuggcccucuauuuuaaacacaauuauuuacugcuaucuuguuuuguguuauacguaggagaaaaauuuuguaaacaucucaucuuuuacaauuauaauuccuuaaguccuuauaauuccagucuuuaaaaauauaaaugcaauguucagaggaguccuaugauaaauauguaguuaauucaaauguuuccuggagcaucuuauuucauuuuuguuaacuuuuaauauauacaagccuaucuauucauaguuacacugaucuaaucacaugaucauuauccuacuguagaauucuuaguuauaaguuaaaaacagauauauaacaugaguuuaaaaaauaaaaggaaaagaaaggaaagucaaaauuauaacucuauagaaauaagaagacaaaauguaugguaaaugaccauuugaaucucuuacaguaccuuucaagcuguauaacuacccuucuaaauuaauaucucauuugaaauaguucccaaaaauccaaucuagucacuuucaagucaaagacucagcuguuuagaaugcagacuguaucauggcuguggcuauguguacuugaccuccugccuguuaacaaagagacucaauuaauuauuugcuguuuugaauggcuauuucauuucaccuccaccuuucuuuaagugcugaaaagcucaauugcuuuauuaccuuaaccuuagcuuuggagaaugcaugcagaauuucuuaacugccaacuaauaaacuaucuugauccagaaaguuaauuuucaggaccacagcuucuagauguuuuagugcuagagacagcugaaguaacauaaugaccuagugucauaucaccuuccaagacagucucuuuguucugaaugguggcuuuggugcuaagcuauucccuucauaugagucaagagacacacuagcacugcaauggguuauagugucauaguaacaguuuagaaaucuuaccacacauaaaaaaugaauguuuucaguauuaauuaaaaguauguaaacuaacaguauaucaguuuuuccugcuuacuuuuagucacauuaaacucaguaauauaauuucauauucaaauauuggaacauuaaacuagaaguagcaaacagcuuugaaauaaaugugaaaauggauuuuuuuuaacguaugggcacaguagaacugauagcaaugauuaucuaaaugugaaaaauuaaccacaacaccaaaacagagucugaaauucaucaaagauuuucucauaucuuuugaauuucuucagcccugauaauauguaacauuuuaaaaauucucauuugcuacauauuugcuuaucuauauauuaauucugauucuauaaguagaccauaagaugauaugaagguaguguuacccuucucauuauauucagucccaagucaguuaccugcacuuauaaaaaaacaaguauuugaugaugauuagaucauaauacauauacgaagauauugcuauuuaguauuucauaaaagugaaauaauacaauauuuguccuuuugugccuggcuuauuucauuuagcauaacgucuucaagacucacccauguuguagcauguaucaaaguuucauuccccaguuaccauuuucaugauuuacacuagucauuauuuuaugaauauccaaacugauuuaucauuccaguaugaguuucuuauaaucuaauaaaaauggcaacugagauuuuaaaaaauuuuauaacucauuucuuuucaagaauauuuauacaaacaugaaaauaaaugugucuauaguccucagaucuuaguuuauagaucagugguccugaaacuaauuuaaagucuagaagguuaggcccuggaaaucuagaaucugaauuugaacaagcaccuaggugauucugaugcaggaagucuaguccaccuuugauaggcacaguuggaaaugcucacaugaaaauucuaugaaauugaacauacuggcucccuacauguucaauaaagacccagccuuaaagaaaagccauaauauauuucuaaaaugaccaugacaauacugauuuuaaaacauguacaaaaaucuaaaauuuccuaucagggaaaaaacucaauauucuaauuccauauuuaauauaaaccuggaauugaaucuacaacuaguaugaagcaucauaacucuaauaagaaagaguaagacaucccauuuccaaaguuuuuuaaagaauauaaaaaccuccucggaucaggcaaaaugacagacaaacugugauuuuaacagaaaggcugugguguuaggguacagaagaauuuauuucuuacggucauuaauucauucagcaaauauaugcugaaugacaagcaggugccagguacucuguaugguacuagcuuacaaaacacaucuuauuacaaucaauggcaugcaugcuuuuuaggguucaggcccaaauacuagcuauaucaccuugagcaagucauuuagcuaucuuaacaucuauuuuuucaugaguauaaaaggaugacagcaaauguuacugcugauccccaaauauuacuguagaggccccaugaacuacuaaacauaagcggccgagcaucugcuuuagauagaaugagucucagaaugagauaauaaauuauaauggagaguuccaugggucuaauuccuacuuuaaguaggaaagcagcuauaaucucaaacuaaaaccacaaaaugaacuucucgcuucuaagaugacuacauaacauuucugugaagucuguguugugguuuauuacacccaguuagcaauucugccaccaaauagcaagcuugacucuacuuucaaauaaaugccaaaugacuucucucuuuccuucccucccucccuccuuuucuuccuuucucucucucucucuuuuccucuuucccuucuuuccuuucuuuuuccugcuaccuuucuucuuccuuagaaccuucuucauaagaccuuugaaauaauuaaagauaguacagauagauuaagccacuuuuaggcccaguaauuugacaauuuuuugcauuaguuuaugagcuguuaaauucguagcuaaauguauucauacugggaaauuuaauugcuccaguaaaaugccgaaguuccguaaaccaauuuuguguggaaaguaaaggaaaucuaauuguuucaucuguuguguauuuuaauuaauuguuccucacgaaaaacuagguaacaaaaugaaagcaauaauauuuuauuuaaaaugcccaagaaauucagcaaauaauucauagaacauccuugaaagaaagcacaauuuaaaaagucugaggcauaacagguauucagaauaagccacuagaaaguugaaaaauaacaauauuaguccacuacuuagucucauauucacuguuucaauguuuucuuuuuaggaugauggacugugccacuuguuaguauauuuguaggcuuuuauuccaaguacuuuaaaauacucugacuuaauuauguuaauauuuuaaaagagugaaacaauuuugccuauauuuuacaauaagaaagguaugccauaaacaaaugaauauuucccaaaaaggcacaaauuggauuguuggaacugagaccaggacuaugauugggaaucuauccaucuauuaaucacaaaaauacauuguaauuccuuguggugcccauuacuauuugcaaugugguuucacuuaaaaaaaaaucaauacaaagaaacagguaaguaacaguaaagaaaaauugauggugacauucuaaaauuauuuucauuuuauaaaggcuguguguccacaauaaauucuaaaaugagauaaaaagaucaaacuauuaauugcuuaaaaaaauccuguuuaaaauaaguuuaucaucuacacuaaacauucugaauuuuuaucugagaaagaaaaaaguauuuaaccccaguuugaauacauugaugauuaacacaaaaucccuauagaaccuccaguuaauuuucuaacccuuugaucucuaaaauucuuucauaaaccuuucaaaguuguauaccaaaaacacgaagcccuguuuaauaaaaauggaaaaagcuacaauccugcucaauucaaaucauuuuguuuugugugacuuuuaaaacauuagaaacauauaaauauacuuuuuaguaauucuuauuagaaauuuauauuauuuaugggauggacuauauagaaaauuaaggaguuugaggucaaucauuagcauuuuaagguugacacuugguauuacaguuagagaugaucaugauuuggaccaaccauguuccaguaaaguguucuucuugaacuucauauauuuuacauauaacuuuucuggaguauauguacaacaugaauauccacaugaauuuauacaguauaugcuaauuuucucuggggaagaguguacuauguugucuggcuaucgcuacaaauuugucugaagacauuccuaguacuuuuauuuucuuacuauuuaugucuaaauuuuuucucaaaucccccuugauucauuuauaaugguuaguagcauuuuaguauuuaucuuuucucauuguuuucuaacucuacacauuuuuaaacaauagaauuacagaugauguuuugucauuuuuuuaaauuaauagucuaucauuacuaguuuuuccuauucuuaacucccaauagaaugagaacuuccagguaggaccaaugcaaaucagaagugacagcuuaucacaauuaucuaaagaauucuaucaguauuauugggugugaccaacauggcacauguauacauauguaaccaaccugcacguugugcacauguacccuagaacuuaaaguauaaugaaagaaagggagacagaaaggcaggguuuaaacuuaaaaaacaaaacaaaaacaaaaccaaaaaaaccucaauaguaagaaaacaaaccaaccacuugaaaaaugggacaaaugcccuaacagacaccucaagguggaaaggauggaaagugugcuuaaggguacagaguuucuuuuuggaguucucaaguuagauaauguuaauagucacacagcuuuauaaauauacuaaaaaauguuuaauuuuacacuuuaaaaauguaaauuuaugguaugugaauuacacuucaguaaagccacuauuuuaaaagauccauuagacaaaaagucauggaaccuggauucuaacuaaucaagugcuaucauauuuuuauaacaugacuucagacaaguuuuuauacuuucuggccuuggucucaucuguacaauaaaaagcccuuucauuucggaaauuuaugguucuauaccucuagcacugucuucaugaaaccguccuuugcugaucuaaaagugaccacucccugcuuugaacucuaaucccauuaacuggcuuauaugacuguauuugugcugcuucuuuuuuuuuuuuuuuuuuuuuuaggagucucgcucugucgcccaggcuggagugcaguggagcaaucuuggcucacugcaagcuccgccucccggguucacgccauucuccugccucagccucuccgaguagcugggacuacaggcgcccaccaccacgccuggcuaauuuuuuguauuuuuaguagagacgggguuucaccguggucucgaucuccugaccucgugauccgcccgccucggccucccagagugcugggauuacaagcgugagccacuccgcccggccuauuugugcuucaucuuaucaccuuucuagaaaugugagccaguugaggaaagacaugaaacugucuuguacaugauguggauucagugaguuuuuacaugacuagauacaugaaauuauuuauauuuaguauacacuguauggaauuaagcagagaaaucaaccauuuuuuaaaacuuucauuccaccaauauaaauuucccuaaauuugacaaaguuuugauguuaauuuuuggcauaauaaaauuguaaacuuuguagaguuugaaacaccauauuaacucuuguuauacagaugagcuucuaugcuauuccaaaauaaauuguguauuaugccauggcagcuucacugauguugcuauuaaacaugaugaaaauaauccaaaaugaaaagaaauaaaauauuugaaccaguguuacuuaauuguaaauaaucaaguuuuuaguauucuaguaguuguccugaacuacauuguuuuuaagcaauaaaaucuuccaaaaagagaccucaguaaaguacacuauuauuaaaucugcuuugagaguuuaggcuacuguuuucuugcaauuauugaguuugcaaauucuuaaaaaauagaaaauuauacaagccuuauugccauaucuauaacuuuccauacuguguguuugacaaggugaaauuuuuagacaaagaagaaaguuguguauaaauguaaucaacugcuuuuucuuuuuuucuuuaaauauaaaagacaauuaucugaaaauaaaaaaagaaaaaaagaaaauuauuggguguggcaauagucacacuguuaauauuauuuguguaauuaacaauucuugccuacaguuagguuuauacugggcaaauaacacaaaucuggucaugccuuauacagcucauaggaaaccgugcuaaaacuuuauaguaagaaugggccugcugaaauuaacaauuauaacuauacuccuggagcaugaaaaaauguuuaaaauaaaauuucuguguugagugguuagcacuaacuuuucacuuaaagaaaaaaaaaaccuaguacuuuuuauuugaaaaaaaaaaagauugaagugauaaguaguguuugagaguugaagugacuccuuuuuaagauuuugaaauaucucaaaaauguauucauuagagugcugauucaauuacauuuccaggacugaggaaauauaucuaccuuuucagcccacuuaagcagaaaccuuuucuaaguuauucaagcucuugcaaugggaauggaaccucuuucucuaaaucugguccucuuccacuucugcugccuuccuuauuuuugcuccacagagacaugcccaacacaaaaaaacaacacuugccacuuucucauuucgaagagucaagacaagugucuucaaacaccuggaauuauaaguaccuucucuuauccuucauucugccauuucuuggaaagaggaauaagaaacuaaauauaaagggauuaaauacaaaacugauaguagggcauuuuauuaggacauuuaaggugaagcauacauugcaagaucuuuuucaaagacuuuuuaaauguuccaaugagaauugguuagguauuaacugugcaaauuuauuaauauaugcaucugauuucagguucuauuagaaaaccugagguaacacagugauuuucccuguauaauucucauguuuucaaaaacaacauagauaccuuugagcugcuguccuccaaaagcuagacccugcugcgucauucagccaaagauauaaaacugaaucaggucacauauccaaguacacaccuccaggaagaggcuuccauugauucagaacucucuauuuaaggcaacaguuugaccuuagcuauaucacuaguuacucaaagucaaguaguuuuagcugaguccauauugcauaagugcucauauuaaggggaaaaagacauagagaacaucaaaauuugcaccuuuguuggcagucucuguagaaaauccugguauugaauaggcaugaagaccuaacaacucucugaucccuggagguggucauacuaggucaaaaaugaagcaaauugguaggcauuaugaaggagcuaacacaacgggguucaugaacuaucuaaaaagacuccacugugacuguacaaguauacuucgugaccacuaauguauauuugaaaagauaucaacaguauauaucaaccacauauuuuuucuuauaacuuaagguuuucuugauuaucagaaacuaaauaaucuacuuucaacuacaacaaauggauaaagguauuuuuuguaaguaggaucuuugcaauucaagucuaguguggaaaugguagcuuguaaauucccuuaagucacauaauucuucucaucuaauuuugaaaaaucacaugauagaaccauuaacuauaucucuuaguuucccaaaacagaaagucauagauuaaagaucauuaauuauaacccccuuaauaucacaccuucccucaacuaagggccaaaugcuuaucaucauuaaauaucccacuuauaauuuuuauucuauuuauagucaugcaauuaucaacaaauaaauccugaaaugaaaacauuggauggauuccauguaaauaauuuuuacaaacaaauauaaauacauugaagaguucuguuauuaaaaagaaguuauuggcuauuauuaucuauaaaacaaacaaaaacuaacaaaauacugagaauaauuaaaguaaguaaauuauuagauccuagacuucaaagaagccuaauaacauaauuuucaagguaacauggauauaaauaaaacaaaauauuuuuccucuuuucuaaaaguaauacuucauauagacuuaaugcuguaacuugacagauugauaauaaacauugcuucuguaaugucacuuuuauaaaacagaaaucuucucaaaguucacuugagaaaucacugccuccucauauucuucccuucucgucaucauauagaaauuuaguugccagaaucuaaaauuguaacaccaucaccaggagucacauaaaaaaugcuuuuaauauauaucauugcaaucacucuuaguuccuacaugccuacaugauaauuaaauauuuauuggauucuaccuguuuugcuaaaauugaagaaaguacuaggaugugaaauucaaaguauuuaacaaguguuaugaugaagcacuguccaauuagaagaaaagugggcuagaaaugacugucucgguauugaggcugaauacuagcccuucuaaggacccuccucuguccacauacauucaguaguaucaagggaagagaaugggaaaaaggcuauuccuccauugcuauuuauuuagucauuaagauuuuaguuuuuaagcucuguagauuuucaucuuccuaguucaugaucacccacuaucucccccaaaauagcacauguauggguuccagaugccacauuuauagucuauagcccuaucucagccagucauuacaugucugaguaaaggucaaaagccugauaaaaaccagaccaagcagauucucucucaaagggauuuggauaugauucaaucucuuagauugacagaggacucagauaugauuuaaucucuuacuguuuaacggagaacauguaaaugcagacacauggguuagucauauauggucccauauacucugacacaaugaaaucugguuuagaaagaaacagagacaaaaaugggucacgucagauaucagauuaauuuuaaauauucacuguuugcuuaagcuaguugagugguauguuacuuaucaccaaaaaaaaaaaaccaccuagauuuuuaaaggagacaggaaaucuguaaaagcagacucccacaguuucuagaucaaauucacgaaaauauuuaguauuaucaaaugaaauacaugaauauuuuaaauacagugcuuuagauucagucucaaaacacuagaagugugaauauacuacacaagagcuaauaauuuacguugcauaagagguaaaaccaguacuaagcagaguuguaauagggacuaaauuugaaaaacauaguaauaauuugacuuagguauucauauuucuuuaaaucuuuuacuagugauauuuuaucuuguuaaaaauucgugguaauagucaauguuuaggcuuauuuuaauaaaaauauuuuguugauaaaagacuucuaauauuuucuucuuagucggggcuuaaccuaauuuuaguaaaaacacuuaggaaacaaaaaucaauaauauuuucaaguaugaucgugcaucuuaaauuuguaaagcuaguauggcaggcaaaauaauggcccuucaaagauggccacauccaaauccccagaaccuguaaauacgugagcuuucauagcaaagggaaauuaaguuugcuaaucaauggaccuuugggucccuauuuuaaaauacagagauaauucaauuauucaggugggcucaauguaaucacagggucuuuaaaaggggaaagagguggcagaaaaaaaagagucagagaaaaagaugagauggcaacacaguguuagagagauguuuuguugccaacuuugaagauggaagagggagaccaugaacuacaaaaagcaggcaaggaguuagaaaaggcaagaaaacaaauucuccccuagagccuccagaaaggaacucaaccuuacugacacuuuaauuuagcccacugagaccuuuguuggaccucugaacuacagaacuauaacauaauaaacauuuguuguuuuaagucacuaagucuguaguaauuuauuacagcagcaauggaaaacuaauauaggccaguuuucucaaauuguuuucuguaacuugcuuguuaaaaaugcagacucuuuggcccuuccucagaccucuaaggaucaagaaucuauauuacaacaaaucaugaggauuauugcuaugaaauuuaagaaacauuauuugaaaaguucuuaaaaaauaguaaguuggugucacaaaucaggaacaaagaugcagaguuucacuauucaaguuuucuuuguuuaacauaguuauaguugaugauauuaccaugacaauauaaauaaaguauguuagucaaguuuaaaacuacuuuuaaaagugugugaauguuuuaauuuuuauagaaauaaacuccauauuuguuaagaaugaaauaauaaaacauuuacaacaugaaaauacugaaguucuucaguuuucccccucaacugaguuagagcaucaaaaucagaaaguacuuuuucucaaagccgacaaaguuguauuuuauuugauauccauugacagaaauugaaugucauuaauaaaaaugaaaacaauacuauccccaaaggagaagaauuacauuagaaugcaaguuuuaaaagugaaaacaaaaagcaacuaaucacauuuaccaacguaaugauaauuuaauaagaauacagcuuacaaacuugagcaaacauaggaagcucacuaggaauacaaaauaaaagaaaauuauuccaaguauaaccagcuaucauacuaagugaaaggcaauaucagauaaaauuagcuuauuaguuuauuaacucuuugagggaaauuuaagcuuucaacauagaugugcguuggcaaauccaaguuguugccaccuggcucuaacuucugucauacaguaucaaugauuccaucuaucugcucagaauuaauuucauuuaaaauaugcugagcuuaaaaaaaaaacaaaguuugagcuuuuccugguuacacuugguuaggcaaaguucuaggacccuguuacaccaacuuccuaccccuggcccaugaugcccccuccucaccuaggguguuguucucagcucucgugguuagaaaccaauuugaucagcuaaucugagauaaaauuuuaacucagcaugaguuuaggagagauuccuccaggcauauuuaccuuuuuuaaagaggccauuaaaaauggaaaaaucuuaaagauaugaaggagucuaucucuacuguaucaaacaggacagguuguggggaaaauaaucucaguuuugaggcuucccaggucucuuacgaaucuugccuuagagcuugucaccuauuaucccuggugugaagcuucuuccagcuaacagaauuuuuaaaagauaaaugagaaacagcauaaaauggaggagagaauacaaacuccagaguugggaaauuuaguuuugauuguuggucaaaucucauagcuucucuuggccucagcuggcuuauuuguaaaacaagaucuuuaacaccccuccaguguugugacacuaucacuaggguggauugaaauauaucuucuuaguuaguaaaaaaaaaaaaaaaaaucucuacuucaagaaaacacccaaacaccccaaacauuggcuauagggcuccacauauuuuaucuuuuaaauauuuuucuucuugggucaccuauuuuccugagguaagauaaaguccuauauaauguuaugauuagaauauccaguuaacucucaccgaaauaguaaaaaauucuuuacugauggacaauaguagaguaggaaaaauauauaucaaucuaguggauagacaggauaaacuuagaauaaaugccaauuucaagaauucaucacuuuucuauuuaccuauaguauauggacagguacuaacuuaaaauucaagaaagaagcagguugaacuaauuaccugacugaauuaaauaauauauaauacuuauaaagaugucaaggaagaaaauaauaguugaauucucacaaaugcaaguguucuuguuauuuuuaaacucuugacaggggaaaggguaaucagaguugacagcuauuggcaaggcacugcauuccacucaguaaaccuguuucugaaaaugcaaugacaacuuuauuugaaucagaaccacuuaucucuuuugaacuacaggcaaaauuuaaaaugguccuucucauuuguuuuucucagucaaguaugucaaaguuuccuuggauucuaauauucugggauagcauuucccaaacugcguuccagggaacacuaguuuuaggaaugcuaguuuuccaagauguuaaugguagaaccuuaagaaggcuucuaugggaaauuaaacuuuggaaacacuaggauagagaaaggagauggguuuauuuacugcaauguuucucacagccuuucauaugcucauaugaacuguacacugccaacagauggguacagugugcaggugucgaaaugucuuuaagaacagaauaucuuuuuggccuaaaaccuguuaacauaucauagaugguaugggcaacauggcucuaugauuuaguuaagaaccauuacauucauuuaaaaauauuaauuaaaauugcauuuguuacugucucagcuuaaggucuugaaucucccccaaauagucuacuaaaauaaaaauacccuugagggauggcucauuaucccguuaucaauuuuuaacagcuuaguucuagaucagugaaagagagaauguuagaaaaacaaauggagaaaggaaaaagguaacuaaauaguaugggaagcugacuauggagaacaaaguagagccuuaauucucaguauuuagaagauuaaggagguaagauuuaggguuauaugauaaagcagccuaaacuaacugcucuaacaaagugcacuaaaaaugcacaauagcucaaauccaaucaaaguucacuuauagcucaaauaacaguccaaagugcuucaguuugguagcagccauaggggcaaggcagcuuuacucuauuaugcaggagcuggguugucaauggcucuuccaucaucaacacacagcuuccaagguuagccuaggaguugccuccaucccagucaguaggaaagaaacagauaguagagguucaagcaugggaaauaucuuggaaacagaucuauaauuggugcauaugacuucuagucacauuucuuuggcuagaauauugugauguggccacaguaacugcaagagaagcugugaaauguggucuaguugaugcacaggaagaaaaggaaagcaccgacucuaguaaauggauagcaaccuuugcuacauguguacagggaaaaagagguaaaaaugaggucauagcaguaugucacaaagcacaguaaggcagcaaaaaaaaccuggucuauauacaugcccagauucuauuugcgugugccauuaaaaaauaaaaggaacuauuuuugaaaagauuaaaaauaauccaaacauuacaaauaagggaggaguuaagugaauuauuguauuccuaaaaaggaauaguauguauucaaaaaacaugauguuguagaauaauaucugauaauuuggaaggauuaucauauuauauuuaagacacauaaauauaguauguucaauauaaucucauuuuuauaaaaacuauaaaaaugauccucugggagaaaaagucuggaaagauagacauuaauauguucuuuugccaggugcgguggcucaugucuguaaugccagcacuuugggggaccgaggcggcagaucaccugaggcugggaguuugacaccagccugaccaacauggagaaaccucaucucugcuaaaaauacaaaauuagccgggugucguggcacaugccuguaaucccagcuacuagagagguugagacaggagaaucgcuugaaacuggguggcagagauugcggugagccaagaucgugccauugcacuccagccugggcaacaagagugaaacugucucaaaaaaaaagauguuauuucuggccagcuguggugacucaugccuauaaucucaacauuuuaggagaccgaagugggaggaucccuuaagcccagaaguaugagaccagccugggcaacaugacaagaucccacuucuacaaaaaaauuuuuuaaaaaugaaaauuagcugggugcaguggcauacacugguggucccagcaacucgggaggcugaggugggaggaucaggugagccuaggaggucaaggauguagugagcacuccagccugggcaacagaagaagacucugucucccaaaaaaaaaaaaaaaaaaaaguuauucugguggcuauauuugaguauugguaguauagguuaauuuucuauuuuuaugggcaauucucguuuuugaaaauaaauauuuauuguacuuauaauaaaauauuucuaaauaaaaauauuaauauauaacuaaauauacaccaaugacaaaauuuuaaagcuguuuuacaauaaaagauaaaaacaaaauuaaaaauauguacuuuaucucuuucccucacauaucugaugggcaaauguuuuuuaaaacauuagaaaaaaccuuuuaaaagaaauguuggcagggaaaaaguuaauaacaccuacuuuuauuggaauauauuuuuuauuuaauaauuucaauaaagaaaaaaauucugaguauuuacuauuaagcuauguaaacaaaaaccgaugcuauuuugucccaccaauucucuguugauugaugcaucaggaauuacuuuccaucaagagauuugcucaauaaaagcccauacauuauuuucuguguauggaucagaauaaaagcacaaagcagcaacagcaaauaaggauguauaaaucaaugauucaaauaaauauauaugacuacauagccacacaaauaaggaauuuaauuauauacauacugugacaauauccuuaaugcuuuguaacuauaaauaaauuuauaauuuccucccaauagcaugaaaacauuaaguaucauuuaaauaacuaucuuugugaauuuaagaaaaucuuaaaaugcauggcuguugccuucacaaauaauccuagccaaagauucaaacuuaaauauucuaauagauuuauaggaaaucuaaaugggccacauuuuagaucacagaaggacacauuuuuauaccaacauuuaucaccccugcuguacucagagauagcaccauucuucuaaauguuuaaucuuaauuauuuuaguuauacccuaaccagauuauaaguaccaagaggauagagcccuugccauacuucuuuuucaugaggaagcugaaauuguagaaauaucauaggcacuggggucagacugacugguuuugauuuuugccucagaaacucuccuuuucuuugucacuuuccaaauccaacccuucauuaucugguagcuggguugcuguguaagccuccuaaccaggcucccuaaugccagugccaaucuacuuuaaguuaacuuacaccaggauuggcuuuuaaaacacaaaccugggaacaccauuucuuacuuaaaaaucuaucuugguuuuccaauugugugauacagaaaguuagacccauuagaccuaacuguacuguccugggcuauaaacccucaacaauggcaaaaucugaaguguugcuggccaagaauaaaccucauauucauauuggcaccuuuuauuaauagcacauuuuaaugcccuuucuuuguccucucuuggaaagaaaacuuuucuaauuuucaugcaauaauaugaaaauguguguuucauaauuaaaaguaaauuucaugaguuacacuggauuagcacaaauccuaugagcuguuuacauaguacugguauuucaaaccacaucauuuaggaugaucaaugcaaagucuacagaagauuaauaaaugauaaugcucugaacauacaagaaaauauuauagccuugacaaagcaucucugaggucaaaaauggcccaugucacuucguuucuugaggcucccaccauguuaaaaaaugaagaaggucaaaacaggacuacguauagcguggcuuacucuaaauguuuauauuuaaccgauuaacauguucaacauugaaaaaaugcaaugcaauauaauuccaccauucauaaaauaauuagaauuuauuaucaucauaaugaauauuuuacaauuuacuaacggugguguggucuaguaauaggagcaaaacgccaucauuuuuuuaaucuggucagugugucuuugucacuccaugguaacauuaaaaacccucauuucaggccuuuucuaaaugggaaaccuaguuccauagggccaugcuggcccuccuucugaaggguauagcaauugucuccagacccagaccaacuaacuaaucuacuuuuugaaagacacacuacuaguagacucugcuaauugcuuaggaaauauacagcucucacaaccauaauaguaguaaccccacagugguuacuauuacuacuacuacuacaaugacuuccuauuaucuaugaaucaaaauacuuaaaaacaccuucuucuggcacacaugguuuccacaauaaccguccaccccugacaauauuacucuucaggcuuaccuucugcaccugguugaccuacucgacuccaaauuuagaucaugcucuccucuuugcuuucacuuaggauguuuccucugccuggaaaaggcuacucaauuuugccaaucauaucauauccauuggccaagacuuuucuuaagcauccucucuuuaaaaagaaacugcuuguaccugacaguuguauuuuuauuuaaaccuugaccguauuucauguuuuucauugcaucaauuauaauacaugcuacaauuauauguacauuucuuuacuucucugagagauuauaaguccguugaagguauaaaaaaucuuguagugcucuacauuuucugugccccccagcguaaugcauuauauauaacaaacauuuaauaaauauuuauuaauuagaaauugcaauagcuacagauuuuggcaacaugcuuacuaaaguaaauauuuccuaugguuucaguaacuuaaauaccaaacuacuuauuuaacauuaaauaacaugcuaaauaacuagauuugcauaacauaacuagauuugauaccaauuucaagcauacuaggcauaaaguauguaguucauaaauauuaacaaagaaauagguauaauaauaaugcaucaauaaugcuaucgguccuuaaaaauaagauaaaucauaaucacaaucuaauuuuguuuucugaacagaauuuaagccauauuugaaauucaaauaaagauguauuacuuucuuaaaaaauaccuuaacugaguuccuaaaugucuuggcaaaauauuuauauaaauauaagauauuuauauuaugauauaagucauaauauacaaaacauucauuaggaagcuuaaucagaucacucaagcauuuguugauauggaaaguucauccaaauguaucaaaacucuuagccaauaucaauacaacuauaauuaagaauauauucagaaauaaugcuauaauuaaugcuuauucaaauugccagcuucauggcaaauaaauucaucuuguccuuguaggccacuuguauucaguccccagagauaaaauaacuuggcuugacuccaaguacaaaucacuuaguggggaaaaagaucauuuuuuuagugagaauucauugcaucaaaagagguacauaauguaaaagauaauaaccuacuuaaacuuccugaacucucaaccuaaucuuguuauaugaaaacaaaauguauauugcacuuauuuuaaaaucacaggagacuaaaacaacuaauugagaaagagguaguacuacaucaauuuuuuuuuuaaaacaggccagguuucccuaaggcuuuccugccuuucaaccuaugccaguuccucacagcccacaagaacagacagacauaugcuguuugaaugauugaaaugaaaaggaagaaguaacaucaccacaccugccucuccuucuuccuugcugcccucuuaguacauaaguuaacuguacaaucaugguuccuaugucucugcucuaaacaggucucacagaaguuacauugauuguccaaugaacagaucaauugggcuucuuuccuuguaguuguuuuuucuagaaagguuacccugauggcugcuccuuuccuugaaauucuuaucaacaccaaugaggauuucuucuauguaguugcuuuucuagcucuucuugcuaucccucaauaaacagaaguccuccccaaagccaauccuucucucucuuugcuaugacauucucaugccuuuaccuauuagauuucaugaaaaaaaaaaacagaccucaaaccucuauuauuuaaaguucuaaaacccuccuuaugugcccuccgacagucugacuuucugucaauguccaacuggauauugcauugauaucucaaagucgaauggucaaaaaccaaauaauucaccucucucccugcuccccuacugccaaaacccccaaacaaccaaacaagacaggccacaaaacaaaaucagccccuccugacuuccccaucgcucuugaugaacacacucuccuagggaaacaugcuagacacugcagagugagguucacuucuuccagguccccucugcccaucugaaggagucugccucuccagugucucucaugccugucuugucucugcccuuuguucucuccacacuuccauguuagaacguaucuucucuuacuuggaaaaaaaaaaggcucuauuugucccucucugugccaucucuaaugccagcaucaaguuaauguguugggaaauagcuuugaucauucauugauuccuuaaguauucauuacucucucucuuuuuuuuuucuuuuuuugcuagagaaaccacacacuuggcuuucuauugacaaaccccgguugaucucugcuuaggcccaaaccugcuuccuuugcuuucucuugauuucacacaagccauaagaacuuggccuacucugaacuguuccugggguucuuuucucaccuucaagccuagauacaaaaucagauguuguuccugagugucugcucucguguucuuuuuagcaauauaaaaaaauuagcccccagcuaacaacuacauauuuuagcuucccuuacugcgaaguaugaccauaugauuauauuuuggccaaugggcuauaagcagaacccacacguagcacuucuagagcaugccuuuaaaagaaguaugcccuccgcuucuuucucacuuucucucuuugaccauacugaugccagaaacauccaaugggauggggagcaccaaaaaggaaacugguuucuggacaaccuuuuggaacagcacauucuccuccauguccccuccuacaaccacuuauagcuuagcugucugugugugagagaaauacauuuuuaccuugucuaagccuuuguuauuuuggcuuguguuaaaguaaccaaugcaaccaucuaaauaauagagaggcacaaucucuucagcaccucucuuacuggcugacagugauaaggugugacucacaggauauuguacagcaagaaggaguuaagcuuuaacacuucugagcuucuaaugauagaagaaagguucaauugauauuacacagaaaggaacaugguggcaagaaauaaagaaacauauuuugaguucuggaccuaguaagaaaauaaaucuucccagaaaaggcccacagcuauauaguacauucaaggcacauugaaaauuagagagcugcugcaaucuccauuucuguuagacagaaaaagagacaucugaagagcaccauagaaguacaacuaacaugaauauuagucauuuguucauaccaagaccgagaacucagacauaaggaucaggaaaaacagaagcuauaaucccaaugcagacuggcaugaaguaagaaccuuacgggcuccguuaaagugaagaaauagaauuggaagaacauaagaagggaaacuuacaauggaucagaccacgugcuagaacuuaggcuaaaaguuauaaugauuucuguaguaaggagaaaacuugaguuaauaccugugccccacuaaagcauauuuauaguuauuuauugaucauauuuguguuuauauuuaagaguaguuguaagaaaacuguuuuccucagaugcuaaucagcaagaggcuaucgaagugaugagagacacaguagaauuguucuguuucuuccaggagauaagaaguacauuauuuuuauggaguuugguucaaugacaggagauuuaaugagaaggaggcuucaacauccauaaacaguuguuaaaauguuugguacacagacuuuguauuucaguucuuucugguacaagcuugugagaaucaggugguuuccaagaucuggcaggaccuuacaaacacaggcagcaucauaaguagccaugaaacccauuaggaacccuggaccagggaaaaucaggcuaagguaugcuacaucucucccccaguuucugcuagucucuguauccuuggccaaaagaaucacaaguugcauguguauaguuucuaucuaucuguaauccaccugggacacuagaauaguaaagaaauauaauucuacagguuaggacauuaucaacaaauccuuuuauggcauucauaauacccugacauaagaaauaacaccauguaauacacauaagaugcguggggaaauaccaauaaaugcaugagacuuagugccaaacagaccuggguuaaaucccagcuuuaccacuuuaccuuugggcaaccuauaaaacaucucucuaagcuucaguuuauucuacuacaaaauuaagaucaaaugacaacauagacaaguaugcaauugcaccuauaagugcuaugacaagucaaaauaccauuggaguguguuacagggcaucugaccuaguucggaaaaucagggaaguccucucugaagaaaugauauuauagcuaagauaugaagaguaagaaggcuuaaacagcaaagagugcuguaggcaaaugggaaaguggccuguggagggaaaaacuacaacacauuucaggagaugaaagaaggcaacuguggcgggagcagagagaacgagagggggguuggcauaaaaggaagcuguagguauaugcuuaugucagacaauacagaacagcacaagccaucauuccaaugaagaagcuguaggaugacaagcagcaaggcuuaagaaauguuagcuugcuuuauugucacuguuaagaaauaacaucugggcuggguagacccugccuugugaucacugacucagggaccauaugaaagagaaccagauuagcaaucccuccugauagaauaggauauuuaaaauccucuuuuuuuuucugagugagcuacaaaaauauauaggcccuuuucuuauuuuuuuucaacuuuuuuauuuuaagacuguaaauucacaugcaaucguaagaaaugauacagagauucuguauaaccuucacucaguuucccccaauggugacaucuugccuagcuguaguacaacaucacacccagaauacugacauugauaagauccaccgaacuuauucagauuacaacagguuuacaugcaguuaguugugaguguguguguguauguaugcguuggugugcaugcugaguuccaugcaauuuuauuacaaguguagauucauguaccaccaaugugcaauuuuauuacacauguagauucaugugccaucauagucaaucacaaagggcauucaugcuacccuuuaauagccacacccaccuccuucccucucccccaccucuauuaaccuuggcaagcacuaaucuguucucuaucucuauaauguugucauuucaagaaugugauaucauauggaauguacuuaaaaaaaauuuacucagcaggaucccuuuaagagccauccaguuuguugcauauaucaauaguucauuccuuuuuauugcugaauuguauuucauguuauggauguaucagaauuuguuuaaccacucaccuguugaaggauauuuggguuguuuccaguuuuaggcuauuacacauaaagaugcuguagacaucaauauucagauguuuguaucaauguaaguuuccauuucucggggauaaauguccaagugacaauugcuggguuauauggucaaauuguuuuccagagcagcaguaccauuuacauccccacaagcaaugcaggaauaauccagucgcuaaauccucgcaagcauuugguguugucacuauuauuuauuuuaguaauucuaauagcuguguagugauaucucauuguuuuuaauuugcauuuccuuaaugacuaaugauguuuaacaucuuuucaugugcuuauuugccaucugcauauacuuuucagugauuuuuuuucuguucgugucuuuugcccauuuucuaacuguuugcuucuuuacugcugaguuuugagaguucuucauauauucuagacacaaauucuuccucagauaugcgguuugcaaauacuuucucccagucugcagcuugucuuauuagugauuauaaauaaugaucaguaugaagaauucaggaaauaaaaaauauauacauguggaagauucagaacuugccaaguucuucuaauaccggauggugugaauaaaacuaguuucugagaugcuauagaaauagaacauggaagcuucauuguacucaaaccuuugcuuuccccucccauaucugcauacgguuuauguggacucuuuccuuccauaauguaucauuauucuuaauagagaaucaauacaguugacuauauaucucauacccaaacuauccuuucucagaauaucaggauaucuggcuggaugguucccagaucaccaggcuuuugcccucuuccaguaugaccugaaaggguucuuuccuucuacuucucaaacccaguuguuccgaaugccuacaaaaagcaugaauuuuacaaccuaggaauuuaggguuaugacaggguaauccaauggccuuucaauucuuacuuucuuuguucuaaaauuucuaucauagucauuauacccuacaauaugccuccagaaaggcuugugaggaccauacuuguucuccuagguugggguuguuacuagaaugaagagaagauagaguuuucuagcacaaggcagaugauucucuugcuaugaaauugaaugccucucucauucuagcaacuaucaauuaaucacugcaaauuaguaaacauuuuaucuaaguaaaucaaaguuugcuaaguuggcaauauguacgcugcucuuuugaauuuuguaugguuaaauuguuucuuaggaaaauuuucuggauucaaacauggcaucccucacauccccuuagagggaaugacuggaaaguuggacucaacugggauugucaacuagagugccaaauggggccaauucaaggaaggaauguuccaagugauaggaaauaaaugaugacaguuucuuaaagccugggcuagaaaacgggcacaguguaauuccacuguacacaacuggugaaagcaguuguacagcccccucagauucaaggggagaggauauaggaucacagcucucaaugggaggaauguuaacaaacuuacagcaaucuucauuccaccauacaauuuagugguggauuaggagagaaauauucugaguucuuccauaucugaaaacgucuucagucugucauuuuuuggaggugcauauaccauaauggaggcccagauaccauuuuaaguuggaaaauagauuuuucucucauaaccucaaaaacaaugcuccaucuuuugguguccugugcugcccccauguaaaucagaucugugauccuuuguuaaggcauuuuuuucuucucuugaagcuuuuauaaucucaucuuuauccuugguguucuaaaaauuaaauauguaucugaguuuagauuauuguuugggaaccauaaaaugacaaauauccuucuucaggucuggaaauggucugcuacuauuuucuuguuaauuuguuuucuuuuuuuuuuuucucauuuuccaugguuuuuuuuuuugagauucuggauuguaccucuuuuauuggcaucuaugcuuuauagcuuuucucccccauauuuuuuucuguuugucuucuugcucuauuuucugcaagauuuucucaauguuguuuucuaguguuauugauuuaauuucaacaaucauauuuguauucucuaguaguacucucuagcucacuaaugguuccuuuaucauaguuuuccuaauucuuguuuuauggauacaauauguucucaaacacuucuaaauauuuucgaugaauaaaaaaaaaaaaaaaaccaagauacguauguucucugaauaguuacucuuucugcugggaucagguuucuucuuuguuuauuugaucuuuuaacuuucuuguuacugggucuccccauaggccuggcaaucacuggugguccauucauaguuacaaaaggagggugggguugcuguugugggcuuccucugcugcugagaaagaaggacuuauuccucaccgagucuuuuccuugagugggaauuuugacugggguauuuguguggaguacuaaagcaugguggagggaaucaaagguaaaggaugaaacuuuacaaguuaagaugagagagugagaaacucccucaauuggcagaguaagaagagcucuacucccuuuucucuggaauaucaauauccacacuaaaagccugaguuuucccaaguggauccauucugauuuuguauggaagagccauuuuguuguugugguuguugcuguuuguugugguuguuuuccuaggcaccugccagauaauucuauucugggaacagaaauuggggagaggaauggaggcaauuucaauuaaucccuguuuacauccacauuucuuacucauaccucuauggaccuugcugacuaucagcccagaauuucucuccucuguuaaggauuuauccauuuaaaauaucucauaagggauggaagguaagcacauauuccaaguauacuaucucuaaauaaaaguucuugauaaucuucuauauuuacccucaacuuagacaugauaacaccccuugcuuucagagcuacaaaugucaaaggaucaucagaagauaaugugauguaauagaaaugacaauaaggugauaauauauuugggugauggggggacuucauuuugaaaauaccuuuucucauauagcauuuauaacuuauuuuucauuuugcacauuaaaaacaacagauggauggauggggcgcaguggcucacgccuguaaucccagugcuuugggagaccaaggcaggcagaucauuugaggucaagaguucgagaccagccuggccaacauggugaaaagucaucucuauuaaaacuacaaaaaguauucuggcguggugguggaugccuguaaucccagcuacacaggaggcuaaggaagaagaaucacuugaaccugggagguggaguuugcagugagcugagauagugccacugcacuccagccugggcaacagagccagacuccucugucuuaaaaaaaaaaaaaaacagauggaugauucccuaugguaggccgaaaauauggaaauuccaccaauauuuugacauucuuguuuguuuugcaaauguaccagaaugauaauaaaagagcuagaaaagccaaaguuagcagcaagagcacugaaccaaaacugcauauagaugaucuaugcaaacaaugauacugauuggccauuucauccacuugugucaaguuguugguaauguguagacacagcauuaucaaugcaacacagguaaaccucugcauguagaauccuaguguaaggacucuaaugucacacaggauuugagaaaacaucauuuuuaaaucuccuauacaggugcuaaaacaccugucuguuguuauuguacuuuuaaaacauuguuuuacucauaaaauaauguaaucuuuaauuauuacaaacaucuuucuuuaagacaaucuucuaugagggucccaauauaaauaaaauccauucaagcauaacuucaacuuacauguuuuaauaucuuauauuauuguauucaaucauguaugaaagugugacaaaaacaaaauuauuaaauaaauauaauauguucacacauaacguuugaacagauuaguuuuaaagauauuuuuaaaacuuugagagggcaaguuaaaaucagcuguuuuuauaucaaaagagaucugguuucauuucaacuaaguauuugaaugaugaauauuaugaaauuuggaaaacaguuaauuacaccuuacaugaaucaauuaaagcaauauuuacuagaaucucacuauuaaucugucaaaauccuucacugcuaaaacaugauuaauaugauauuuaaaugucaggcaaaguucaaacacaaaguuaauugugagcauuagugguacacuaaggucaaacuauaauuugcaauuuguaaugagcugggacucuuaucaaaauauuucaucugauaucauucucaaaagcagucaucaagaaaaauagacauacaauccacugcaauguuugugagauggaagaaacaauuagagacagagaacucccuacagcuagguaguuaaaggcugcaaaauugaucacauucaaauuccuccaacaugcaaauaccaucuaggcauguggucaagaaauuacaaggaaacugagcaaacuaaaauuaaacuucggcacccacugagacacaacacaucaauaauacuauaauaacuauagccuuuuuccucauuugacaagauuaacugaacuuccugauacuaugagagucaagugcagggaguacaaaugaagagacucucugagguaccagcagaauucugaaaauaaguuuaauaaaaucaguacagaguagaagacacaagguauagguaaaaauuacccuaagguaauagaaagccucuccagcccagagggauaaguaagccugccuauuacccagucaaagguguaaagaucccaggagaacgaauguguuaacugaugaggaugaucagaaaaaagagcgaagaaaacaaucagacugaccaaguuucccagaguuuuauccaacaaauuccucaaauaaagagaugaggaauuugggagaguuuggcuaccuuucaccuuucacuaaagaucugucuguuuuaaggcagagguucuucagaauucucuagagcuuagaugagugcuucaaaucuuaagcuuugaguucuugaaggccugucagaggcuauaaugagaaggggaguuaugggaugggauaugaagagacuagaguaguuuugcuuucauuuguuauauacuuaaucaaggguaauuuuuaaaauggaaaauuuaccaacuuauuugaaauguuuccaccacccugaucacagguucuccacacaugugccagauacuaagucaguuuccacugcauccugacucuggaaaucauccugaugaacugucuuaagcauuuaagucacucgaaagcaagauuucuuuuggaauuaccacacuuguagucuguuuuguuuuaauuggcucuugugagucugguggggaugagccaguguccaugagacugaaaaccuuggggaauguggguaaaaccaaauucucaaacuguacauccugggaccaugguaaugcugccaugcagguaaugcuuccuuauauguucucugaggauccagaacauccucuaguugacauagauauugucacuagaacccucaagccaugaauaccauuugagaggauuuuucugcuagcauuauuguuauuauuguuacuguucuuaguuuauguuagcauuuaguucauuguucacuuaaucaaaauaacuugguuguguucuggcucuaaaacuguuauuacuaauaauuugcuugcccugacuuuucuuaacuguuaaguggagauaauauuuaccgauauucucucaauuuuagagauuuuugccauacaauggucaaauaauguauuucuuaucacauaguauauaaauuauaaagcuaucuguuuaugaauuauuuacauauuuauuuauauaaucaaaauaucaucaaaauaucccugcugcauaaagccaggagucauacaaaaaccuucugauuaucuaaacuacaaaguacuacacgaauaaaaauuguaauugccauuaaaauuuuaguguucuuaauauuauaaauuucagauagauuuuuuuuuuugagauagggucucacucuguugcccaggcuggagugcaguggugugaucacagcuuccugcagccucgaucuccugggcucacacaaccuucccaccuuagccuccuggguggcugggacuacaguugggugucaucacacccaucuaauuuuuaaauguuuuguagaaauggggucuuacuaugcugcccaggcugcucuagaacuccugggcucaaguaauccuccuaccuuggccucccaaagugcuggaauuacagacaugagacacucuaccuggcugauuuaacgucauuaauuccaaauccaguguucuuucuccaccccauugaauguauaucuaauuuuaucauaggauauuucacuuaaaacaaauuuuuuuaaaaaguaguuauuuaacagacagauauaccacuuuguauauucucaccuaguaccuauugauaaguuuuauaaagaaagcaaugaaucauugccaaagaucauggauucucugaaugaaaggucaagaaacagagagaaugaugcaucccaauauagcucaguggagacuagaggcacacugucuagauuugaaugcuugguuucaccauguauuaucuuagugaucuuauacaggucacauaagcuucuauaaaagagaaaauaauauccuaacuucauaggguugccaugagaauuauuuaauucucuuuuggagugcaauggcauaaucauagcucacugcagccuugaacuccugggcucaagugauccucccccgcucagccuccugauguaccaucacgccuggcuaauuuuuauuuuuauauuuuuguagaaauaggguuuuucuguguuucccaggcuggucugaaacuccuggacucaaaugauccuucugucuuggccucgcaaagugcugugauuaaaggcaugaaacaacacaccuagccuguuuaauucucauaaagcacuuaggucauugacuaucacugaguaauaacuggauaaaugucagucaaugauugcuaugguccaaaguuuccacucucaccucauugcaaaauagaucuucugaugagaaacucaacauuaucccuagaauuaaagcaauaucauggcccaaaaaauuugaccacagcugaauaaaauagcgucuucagucacccaacccccuucaaggaaggcaaagcuguccaguuucuauaugaggcaugugcuucugguuguguacucaguggcugacccuaacugggcaugauuuuucuguuacuguaugcuauguggacgguuuauuuauuuaacuuuuagaaauaaauccacuaauaaaauaacagcauuugggaauaaaaauaaaagguagauuuugaaaucucaggguagauguacaaagaaaaacaaaacuacucucacuuaucacaucaaagcuauuaaauaaauguagcuaaaucuaauucaaucugucccagguugcuauaagauccaauauauguuacagcuacuaaguuaugaacuacucaggagcccacccaaaaggcagucacuuuuauccucagaaggauuggaguaugugaauuuacugcuccagauucaaagagcuugugccuauauuccuauuuuggaggccaucacuucagugguucacucuguugguuuccaagauggugguucgauuaagauuccccccugccuuauuacagguaugcaaauugauccacccagaauggcugucugacacacacccaggaagaauuguuucauccuuaugcuaucuuuccuauaggagaaaauaauagaagaaaaccauauacaguguuuguuauuagcaaucauacaucuccuauuguuacauaaaguagcucucggaaauuauuaaggaauuuguguugaccuauauguaaacuuaagguccaaauuaauuacacagagagaacaaacacaagcauaccuugcaaggaugccaguuugggaaacuacuuaaaucuagcauauauaucacuaaucuguguaacaacuaguccaacaucuguugaucucaugcaaucagaauuugcaucugccucaauuaagcagauaauaaaucuacauaguuugucacuuacuguguuccuguaagggugucacaaucauaaacgaccaagauuaguuucuauucuggggaagucuagucuccuauaauugaacaguuacugaaagaaucugauuccuuuuaugagguuuugauuuugaugacaauuaccccuucaggagagaguaaagaaugcaaguuuauucuuugaaaagaggaucuucuguucuaaaugggucuucaauucagacuaaaugcugaagauugcucuucauaaucaaucauucuuucuagcuucagaaugcauggaaacagaauuagcggcuggaacacuggugaacaaaggaauaugaggcaaagagcagaaacuaauuucagaaaggccagguuuuuuuuuuaagccaugggccccuuggucaagaguaacuagcuacccuagucccuccacacagaccuaaccuccugccaguucucaaggggcucaucugagucugagccuagaaggcauuuucacauuuuagcguaaauuaugcuuacaucucccaugcgguuuaggaaagacuuaauugucacugucaucuuauaaauauauaucagugaugauacauagauaugaucuuaaaugccaaagccaauccaaagauagugacugacugacucagaaaagauucugaagacaacucuugacucaaugugaaaaaguguaaggugauugaugugcacuaacuggcaaggauauaggagagggaaaaggaugacauuuauaucauauuauuuggccucuguauuuuauaaugcauaauugggcuuuauuuucauagacgcauagacuuuuaacacuaaaagugauuccaggaaacaacuaguuuaaucccuugaagcaaaagcauuuucccauaauagcuauuuauuuuaacauucauucacucaugaggcaucuauuaagcucaaaucuuuugauagacacuauacuaggaaaaccauauuucccugcuuuccuauuucuuucaagagcaacaauuuuaucuaaugucccaaauuccauaguccuugcuaacaucaagcugcuguugccaguugcuucuaggaucucaguaucugauuguuucagcugccuccuucucugaaccacugcuaacaggcucucaccuuuugcgucuacuuuucucucucuuucuaaaauuccauuauaaucauguaagcacuugaagaucccccuucuuuuaccuagccaagcaaaccacucuaagaauucccuuuccaucacugacuucaucaguuucuuucccucugcugaaucauucacauauauucauauaucugcuggauauaucagcacacaaauaugcucgcuugagagcauuucuaucauauuucugacuuccccacuuucccuccucccauuuucucuugaaccuacuuguauuagucaguuuucacucugcuauaaagaauuucccugagacugaguaauuuaucaaggaaagggguuuaauugaaucacaguucuacauggcuggggaggccucaggaagcuuacaaucauggcagaaagggaagcacgcaccuucuucacaugguggcaggagagagaagagcgaaggagaaacuuccaaacacuuauaaaaccauuagaacuuguaagaauucacucauuaucaugagaacagcaugggggaaaucacccucauuauccaaacaccuuccuuccuggacaugucaggauuacaauucaagaugaaauuuggguggggacacagaccuaaacuauuccacuuugguuuuugcuccuaccauuccaucagaauugcuagggucagcaccauuugacacagcugaucacucucuccuugauaugugcaugucacuggacuuuggaaauacaaaaacuuucuuaauucucuugccucaucagcuguaccuucucagucuccuuuacugauuuuucugccucucucgaacaucuaaauguucaaauuccccagggcucagaccucacacuuuuuuucauguacacucacucccuaguaaaucucuuccauucucauguguuugaauaccacugacguguacguauguacacauauagacauguauguacacauauagacaugcauguaugucugugcauacauacuuauauauaugcauguguguguguguguauguguggguguauucaauccaaacuucucuaaauuucaaacugacauccuacugccuaccuguuaucuccacuuggcugugucauaagcaucuaaaacaacaucccaaaccaaaagccugauuccccgacuuucuaccauuucucgucuucuaacucuucccaaaugcaauuaauaguaucuccauccuuccggguuaaaaacauuauugauuccucucuuugucucuuacccacaucuaauuuaucaagucuuguuaguucuuccuucaaaauauaucuagaauccaacuacuucucaccauuuccaccacuacuggucugagcuauaaccauguaucuucuacuacuacaauagccuccaaaugcuuuuuccuauuuuaucucuugccccuccccauucucuauuuucaacaugaugccaaugugagcccucugccaugucaaauuguuauauuccuuugcucacauccaccaagggauguaagacccuacauacuaugacucccccaauacuucuaugagguaaaguccuaccaucaaccucaacugcucuacucuugaucacacugacugccuugcuauucuuugagcauaccaagaaugcuacuggcucagggacucuguacuaagauugcucugccuaagauugcucuucccccagauaucuucaugguucccucccucauuaccuucaagucucuggucaaauguuguauuagaaaaaucuucccugacaauuauauaaaagaaacuguuccuaggcuccuagccaccuccuaucccucuuaaccuuaucuuucuccaugauacuuauauauauggccacacacgugcacacacacacacacaauguugcugcuauuguuuauucuucuggcuccucucuuaccugcccccuauuaaaaaaaaaaaucuguaauuuucaugcugacaggaaccuuagucaaauggauucacugcuguauccucagugccuagaauacuauguggcacauagucgacacucaaaacuauuuguuguaugaguagugagggggaaguaauugugugagaagguucagcaaaguuacaauggaaagauacaauaugggcuagucuugaguuauaaagaaugaauuagguauuuccagaaauugaauaggaaauucuaaacaaaagcaggaauaugaauggauucugugccacuuugagucaucucagugucaguuauucaugaagacauccccugacuaacuuacauugauuguuuucaaauuuaaauuuuguguccuauaugguccacaggucacagucaguauuugcuucauaucauuuuacaauuuugggggcuguucuauuaauacaaucaguauguauuuauuguuuuucuacuaugugcugccauaacgauaugcugguauuaucuucucucuaaaagcgauuuaaaaacuugguuuucuggccuuaucagauuguucuagaaaagauuuugcccacaucuaacuucacuguugcaaaccauuucuucaguuaagccaaaauguuccuauuauuugguaaaagcuauaauugcaaugauuucacucaacacuauauuaguaagccaaauuaauuguggauucaguucagaacauauaugcauuuuuuucugaguguauuuuuuauuuuagcuuugaucuuaacaauuucucuaagaccauaaauucugugagggcagaaauuguauugcucaggucaccuaucauagccccucauacauaacaggcacauaaaaaaaugccaauaaugaugacccauggcaugaagcacagguauacaagaacaccuugcaguugaaauauucccauuuuaaguuguuaauaugagaaaauuuuaaauuuugacauacugaaaauguauauguuauauauggcuuuaaucauuuauuuuuuguuuuuguuuucagucugucuucaacaaaauggauaaaaaaaggaaguuaaucuuuggcaacaccauaagcacagucuaaaggcucacaaagccacucccacuuauuuucauauucuacuuuggaaaauggauuuuggguucucugaguagaagcugaaaaauaaaugcugugguuuugagaacagaacaaaagcacugaagagaaauucaacaaaggcucugaaccuuguuuguguucuguaacacugcuucaaggcaacauuuuuauuuuuaaauguaugcccucauuuacacaggaaauuaagaaacaaacucuccgugucagugucccugcuacuaaacaaccuagccaucagcugauuuacaauugaguccuaauugaacaguuaugguuucaacuauaucagcauaucugcaaguuccuuagauaaauauuccaagcauuucccauagauuuuacaggcaaaguaaaaaguaaagagaaaccuagagcagguaacauuuuguagacuacuuggcauaucauucugcuuccuuucuuaguuauaucucauuucuaauacauauuuucaaagacuugcuauuuaaaauauaaaugcuuucauuaacaaauguuaagaaaccaaauaagagguuuuagagaagucacagagucuuacaucuuuaguaauguaacucaaaauuugguuuaacaauuauuuucauggagauagaucuuaacaucauguuuaaucauuuuaaugguuuucgucauucacagauuaguauauucauuuggaugccuucagacuagauaaagacagguaaucaagcaguacauccuaacagguauaagcaggcaaacauggauaguuuccauuaaaacuauggagauuuuauaauuugacucauuagcaugcuuuucucaaaaagccucuuacuacugaucacaguuuacgaaauuguugcgcuacagggaauguauagauccaggccaaacaacuauuuugcacagaaagaaacugggguuuguggacauuugaugagauucugaaggucaaagaacaagcuagguccuccauccagguacuuuggaagaaaucagauaacugaagcucaugcuagugugaaagguaagcucagugagcauaaaggaagcacagaguuacaaucauaggucauguuuuggccggagaaaggacauucauggucucaagacuacaaacguggcaaaguuucaacugaagacaaguuugagguauagccucaaaguuuacugcuuaaugaggccaucagagcuggacaaaaaaaaaaaggucaagauacagacccagguguugaaaguguccccagcaugcgaugagucagguccauuaucacuguggaaaccaagggaguacuccugagaucaguagaugagaguaauccuuggcaaagggcuguagaagugaguggcacugacgagaggguagagaugugauaacaggcaaugauuauggaaagaaaaaaaguacccacuaaauuuuaaaauauaugguucuaguugccaguggaaagagagaaaaucaugugcuagauuaaucauguugaauuaugaagacuaaauuuuagacagacugccauuugcugagagcaguauucauuacuaucugauucaguaacgcuuauaacuaaguggucagacuauauaccuagagaaauauugcucaugucauucuaaagccacaugcacccaaacuggacagguagcuguguuauuauuaaagaaaaaaguacccaaaaaugcaugcacaacagauaguuuccuucaggaaugcagugcauuugaaaaacaauuuucugaagaaaagaguccccuuacuaugucauuacucugaaaugaagucuaagggggagggaggcaauaaauggagagccuguggccuucuuuucuggaccaggaucauuucuuauagcugaguaaucauacccuuagccaauaugaugugagaguuugcagcuuugcuacugggcaaggaacgaauucugaaaccaugcugcacugaagacggcaacaacugacaagagugucagugaguguuuucucuauaugagugaauaaacaaaugaaaacaaauaaauuacucauuuacuugugugauuuugauaggcuaugaaucaauucucaccaggaagaaaaugugccuuggguggggaaggguaugcccuaagcuagaaauugcuauggcucugguaggagagcgagcacaaaauucuuaugacauugccauuuccugccauccuguauuucucucugggacuucacagcugggcagcauauuacuggagcccacuuuuccagaaccauuucuacucauguguggaaggcaagagaagguaaguauguccauuuucaucccccugucuauauugaguaacagauauuuauggaguucgagugggaaaaaagguacagggagagagaauucuauuaguugaggagcugaaauguaaugcagaucaaagguacagggauaaaauaaauuucuauggcuauuucagguaaaauuugauauggcuaauuuucauaugcaccauuucugaugagauguccaagcacgaguuuucagaguaacaaugcaauuauuuccauuaucauuuugaauuuauauuguuauucuuccuuuaaggaguuugaguaccucauacaauguugcaauuacuuucagaaaugacucacuauagugcgaacaguauuucauaauaaugcagccaauaaaauaaaaacaaauauaaauuucaccuaggcaaauaaacaugaaugcauucaguuccucuacauuauacuuuuucaauuuacaaugaaauaauucacauauaguaauauuuauauaugauauuaacauaggggcaaaugaaacauaguugauaaagacacaauccugacuuuuaaaaaaauuuaaaccaaccuuaacagaaauuauguuuuagaaggccaauaaauauagauuuagagcgacuauuuauacauuacauaugugguagcuauucuggaguuuuagguaaguuaggguggacacauguuuauaggaucacagaacagaaauuucagagaugaauggguccaaucacuuuagcuuacagauuuauuaguaaaggcuuuagccccuaacuugccgaugaggaaaugaaagcugagaggguucacuguaucuuauuuuuucagaacuuguucaagcuuguugggaguuagaaaauaacgaacauccuaaauuauuguaagaaaauuugcaauuaggaagaggaagggcuuccauauagcuuaugugcacugcagcuuucauucauucagcacaauuguacugcauaccugacguauuauacauugcacuagguacaagaacuauagcagugagcuagauugguaugauuccuaaauucaugaaccccacaauccacugagagaaacaaacaaggagagagggccuuagaagaccccuagauaaagauuauauaagggaaaaguaccuaaggacagaugaggcuguugugguaaacaugugugagacugcaaaagaccuuauaagccacgauaauaacuucaguauuaguacuaagagcaauugagaaccacuuaagaguuuuauguaagagguagacaugagcaaaucauauuuuauaaauauguuucugacugaaggaggcaagucaaggcaggcaggcuggccaaugaaaaggcuucuacaacacuuuaaggcagaacaugaagucuugcacaaggaaaguagcaauaaggacagaaagaaacaggcuuacuuuucgagguaagacugaaagaauugggugacugccuggaugggaggugugagggagaugaaaacggaaggagggugugcaaguuucuguuuuaguaagugggugaacaggaagccauucaacauaaaaaggaacacagaaggaggagaagaggaggauuugagugcaagcagguuauguucacaggcaucacuccaaacuaacuccucccacauacaaacucccauauaugccccuugccuacaaguggaaaaaaucauucauuuuacagugaaguagaaugauucccuguaacuuaggcaauauuauagaguaaaaucuuaauuauguauaucuuuuauucguuuaguuuaucugugguauaucuugauuaaacauuaaguagacugcuuauuuuuuuuuucuuuuuuaaaaaacaagucugguuuaccaccucauauagcuuucaucuuaccaagaaaauucuuugaaagacaaacauguaaaaaguucccucauaucaaggaggucuugaccuaggggucaagucaggaaaacuggacauauuuccagcuucucaagucauauauucacagcaaaacuucauuauuuugcuggcaauuacuuuucagaaaaguaggcauauccauaaucaaauauaaguacaaacaggccagguguggugccucacgccuauaaucccaacacuuugggaggccgagggaggcagaucacuugaggccgggaguuugagaccagucuggacaacauggcaaaaccccaaaaauacaaaaauuagccaggcauuguggcgcaugccuguaaucacagcuacucagaaggcugaggcacgaaaauugcuugaaccugggaggcagagguugcagugagccgagauugcaucauugcacuccagcuuuggcaggagagugagacucugugucaaaagaaaaaaaaauuguguguguauauauauauacacacacacauacacacacacuuauguauguacaaauuacauuuuaaaugcaaauauaaaugacuccuggauuaaucuuugaaucacugaacucuguuuuuaucauaaguugacuauuuaaaaggcuuuuggaaugauuucuuggauaugaaaugaaaagcacagacaacaaaagcaaaaacagacaaauggaacuacaucaaacuuuaaaacuuuugugcaucaaaggacacagucaacagagugaaagguaaucuauggaaugggaaaaaaaaucauauauuugaugaggggcuaauauaaagaauauucaaaaaccucuuauaugcaacaacaacaaaaaaccaaauaagccaucuaaaaauuggcaaaggacuugaauagauauuucugcaaauaugacauacaaauggccaacaagcuugugaaaaugcaaaucaaaaccacagugagauaucaucccacacccacccauuaggaucacaccuaucaaacaaaagaaaacacaaaaauaauaaguguugucaaagauguggagaauuggagcccuggugcccuguugguggcacuguaaaauggugcauccucuauggaauacaguaaggagguuccucaaaaaauuaagauuaaaauuaccauaugauucagcaaugccaucucuggguauauacacaaaggaaugaaaaccaaagucuuaaagagauauuuucacacccauguucacagcagcaauagucacaauagccaagagacagaagcaacccaaauguccauuaccagaagaauggacaaacaaaugugauauguacguacaaugaaaucuuauucagcuuuaaaaaggaaggauagccuaucauguaauaaaacauagaugaacuuugaaaacguuaugcugagugaaauaagucagucacaagaagacaaauacuguaugauuccauuuaaaugagguaucuaaacuaguuaauaucauagauacagcaaguagaauggugguuaccaguggcaagagacaggaggaaagagggagcuuuuuuaaaaugggcauagaguuuuagauuugcaaaaugaaaaaguucugcagaccuguuuuaaaacaacgugaauauacuuaacacuacuaaaaaguauacuugcaaaugguuaagaggguaaauuuugcuguguuuuucaccacaauagaaaaaagggccacuuauuguuugagucuaucuacaugaaauguccaagacaggcaaaucaguagagacagaaaguagauuggcaguugcuuagagcugaggaaacuggcgguaaauggagagugaaugcuaauagguagaggguuucuuuaggggguaaugaaaauauucuuguauuaaauauugcggacagucccagaacucugugaauauauuaagaccacugaauugaaugauuuaaaaaaaaaacuuuucgaugcuagugauugacacacuuguguugccuuuuauauagccucucucaaacaccaaagacucuuaagcaauuccccacuucaaacacucuuaagaaauauuauaaaguaguuccuucagauaucucaacaacuauuuucuuagauccaaugcauucaacucccuaggaauccucagacaacaaacuaaaauguagcacuaauaauguuaugcuaagaacaauggcauaaugccagaaaauuucaaggauaaaaauaugaaauucucuugccugagauuuagugugcauugcaaaaaacaacuauauguaucagccagcuugaguaagauguuuugacaucuuaucucaacaucuaaaauuaaaacuacgucuucacuuugcacuaaaagccuuguguuucaucuagguuaaacucagauaagaauauagaaugaagauuagcuacauggauguuacuugaauauugucuuccuucccugucaaacuugaaaaaaaguccaguaauuauauauauaauaauuuauauauaaauuaauauauuuauauuuuuauaugauauauauuuuuauauauuuauauuuuauauaauauauauuuuacauuauauuucagauaauuauauauaauaaauauauauauuuauguaguuuauacuauauauuuuauaauauauauuuuauguauuuuauauuauauauguauauauuauauauuauaauauauaguauauauaauauauaauacauacauauacauauauguauauauguacuauauauuauauauaauauauacauauauauaaugcauauauauuaugugcauauauacauauauuaaacauauauaauauauaaauuauauuucuauauuauauauaauuuuauauauauuuauauauaaaauauauauauuauauauauuauauaaauauaguuuauauaugcauauauaauauauacuauauaauauauaauauauacuauauauuauauauaauauauaguauauauuauauauaauauauauuauauaauauauuacauauaauauauauuauauauaauauauauuauauauaauuauauauauauuuauauauacuaauauauauuacauauaugauauauaauuauauguauaauuauauauacuaauauauauuacauauauuauauauaaacauuauagucauuauacucaacagaacuucauauugcauuuuuuaauauaugugccuuuauuuauuuauuuauuuauuuauugagaaagagucucgcucuguugcuggagugcagugcugugaccagggcucacugcagccucaaccuccugggcugaaucaauccuccugccucagcugccugaguagcugggaccacagguacauaccaccaugccuggcucguauuguuuuuuuagaaauggggucucaucauguugcccaggcuguucucacacuccuaggcucaagugauccucuugccugggccucccaaaguacugggauuacagaugugagccacugcgcccagccuuguuauuuuuaacuccauggucauuacuuacuuuccaguaaugucaaaagucuaggauaacauaauagauuauuauguggguuagcuggaaggaggguaauguauacuguaccacaaucuugugccuugaaagucaacuaccacaggaucagugacugaaaaacaggaggcuuagauaccccacucccagauauggaaauugucugacauccucuucguuguccuuucuuuuuacuccccuucaguuuaccuuuacuugccuuuaucuuaagggacacaaucccuucuuuaccagcagguagagguuuccuugguuuugacccuuuguguuauguucacugucauucucucucccuaagaaacccagcuaagggcccagcccucauuaagccaggcucacaaagauccagacaagucuccuaaaaggcagaugaccgugguaggagccaucagaagaagagaaacuacagagacaaugucagagaaaauacccauucagcagaaagaaagacuccuaacuuuauaaaaauaaaucauuuugaauuauauacauaggcuuacuuucccaaagcaacaaaccuacuuaacaacacuuuuuggacaaacuguuagucaucuuggaaaaugaaagcaauggauauauuuagugcauuugggcucuaauauacauuaucaaucacuugcaaguuacagcucuucuuaaacuguguuugcuuuucuauuuuucaguucuaaggcagcaucauuauucuacuauuauuugaacccagguuauuuuucagaaggaggaggaauguaauaauuuccuauacauauauuguucugaaagguagcaagacaaguuucagugaggcagagccaccccagguguucauuaaaaucaccuggcagcauggugggacacaguguuaauagaacucaguauuaaugggacaaguguuagcggcucuguggcgcaaguguuaauacugauugcaaauugugcuugaugauauacauaggaaccucuggauccuucacuuacaaauagcaugaaaugguggaugaaaaguaaugcccuaaaacacaggacaguuucuaaagaaaagaaacauuuuccuuguucaaacuagaauuuaacucucggcuguucugugguuaagaucuacaacguagaaacauuucaacaguaacuaacacauguggcgcuuuguguguagcagccacuguucuaaguauuuugcauaaacucauuuaauacucaaccccuacaaugccaacagacagcuaacagaauuguucccauuucucguauaaagaaacugaggcucagaguuaaaugauuugcccaauaccaaauagguaguaaaaggauaaaccaaaauuuggaugacauacuuuggcuagaguccauaccucuaaccacuggaaauugugugucuuuuuauuauuauuauuauuauuauuauuauuauuauuauuauuauuauuauuacaagcaucaguauuuuuuaugaauacucauuucacaauggcauugauuuaaaaaaaauccuacaccuacauuugcaaugguucaaucuuucuaauaaccuaaaucaguuaauuaagacaaauugucgacugaguuagugaacauauucaagcuagcuagggguguagauaacuucuaaauagaggauacacuguaaugacuaguuauuccauaccuagauucugugcagauaauucugcuccuugaaagcagagauuacuaucuuuauauucugagcaccuagcauaguguaaacagucaauaaauguguugaaugaggauggaggguaaauaaaucacacuacaugaaggaaauaucuguuggcauugagagggaaaaaaacugacgagggaggaggauggggaacuaaaggugacugugagcucuuugcugccuuugcuccaguguuccagggcuuccuuacuuuuugcaaagcuccaggaucuguauccuugcugugcuugaacagaguucaggcagcagggcaaggggcagggagagcaaagugggaagucagaaaucagagcagccccgcagcagggaaacugcagugguugagagucacaaccccacccuccugggagcacuggcaggagugaggugcccaggaagcagacagagggggaggcagccaguaagggggccuccaccuacuuuucaaagaaucaagaagucacacugaaagaaaaaaggauuuagccuccucuuacacaaggucuucugucuuccuuugaaaaugacuuuagaaaagaaaagacaagguugaaaaggaacacaaaagaaagucagacuccugccuagagaguuaaaaacauguuggaagagccaguauaaaucagcagcuaaugccagugccuuuggaaaggacccacuaccagggguucuggaggcuggccuggugacacuguuuauuauacccagaaaaaaaauucuuggaaguaagggcauaaauugaaaggcaacucaaugacccuccuucccucugcuuuccauauucauaccuuuccauuuuucuggaauacaguaacaucuccaugucaagccaaaaugccaucucuuccaugaagcauuuccggaucaccagaaggauacuuucucuacauagcucuuagaugucacuuguauaguauauucacuuacucaacagacacauauugaaugucugcuaugugcuagguaucuuucuagacacuagggauacaacaauuaaaaaaaaaaaaaaaggccuagcacgguggcucacaccuguaaucccagcacuuugggaggcugaggcggguggaucaucugaagucaggaguucgagaccagccuggacaacauagugaaaccuugccucuacuacaaauacaaaaauuagccaggcaugguggcuuaugccuguaaucccagcuacucgggaggcugagacagaagaauugcuugaacccaggaggcgaagguugcagugagcugagaucgcaccauggcacuccagccugagugacagagagggauuccaucucaaacaaacaagcaaacgaaaaaaccaagaugcaaauuccuacauuuagggaacuuacguucuacuauaguauauugcacauuaaauuggaguuguuggccgggcaggguggcucacgccuguaaucccagcacuuugggaugcugagacagguggauugcuugagcauaggaguucaagaccagccugggcaaaaugguaaaacacugucuccaccaaaaacacaaaauuuagcagggugugguagcaugugccuguaguuccagcuacucaggaggcugaggugggaggaucacuugagcccagaagggcaagguuguagugagcugagauggcacuaaugcacaccagccugggcaacagaauaagacccugucucaaaagaaaaagaaaaagaaaaaagaaagaaagaaaaauaaagugaguuauugaagucuccaacuauuauuguugaauugucuguuucucccuucauuucugucaguuuuuguuucaaauauuucagugacucauauauucaaauuguuuucaaagggaucuaaaaaaagugugucaugagguauuucuuaaauuccugcucauuuuuaacaaaauauaacaauuaguaaaaguaaaauagaucaaguauuuccucauuugacuuuaauuugccaaaaaauaauguguagugaugaaagcuacaacauaauuaauaaauuaguaaauaguaaccacacuauucagaauaacacugcucaauauagagagugggugaacaauacacuauuccuuauaccaggaaacuccuaaaaaagagacuugaguuauagguuagcuauuuccucauggcagacaaaacaguuuccauuauccagcucaucuuuccgcccuuucucccucuucucacuccuuuucucuucuauuuagcaaauauuuauuuucucauaagccucagaaaauccuaucugaaagcagguauaaauugaaagcagguauaaaacauucuuuguaauuugauuccuuacucacuguauuagucuguucucacgcugcuaauaaaggcauauccgagacuggguaauuuauaaaggaaagaaguuuaauggacucacaguucuacaugccuggggaggccucacaauuauggcagaagaugaaggaguagcaaagucacaucuuacauggcagcaggcaagagagcuugugcaggggaacaccucuuuauaaaaccaucagaucaucugggcacgguggcugacgccaguaaucccagcacuuuuggaggccaaggugggaggaucaccugaggucaggaguucgaggccagccgggccaacauggugaaacaccaucucuacuaaaaauacaaaaauuagcugggggugguggcaggcaccuguaaucccagcuacucaggaggcugaggcaggagaauugcuugaauccagaaggcagagguugcagugagccaagaucucaccacugcacuccagccugggugacagagugagacuccauaucaaaacaaacaaacaaacaaacaaacaaagcauccgaucuccugagacagcaagggaaagacccgcccccaugauucaauuaccucccacugggucccucccaugacaugugggaauuaugggugcuacaauuuaacaugagauuuguguggagacacagccaaaccauaucacucacccuaaucaaucaacauuuccuaaguagaaucaccuaugcugagcauuaugccacccuucuuccaagugaaccaaaucuggcccuguucugccaacaaauccuagucugaagccagagccauuuucuaaaucucauauuuccugccuaaguaugggggagucaugggcuuagcuauaaaaauuccuaagacuagggugguaugagugaaugcaggcugggcauagcagaaauguagcucuggcaucauaauuucagaaucagugacauccuuagaacgaagugcccccaucaaucuaacaaaggaaacaaaaccccagcuuaauguuugcuuuaaguugccaugauuuuccuacagacucagugcugcaagucaaucuuuacaaguguuuuuucagccugggggcaagaaaauaaacaagaccccaagaaguguuaggaaaggagaagacuuuugaaacucuacuccuccucagauguuccgagauacacugcucccucaagaaucuuagugaguagcugugguuaugauggacauguguaauaccccuuugcaaauguuggaauaaaaacaaaaaugagaaacacugaucuacccucacaaaaaauuuuggcucuucucaaggaugaucuauauccuauagcuucaggacuaaaaacagaagcagagaggucacuaauucaugucauaacauccaauugcuccgucaccaaucugcugauccuuucaccaacccacugcauaacagacguuacauggccuuaaaaaaauccuagaacucugaucagaaauaaguuucauucauuauuaaugcuaaccuuucuuuuuuuuaugggaaaauguugugaaauugaaugagaaagacagcaaauacacagagcagaugcaacucauuucugagccaugaaccggacacaauacaaauucaccuuugcagcucucuaccaacugcucaugcccucaguagaaaagaagucauacauaauguagcaguaaaacuguugacagcauuccauggucacagaagaccccgcgaauuugcugcuguggacaugaggaugugaugugcgaagcagggccuaaugagauuucgcauuucucuuaacaguguccugaaggcaaguucugguacuugcuuaacaucugcaguaauguaagggauuauugaaaguaagcuuucuauuucacacauuuucuguaucagcuaaacacacaugcacucacaaaaugccaucauuuccuuguuaaauaauacuuagauauucaauuguucaugaucuugguaaacacauaaacaaaucaucuagacuagcguggcucaaaaugcuccuuucaaacaaauauaaauuuauaaguuuaugggcugggagcgguggcucaugccugcagucccagcacuuugggaggccaagguggguggaucaccugagaucaggaguucaagaccagccuggccaaaucgugaaacccugucuacuaaaaauacaaaaaaaaaaaaaaaaauuagccaggugugguagcaggcaacuguaauccuagcugaggaggcugaagcaagagaaucacuugaaccugggaggcagagguugcagugagccgagaucaugccauugcacuccagccuggguaaccagagcaaaacuccaucuuaaaacaaaacaaaacaaaacaaaaauuguaaguuuauucaaauuauggauucuuaaacuucaugaaugacggggauguagugguuaauguaugggcuuuagagaguuaugaaaccauuuagaaucacauaugcauugcuauggaugaggaguccaugacucucaucaaauuuucaagaggugaaauaacuucagaaagguuaagaaucacuaauuuagagaaauaggugaauaguccaguauauauucaacuguaaucucaugacacaaguaagaaaaagcaaacuauuaucaguaauuuguagaugaccauauuaaacccacaaaugaauagaucugaaauauuggccgugugaauucuaccauucaauugagucaagaauuuaucauaugaagaaacugaaauagagaaugcagguugaagcaaagauagguaaaauucuuggggcaaaauuuuagcaaugcaucuuuuacccuucaaaaauauagcuuuauuaagcuauaauaugaaauaaauagcauauauuuaaaguguacaacuggauaaguuuugacuuauguaaacaccuguucuuuccuuccagagucgaguaguuuccucaggcacaucagcugaucaggacucagcugacuacuugagggggcagaucucuagaggaggcucucugggcagcccuuuucucuauucucucuccuacuuuauccuaggaacuccaaaugccuuggucuucccagauucucagcuccaucaccucaacccagguagucuucugugcucugucugguuccuccuuucuaugcugcaucuugaaaguaagcugggacaaugguaaggcucaccuuguuucccaucucccagggaacauauugauaaagugccugaugcccagagucuuguuucauauauuuugcccuuuuuuauuguuguuguugcuuuuguagaaggguaaauccugacccuguuacuccucccuggcuuuuauccuuucaauaacuaucacacaucuagaagccccuuuacucuuuaauaccaaccaaauaacuagaacauauaauccauaaacaacuuuagcaccauuuaccugugcagaaagaaaaauagcagagagaagauaccccugacuuuaacuugcauauuuuuacuugucuuucaaauuuuccuuaaucauaucagacauuuucaggguuuaugauuauuuuuugucaaaaagaaaacaagaggcuuaauuaagggaguauugaaaucagcauauuuuagagaaaaacuucugaaauuuugguuaccuacaaauaaccauuaccaaauuaucagauucuccaaauaggaauggaaaugguucaucuaucucuuucauuccuuccuucaccuacucccuccucccaccauacucaucccccauaucaucugaaauaugucaguuauaccacuucuuagcuuccaacacagcacuuugaacuuugaacaaaccagaaacucaggggccuauacgcaccaggcaggugauguaaacaaguaaaguggcucaccacuuaaucucucugagauucaguuucauuauccauaagaugugguuagccaugucaucuacuuccuagaguuguugugaagauuaaaugagaaaaaguuuaaucuugguaaauccuagaguuuuacaccaauaaaagucauuuuuaccaauaagaauuaucagaauuaaacaagcuauuguaauauccaaaacuaugauccugaaagcauaaagauuacauccaauauuucuguuuagaggucauauauuagaaauauuuccaucuaaauaaaacagguugcgccuaaaugguuaauucuuaaacaucuagaaaaggcagagcaaugaagccccugaaaauaaaaaauagguaaaauuuuaauguaguuuucauuccaccauguaaccuggcuuacaccucuaauuacaagacaguccucucugggagggugauaugaguuuccugcuuauuacuguacucccugcauccagcccagugcuuaagccuaguugggcaugauauuuauugaagaaauauaugaauggauagauggcuagauacauggaaugaaugguaugaauaacgaaucucauuuuaacuaauucuguuuuaacauuguuuuaaaucuguuuuaacauuguuuccucaggaauggaguuuggaauucagguggcuuuuucucagauuacuugaaguuugagcaguccaugauuuauaauaggcauauaacaaguuccccggguguuuaacaucauuaaauguucuucucuaucugauagauccuuuugcuaauauuaaacacacacacacacacacacacacaaauuaggaaaaaugugaaaacagaagaauuguuuuagugucauuguuaucaaacucucaaguaggacacauuuuuaaaaauaaaauagaauuugguaaaacuaagucuauaacagucacaaccauuguguaauuuuaccuucauucuacuacauuguauaauuuuaccuucauucuacuacauuguguaauuuuacuuucauucuacuaccugaagcaaauaauuucaauuccuaauccaaguaguuagaaguuaaugauaucuuuuugcucccuauaaaaccuggcagcucuaucuaagauggcgugucacagaaaaauuucgccauuuaauccuuaaaacaaaguaucccuuugcuuccccuuauuguagaggagagugauguugacauaaagaucaaacuauuugcccucaaaugccauuaugaguguauaacagagaggggaaaaugugcaauuuagauuagauuauugggcuucuagcagccucucccugugccaauuaugggcgacuuuccauuuacauauaaauagcucggaaauuccaacaccaauguacuugaaaacacugaaucaaguaguucagaaaaacauaaauuagaugcauuucaauuuaagguguuuacaacaagcacucauucaaguaaauaaaagaaauggaaucaauuuuuauuacagaaagcaacaucuuuuuaaauuauugaaauuauccccacacugcucuuaaacccgucaagauuucuuuuggcaugcuguuaguuucuuuugcaggggaagaaaggauuaaguaguuguauacaguuguaguguaauguggggguagauaaugcugguuuuuuauuuccucuuuuuuucuguguaagucagagaugccucuugagcuaccuggggccuuacaaaagacguaaauaaaaccagauacacuuuuucaacauaacuugcuuuuaucucucuggauaauccaguuuaaguuuucuguccuugucacauucucucccacugaaagacaucuuagaaugaguguaacuucauuagcagucucuaacugcuaacucaccacagauuaaccacucuguuuauugaucuauugcuuauaaagagccacuucaacgcccacugcaguuucucaaauggauuugauacaugguauaaacaaacaacucaguaugguagagaacaaacaauauuguauaucacugguaagggcugaguucucauuugcugaauucucuugagggucuagacagauacaagagaaacgaaggcugauguuguguugcuuauguauuguaauaauauuagugauguuauauauuuuacaaaauacaucacaauuauuuguucuuugaauaucuaaaaauauuuaguucacugaauuucacagauaaaauagcacaaucuaaaaugacuagaaugacucaauaaugaugugguugcgggaaggaggcagagagaaaaagaaacacuaauuuuaugugaaugaaacugcagaccauuuucugucacugggacggcuaaagucauuuagugggaacuuccugguuucuucucggaggggauucuggagguacacaggguagaaaugcucuuggucuacagacacagugaagagcuugcaaaaaugacuacuaugcaaguuucauuuucgacugauaaaugguagagauuauugaguaucuacuauguacagggaagucuaauacuguuucucuauguguuacacaauauucaggcacauaucuugauauaucuaaaugaagaacaaagaaaucucaacuuuacauuucauggggcagaagacucagaauaggacgaaaucuaaauucacagacuaaagcgguauuauuguuuauaaucacaaaagcuugacaacuuagaaagacagacuaggagaaaugauuccugaaaaaugaaaggcaaaagcaaaugaaacauuuaauaaggaaauuuaaauucauggguuaaaaauaagucauauauuuuaccuuaaaacucauuuuaagauaaauuuucuugaaguguauaguuucaagguucauaugguuaaaaguuuaagaaguucaaaaacaaauggaagaaauaaauuuaaacgaaagaauaauaguauaacaauuguuaaucaaccuuccuacacaaauuaaacaauuuaaaugagauuuuuucaacguuagccaaagcuugguaaaguagacuuacauugacaagucuaauaaccauuaacuugguaagucugucauauuuuaugagauuaagcacacucauacugagcacagggucagugauaaacagcaaauacuguauauuguuuggcaugaaacuuuucccuuggacucucccacauucucucucuuccacucuucagucuacauauuauacaaauuagaucuugcaaucagcauagggaaaucucauuacugcugaauauacuuaauaaucaucuucuuucuaaacaaagauaacagcaaacagcucugaggaaauguuuaugcaaagaaaaagcuauguaguuuauuucuaaugaagaugguaugacugucugcauaacagguuauuaaauacaccaucaaaaggagauucucuaaaaaaauaaacuauguugaauuucaagaugggccucauuauuuaagaagucauuucccuaacaguuucuagaugaugcuaacauaccaaacuuuuaguuaguauuccaugguuuuccuugcauucuuucuuuucucuuaauaucacacuauguugcuaaagaaaagguuauguauuuuaaaagaauaaaugacauacaucugcauauaaaaugauuggauuugacauaaggaagaaaucuuaugagcaagacugugaaaacuaagcugcaaaauaagauuuucuucaaaugucacuggacucugaaccucccuuuuaagaaaaucagaaauacaucuaauggauuagaauauauagugcaucaauuaaaauuauacuuacauaaaauaucuauuagccuucuaaaagaauacugcuuuaaaaauauugcagaaacuauccagacaugacuaaugggaacaaauaugauucuucuaaguaguuauaaaucagcugucaugauaaaauagucacuuauugcuugaguucucaauagauuuaaaagucauggacauugauccaauuuccauaaaccacugcauaaccuagguacaacacagaguuuaacagcuuucaugggacauaguucaaggauggucaaacagagaauuacaucagggaaggaucugguuucagcucacugggagcaacagagaugagagccggcaauaucuucacacuuuucaaagugcucuugugggugguugggcccucuagggaaguacucucuccauauuggaggugaaaaaauggaaacauaaaaaggucaagugacauauuuagaucaaacuauuaguaagccacugaagagauacagguagcuauuucuuugcaucagguggcucugaccagagaggaaucaacuuucaaagauuuguuuuaaccuaagauccaaagguuuucacugaagucauccagacuaccuaaauuacccuaucaaugucuacaguccauuagugauggucaaaugucuucuggcuuuuuugucaugaaucuaaaaauaguaagccuaccaaguuagaagaaaaugaaaugacuguuauaguuagaaaacaagguauuuggguauuucaauguauugcucaucauuuuccauaccagcuauaauuucagccacuucaauccagcaacacauuucugaaacuacugaaggagucaaccucaucuuacugauuuuuaagaaaauuauugcuagucaaacggaagaacagcuuuaaaaacacugacagcauaaguggcuucuggcaggauuccagaucaugcuucuugggcaaugugaaaagggaacaaaaaggcagucacuuaaaugagacagugagagaaucacaaaucauagaaucccaaaacccaguggucacaacuguuccuucucccaaguuccugauucuuuccagaaagccagacuguagcucauuccagcucauuaccacaaaaggaauauuggauucugccccaggagagacucaaucucaagagccaaaucacaaugacaaagaugugcagaguucaggauugaaccuauugcaucuaaucacuagcagaaaaucagaccacugaggcaauuguuuuaaauauuagucacuuccuacacuuccuccaucaucuaaaauuuuuuuaaaaugugaaaaaaaagccuauaauaugugcuaaaaacugaugcuacuuaaaaaaaaacuguuuuccuuucauugaacaaacucuucuuuccuuauuuccccauuuaaugugaaaacauaugaucucauaaugaaugccaacagaugauauacuuaguuuuauuauuaugaaguauuuuuuauuccuuucucuuccuucacaugggaucuguacaguuaaaauaucuacacaacaaacaugaggaagucagagaagaugccaauuugacugugauuaaagauuuagcuauguagucccuaaagaaauugcacugaguugcuauccccaagacuccagagguuccuuuguaguagaggugagcuaugaaguucucaacuaugaaagguuaauacaaauguauucacuuuauuuauauuaguaaaacaggauuaacuacauaguuacccacuguauuuacuauacuuuagagcaaaaaugcauacaguaggaacaauaaauaaaagcaaaaguauauauauguguauguguguacauacauauguguguauaugugucuguguauauauguauguguguauauacauauguguguguauguguguguguguguguauauauauauauauauauauauauauauauauauauauauaaaauauauauacacgagaauuagacaaguaaauggaugccauaggaugggaaccagauuucucacuguuagagugagagguuagagguaagcaagggagagugauuagaaucauccauauggugaugaauuaugguaggagacacaguaugaacacauguuuagcuuaauauagauacagauaauuacauauaguaauguuuauaguuauauguauacacacagguuaguaaucuaugcuuguauuucuucguucugucagcugagagggccuagaagcaaucacauaucaguagcaaugagcauaccuagugcccagaccuugguuucuaacaucacuccccaauaaaaggcauccaugcuccuugagaaaagggaugcuucuaggacaagaacaggaaauauaaaaagugagccuggaacauuuuguagugcuagaaaauaagggguguaggggugugugugugugugugugugugugugagagaaagagaaauccuauauugauguggauaugucaaagggacaccaaagccaacuaaaacagcucccaauggccaaagcugaaauaauuuaaugaccaaaauuuuaaaaacauaucggauuauaacaaaaaguguaaaauaaauauccacaagccuacacagauauaaauaaaugacugaauacauaaaugaaugaagauaaagaggcaaguauauccaacggaggaaauccaaaugauuuaugccuauacucugcccucaaagaggaagagaauaccucuccacuccuugagugugggcugcucauagugacuaucuucugaaaauuauaguauagaaagaagagaaaaauaauaacuuuacagugcagaaaccuggcaaacauuauuucagccaggugaucaaggugauaaaucauguugacaauauguacccuugauacauaaugaaaaggcacuuuaccucuguggucuuacuccagaaaaaaccuauaaugccgcuaugaccaugaaaaacaccagagauuuuuuuuuuuuuuuuuuuuuugagacagggucucacucugucaccgaggcuggagugcaguggugcgacuucagcucacugcaaccuccgccuccugggcugaagcagucaucccaccucagccacccaaguagcuggaacgacaagugggcaugaccaugccuggcuaauuuuuuuguauuuuuaguagagacaagguuucgcuauguugccuaggcagaucucaaacuucugggcuuaagguauccgccuaucuuggccucccacagugcugggauuacaggcaugagccaccgcaucugaccuggaccauuaguacuggcaaaagaauggaaaagcagaucaauagaauagaauggagagccuagaauuauguguagaccuacauaaauaugauaaacugauccuugacaaaugacuucauuaaaacuaaaaacuucugcucuaugaaaagcacuguuaagaaaaugaaaaaccaagccacagccugggagaaaauauuuucaaagcacacaucugauaaaugacuuauauccaaaauauaaaaagagcuguuaaaauuuaacaauaaggaaacaauccaguuaaaaaaugggcaaaacagggcagaguccaguggcuuacaccuguaaucccagcacuuuggguggucaaggugggcagaucacuugaagucaggacuuugacaucaaccucaccaguauggugaaacccccucccuacuaaaaauacaaaaauuagccaggcauagugguggaugccuguaauccuagcuacucaggaggcugaggcaggagaauugcuugaauccaggagguggaggcugcagugagccaagauugcuccacugcauucaagccugggugacacagcaagacuccauuucaaaaaauaaauaaauaggccgggugugguggcucaugccuguaauuccagcacuuugggaagcagaggugggcagaucacccgagguccggaguucgagacuagccuagccaacauggugaaacgccaucucuaccacaaauacaaaaauuagcugggcaugguggcaugugccuauaaucccugcuacucaggaggcugagucaugagaaucacuugaaccugggaggcagaggcugcagugagcugagaucgugccacugcacuccagccugggugacagagcgaaacuccaucucaaauaauaaauaaauuaaaauaaguaaauagauaaauaaaaauaagaaugggcaaaagauauggaugcccuaucuaaaaugaauacauaugacaaguauaugaaauguucaauaucauaugucauuugauaauugcuaauuaaaacaauuagauacuauuacacauucaaccgugacuaaaacccaaaacacugacuacagcaaaugcugacaaagauguggaacaauaggaacucucacucauugcuggugggaaugcaaaguggcacagccacuuugaaagaggguuuggcaguuucuaacaaaacuaaauagacucucaucauaugauccaucaauugugcuccuuguuauuuauucaaauaaguuaaaaauuuauguccauacaacagcccucacaggacuguuuauagcagcuuuauucauaauugccaaaacuuguaaacaacuaagauauccuucaauaguaaacaaacugugauacauccauacaacagaauauuacucagcaauaaaaagaaguaagcuauuaagucaugaaaaaucauggaagaaccauuaauguauauugcuuagugaaauauggcaaucugaggaagcuacauacuauguaauuccaacuauaugacauucugauauuuaugcaugagacaugaaaacauaucaauacaaaaacuuguaguuaauauucauagcaguguuauuuacaauagccccaaacuauaaauaacccaaaggcccaucaacagauuaacagauaaauaaauagugguaauauccauauuauggaacauugcucagcuauaaaauaaaauagaucacugagaauaaacuauagugacauaaagcacaucaguaguugccaggugguaggugugaugggagaagaauaacugcaaaaaggaagagaaggaguaugggaagugacgugaaugcuuuuuauguugaauuuuuuauaauauauugaaauguacacauaaaauuaaugaauuucacuguagguaaauuauauuucaauaaugaugauuaaaaauaaaguaguuacaaaaugaggagggggaaugcagcaaucacguauucaauucuuccuugacacaagguuguauaaaggaguugaaguacaaagaugaauuaagauaaaauucuuacccugcagugaauuuacagucuaguaaaaaaagacagacauguacacaaucaguguaauauaacuaugguaaguauaauaauggaguuauaaacagaauuuuauaggcauaggggaaaggcauuaauuauacaagauucagagaaaccuugcaaagaauuacgaaugaguugcgucuuaagaggugauuagaauuucagcaagugauguuuccuaaccaaucauaagguauauuucauaguuauuuuccucuauauuuaucuauucauccauugaucuauccuucccuccaccuaucuauccacccaucuaugccuagggaaaggaagggcuguagagaaaauucuauauugcgguauauagcaauaucuagggauuaaguuuguaccauaagaauuuguuauuuuguauuuuaugucuaauaauuucugcacagcaguuagaauaaauuuaugcuguauagaacugcauauuuacuuuaccuuagcagcaaaaacuuaaaugugauccucucagaaacuuaucuacuucaaaggguagccuagagcuaaaacaggcuaaugaccauaacagcaccagaaacucguuccagcaccuacaacaauacuuaauacuuaguaagagcugaguaaacauuguugaauaaaaccaaaacagacagauuguuaauucaacuuuauuaaacuucacagaggaaaacuccacauauaaccaaacuguacuuccauuacagacccuguaugguuacaguuuuuuaaaucauuuucucaaucgagucaauaauaggauguuaaaagaaaacagaauauuaaagaauccaauacugcuuugagacaggaucaaauaaagcccugcuucaaaacuguaacugcuucuccaagcuuacaaaaguggguaguuuuauuuagacuuacuauuacuacuucauucugcauuuucuacaaaacuuugaccaauaacacugguaaauggccaacguguaaagacaaugacagaaauaaaaagguaucaucuauuaacccuguuuacaccuuuccacaaaaacugauguuuggguaacugaaguagaaaagcaaaauaacauuuucuaaagcaagcaagaaauagaagauaacucuaaacacaaauauggacaacauaaccuaguaguuaaguacagaugcuuucagagaugagguuacuugguuggaaugagaccuuaaaccaaagaauacugcaauaaauagugauugcuucuacauaugugaucaacuacaagugaaaagggucaaacacacaggugauugugcagccauaauuuuugcaacauuguauacaugcugacauauaccaacgcuagcaauaauaucuuugagaauuauggacacaagcuauggcuagauacuuucaaauuauugacaauuuccuccugucaauaagaagaaaguuccagaaauguugcacaucacguuagauaacaauaagaaauuacuagauuauuuauuuuuaaaaaauuaucauuggaggaguccuucuuaacuaucuauauucuucaacaaaguaaccccuuuccuaaauggaaucaucugauauggacuggccuggucauuccaucuauacacuguauaacauuccacauuugaacuugggcaaguuaccucccugugccucaguuuccucaucuguaaaaugggaaugacaacaguacuuaccucacaaaguuauugugaggauuagaugagcuaaugaaugcaaugugcuuaaaacagagccuagcacauaggaaguucuauaacuuuuagucauuauuauuacuauuuuuuauuauuauugcucauauuauuccuucuuugcuaccaaacuacaucaauaaauauggcauuuuagaacuaguaaaaacuuagaacuaacauaagaaacacaaaucucuagaucuaguucacugcuucuuauaauaccguuuccuuuaagugcaagauuuaccuuuccuccgaaaccuuccucuauaaacugggccccuuaaugacaagagacgcacugugaauaaaauucuggucccagcucuaucuaggccucccagaaagccccagguaagucaucuccccuuuggggccucagcuuucucauucuuaaaauaaaaguguucgcauuugaggauuauuaaggucccuuugaguccuaauauucugauucaauaaauccuucagguucuuuaauguauuaauaugacauuauaaauuuggcuuuuugacacuuuagaauuuaucucuagacacuuaacuagauuauaagcaucaggauccucuagggcaggaucuuuguucucuuucauucagaaguuagauaguuuagccaaaaaaaagucucaaaacuaaaguauuaauaaagccaucagugcuucuagaagcaaacuggaauuuuauugauguuacacaucucuuuuuaaaauacuauuacuugauuaaaaagcuguugaauucuaucauauauucuuguaaaaguguauuuuuacaaaccagauaacuuuauaguuucugaguuuuggauagguaaauaaguggcuuaacauguucaaaacuggggucacuuauuuuucuaaugaauccauuaagauuauacauuuauucaugauaucauaagaaaucaccauguggguuuugcaauuaaaaagaaauauuuuuguuuauuaauguuuucaagugauauaauguuuugcaacagaaaaaauaagcauaugaaugaaaugucaaggaccaauaaugagcagucagaacugcugagcagaucccucccucuuagcuaguaacacugcuguauaggaucacucaggcugaaaaugaaauuuuuuacgaggaaaaauuuaacauuuugucaucauuacacuguugugcuauaacugauuuucuucaacaagguggcaggugcuucaauacuuaaaaugcuaagauucuuaaaccaaacuaacauauacauaguauggaacauuaaucuuaagauuuauauuuucaaauuuguagaggucuaaagguuuucaaggcagcuguaaacauauacaauuucucaaguggagguuuccaaagacugggaaugcaaccgauaagauauaaaaucagaggagaaacaguggaaaaguaaacauaauauaagagaaucacaacauguaaugcagucauuaauuucaugagucuccuuggauagguuuaaagcacacuucagaugcauuaguaggauaucauuuuauauuucagaaggaguacucucaagccaagcuucuuuguaguaaaugaaucauccagcuauauuuugugaaaaggggucauuuuaauuucagggucuuuuauugcccagcaagguaacugugaaaugacauucacaauauaaauaaauucaguugucuuugcuucaaagaagguaguuauuauucaagcauuuacuuucuagcuuaucuuacauacugagauuugcauaauagauauuggccuuguuaacacugaacauaaagcaaacuuuacuagaacaauuuacaguaauuaauuauguacaauugcuucuaauaaaaggcauaaugaaaagggagaaacuaugugcagaaaauagcaaaaguaagaugaagagaugguaaaguucacauaucuguuuguagaugacaguuuuaaauguacuguauuuuguuaagagguaaaaaaguugcggggauaucuuaaaguucucauccuaucugugucuaaauaaucuauccaucacagaaaaacucugucccauaggccagugugugauugauagauacuauuauagugaaauauugaccgcaccauaacuagcaaauguuacaaugaagaaccuuaauuugaaguuaaaauauuuucucauaaucaauaguagguacagcagcauauccuaacuuaagaggagagccuguggccaccuaaaaguacugacagaauuuaaaaggcaaagaaagagaguaagaauacacugauuuuuauuuuuauaaaaucuaaaugcaauuauucacaauuugggggugguaaaaaugaaaggaaaagcaauacguugguggcuaguuaauuggaagcacaguggaaaaggaguaagcccacagcacugccuacuuaguuacuguugaggauccuguccucaucaaugauuaguaauacaugaaagaggagaggaaguaguaaaaguuguccucuuuucaaaccugcuaaagccaacuagguucaaagacccugaacuagguuagcaaacucacuaaaaucaacuaugauccugaacgguaugcacugagcggucacaauaaccuaggcaccagcaucuaacuaaaauguaaagaggugaagaggaguucugguuuguucaguaaaacagacccuugggcauaaaacuauacaacuucuagcacucaguggaaauauaaugaauagaaaagggaguacauuguuucauauguuaaauaaucuauggagaagaguaccauuuucaauauuuuucaagccaauuuuuuaucugacaugaguugaaaugaagcauaguuaaaaauuaaaggggauaaucuuuauaaaucaaguuauuaguagaaaacagauuuuaaaauccagggaauugaauauuggaaauucucucaaaguacaaguaaucaaacuuggggacgauaacucauuaaucaaaaucaagguuucuacuuguggccuaauauaaauaaggugauagaaauauauuucuaagccuuggaauucagggaauuuuuuuucucuuacaucucagacuucaaacuuuggggaacaggggucauuucuuuuuguacauaacuucuauuucaaacuuugauaagcacaauguauagaauagaauggucugcuuuggaggcauaaagauagccugaucucauaucuuucaucauuuuucacauaugaguucacugcaucuguuccgaccaucaauucaaaacauguauuuugauuuuaauuuuggaaaacauaaaaucucaaauuuaaaagcuuaaguuucagaauguauuuauuaaaacucaguuauucaaaugacaacuggcguaaaaaauauaguguggucuauuuagggagucaaaaacauguucaaaacaucuaguuuauuuuuaauaaaaacagaauauauguuucuaaacauaagcaaaucucuauuaaccguuaaacuaacauaaauauuacacuuaugacacuuuaaggaagauaugcucagaugccauguuugguaaagcuuaugaguagguagauaccaccuggaaaauaaaaaacuaaauuuggcaucaaguauagauagcgcaauucaaaaaaauucucauuaauucaggucagugagcucuccccccuuuguauucccugcuugcauguuaguccauguaauaaaguauuaacaugguagugguuuuuuuaaaaaccaucacaacaaaaaccguccaguuuuacugcauuaaucaaaaguucacaaaaauaugaaacucaagaaguaauuccagcaucucuauuccucccuuaaucgugugcaaauuuuaccuaagaaauaucuucucaucuuccuaugccuuuaauuggcuaccacugcauugcagcagcacauuagcccaacuccauacaugcagacccaacuauaaaagggucuggacugggcagggugguucacaccuguaaucccagcacuuugggaggccgaggcggguggaucaccugaggucaggaguucaaggccagccuggccaacacagugaaacccgucucuacuaaaaauacaaaaauuagcugggcgugguggcacaugccuguaaucccagcuacucaggacgcugaagcaggagaaucacuugaagccgggaggcagacagaggaugcagugagcggagauugcgccacugcacugcagccugggugacaagaccaaaacucugucucaaaaaaaagggucuggucacuacacuacauaauuauuucugugauuaaaaaauuaaaccaaaguuuccaaaaauuauuuauuugaaaagaauuuuagguugcuauuaaauaacuaaauucuuuaaauagauauggaguugccaaaaugaccaauaauauuuuacagguggacaaauguuaggucaccuagacugauagcaguagugauauugaaaacuuuauucaaacaacuugaauuuuuauucuuacugaagcaaauacccaguuuaggggauguucuacccugaguuuaauaaaauguauucugccaaacaauuacagcaaagggaguguuuaaucaaauuuaucuaacauuugauuguauauccugaaaaucuuuuaaucuaaaagauauuuauaucuaauauuuaaauauuagauauaaauaucagguacagcagcauauccuaacuuaagaggaaagccuguggccaccugaaaguacugacagaauuagaaaggcaaagaaagagaguaagaauuugauuuaaauauauaaaucuaauauuuaauauuauauaauuauauaaaaucuuauaaaccuuauaaaaccuuauaaaacuauauaaaaucuaauauuaaaucuaauauuuaaucuaaaagauauuuaaaacugaugcauaacaaaagauguauaagauuuuaacuugggcaauaaagcaugguaugauaaaucaaguuuuaguuacaucacuuauaaauuuauaaacauuuauguuuauaaauuaauacugaugcuauuacuuggcucaaauauuguacugaggaaaaauacucaacuuuagcuugcauucacuuacaaacauacaauaucaacauacaauucuagcuguucugaguuaucauucccagcuaguauuuugguaugauaaucuucuagaagauaauccugcuuagggauuaguggcuaauucuuaugaccauguaccaccuaaggaaauuuaaauuauuguuuuccuggggcucacaaauuuuugaaauuuuuucauuaaaaaauauguaagugccuacaagguaaaauaauaugaaacuaaacuuagcugagguguggucuaaagaauaaguuuacagaaaaaaaggccuugaaaucaacuaaauuuguuucacaaaaugaguaaaaauauguguaaauaaaaagucuaagcauguacuucugucuucuuaaaaugugucuuuguggcagcucauucuaucuucuuuauuauaaauauccaauuauagaaaaaggcagcaaugaucucuuaacugccagaugaguggcuuuucuaguuugcauucuuuuaaccacucaggggcacauguaaaguuaaacucuuuuugauauucugucuuuccuuggcuuacgagauagcguuuuccugaaucuguucacucucagucuacauuucugauguguguuugucaccagucacuuaaguguuacuagaucccggggcccuauccuugagaaucuccuuuccuuuucuauuuguacucuucuacucugauggcuuaaaauuacuaggugcacaugauucugauuuguuuucagcccagggcuuuccuuugaauuucugacucacacuuccuacuagggcauagacaucaggugucccgcauauaguacauagggauaugaggcaaucuaguguaguuagugucaagagcauaggcucugaagauagaaugccucaguuugaaugcuaagucuaccaguugugugaacuuaaguuguuuaacccuucuguagcucaguuuccuuaucugugaaauggagguaaaaauaacaaucuauauuauagggcuuuuauaagggugaaaugaacuuugaauggagacuggcauauaauaaguauuacauaguguguguuaaaugaaauaaguaacacuauaauuuaugauucuuaaaauauuccuuauaaucccccuuaugcacauauuuguaaaguugcauguccugaguuuuaauauggccaucauagauaccauuuaaaguuuuuucuuuuuuuugagacugagucucgcuccaugguccaggcuggagugcaguggcacaauccgggcucacugaaaccucugccuccuggguuccagugauucucuugccucagccuucugaguagcugggauuccaggugcacaccaccacacccagcuaauuuuuguauuuuuauuagagaagggguuucaccauguuuggccagacuggucucaaacuccugaccucaagagauccacccgccucagccucccaaaguguugggauuacaggcgugagccaccaaucccagcuaccauuuaaagauuuuaucuugugcaaggguuaacuuggugauaucuaagcuugaggcacuuggauaaacaacaagcucaagcucaagcuagaugcucgcagaggucaaagggcuccugguuaggcaaagagaagcagggauauagagcaggccaugcuugaucuauuuuauacuccgccuaaaaucuuaguucugccuaagagcuuagugaauagcauggucugcucugccacaauagaugacuaacaucuaaauugggauuucaggauuuuaaagaagcuuacaacuuucaaccuuucuccauuccuucuaauccacaauacccuuuucuugacccacucucugguauucugaugcuagggaaaauaauaaagaaauuuaagaaggcuauaugucuugaaagggcagaaauuaugucuuguucacuguaacccagcaccuaagcagagugccuggcuuauaauugaaauucgauaaauacuucuugaauaaaacaauaaaugucaaaaguggauggggcaaaagaagucaaauuucuauuucuacagcugauacugcugacucaacaugccucagaaacaaccauauacuacacucccacuccaccucacccaauccacacauacuccuguaauuccuaacaguagcugcuaauggcccaaccuguaguaagucucaaagacaauccguuauauccuccuuuaauuuuuaaaauaugaaaagaaauacagaggauccuuuccuaaaggugucucuugaauuaagcacauccuaugauuugauuuaaguggcaaaaaauugauuuuuaaaaguguuaauacaguauaaugauaagguauuauaauuaacucagccaggaagccugaaauuucaugguuacuuaaugucccaccuuccuccccuuuuccucucaacguuaacaucucaacaguuuauuuauacaguacucaaaaaugccuauaggaaaauacauaaacuuuaaaugagaugcaaauuugacaucugccaguucagucuugcacaguuuuaucuucuccaucuuagcugaauuugagaguuuucuuuagguacaaauucauuuccuucuaaauauuauggguuaaacauuaaauacaaaaagaacaaacagaauaguaaaaagcuauguuucaauacuggaaaaugcaaauaucacugugugaccuuugauauaauaguuuuuuagucuaacaccagaaauaauuauaucaguggccugcuuccugccaucucuacagagguguaaugaagaaaucuuaguuaauauguacuagacaagaaaguagcuuagaagacaaugcuuuuaauuacuaaacaggaagcaaaaaacaguuguggacaggaauauuaaauagagaucaucacuugaccuucaaauacaagagaaugacuaauaauuuugucagcucuuuugucaguaaagggauuugauagggguauguaagaauguucauaguccgaaagauacugacccuuuaauaaaaauaauaaaaacacugaggcauucaccaaguuaauaauucuugucauuucaguaucaaucaaaagacauuaugucaagcaacuauauucucugaaccauuuucaguacagugaacuuaacuguucccugaaugccuucugaucuauuuagauguuucuucaccagcaucaucaaaaacauuauauagagucucaccuucauauauuauggaauaggauaaaaugccaaaugcagagaauuaaaucaacauugccuuugaucucuaaggaccuagaaucugaaauuguacauacugggcugagcaugguggcucaugccuguaaucccagagcuuugggaggucaaggccaguggaucacccgaggucaggaguucaagaccagccuggccaacauggugaaaccccgucucuacuaaaaaauacaaaaauuagcugggcauggugaugagcaccuguaauuccagcuacuugggaggcugaggcaggagaaucacuugaacccaggaggcagagauugcagugagccgagauugcaccacugcacuccagccuaggcgacaagagcgaaacucugccucaaaaaaauaaaaauaaaaauaaaauuguacacacuauaauucuggauaucuuuaugaacaaaucagauaagccauuugucaaucuacugucauauuucuuaacuauucaaaauugguugaugagugacagaugcacaacacuaacgcaaaaauggcaugaccaauggaaagaaacaaaggaaccaauuugauacuuuuuuuaucccaucaacaaguuacaaauauguaagugggcuuuaagugaacuaaugaaugacaaucuuuuuaaaguuuacauauauagacaguggguaguugacaacucuggagacuauuugauuauaauuuauuuauguuuauuuauaauuuauuuauacacugccuggacuuaaggcagcuaacagagcugugaaaauauaaugaaaaaauaacuuuaaaaugaaaaagauaaagcagagagaauauaaagauagaaaaguaauaaagagauaauaauuaauauauaaauuccagucaauauagcccugcuaggcaaaacugcuaaaagcacucacagauuccacuuucagcuuucagacacaaagauuacaacagcuauaagguaaaacaaaauuugcgucucuguaaaagaacaacuauuuggcuugcuaguuagccuacucagccaaaacaacaaaagaaauccuugauuuuuuccauuucccucaccugucagacucaauccauuaguaaauucuaugggcuuuacuuccuaaauauauccucaaaauaugcccauucuucauuucuaaugacacaacccuaguccaauauacuacccuuucucaucuggauucuuccaaaagccucuuaucuggucucugcacaauuuauucccuacauaguaaccaguaagaucauuuaaaaacacaaaucaaaucuugucacuccucuguauacaacugccuguggcuuucuacuguacuuucaacaaaauccaagcucuuucccaugauauuugugauccagaccuugaccaucucucuaaacacaucucuaggauccuuaaaaguaaaaacaggaggcaggagaacagucagugccagagugaugcaauauaagacucuaugaaccacugcuggcuuugaagguggaauggagccaugagccaaggaugcaggcaggcuguagaggcuggaaaaggcaggaaaacuaauucuccccuagagccuccaaaaggaaugcagccuugcugaugccuugauuuuagccuagugaaacacaucagacuucugaccuacagaauuguaagguaauaaauuuguguuaugauaaaccauuaaguuuguguuaauuugcuauaacagcaauuugaaacaaauacagauuggaauaaaaaccucccacccaagauaaaaauacagaacaaaauuaugaaacaucuuuuaaaaggguaacaauaagggaaggccaauaaaauaaaauuuaggagaaauacucacuagauaaaaauacaaaucuuaacauaaucuaaagaauuugaaaaaaguuuacaaacucaaaaagaugaaagaugacauguccauaaaauaaaacauaauucaaacaaauuaaaaaauaccaaguacaaaugaagaagaaacaauuagaaacacaagaauaaaauauguauagucauuaaaauuuuaaaaagaaccaauagauuaaauaaacuguagacuuaccacaguaaaagaaagaaguagaaauuuucaaagagcauuaagaggcacacaaugcaucccagaaagauaaugcaauuaaaaaaauaaaggagcaguuaaaggacaugagggagauauugagaagcuccaacauauauccaguaggugucacacaaaagagagaaagggaaacaaaauuaggagaaauaaugaaaaagaaguuuccagaacugaauaaagauauauagaaaaguauacacugaaagucaagaaggaaaacaaaaaauaaauccaccuguagaaacaugauagggagucuauaauaaaugaagauaaaaagaaaagcuuuucucauuagcaacagauuacagaagacuauuaaauacuauguucaaaauaugagggaauuagaacucuauaccagcuaaacuauuagucaagaaugagcuacauaaaagaugaauaucauucaaggucuauuuuaucuuaauaaugaaauuauguccauauauaccaaagaaagggaacaagggaugaaaugauaacaauaauuuacauuucgagguguuuaccacuugccaagccugguguuggggacucuacauucacuacuuucauucacggagcaaugacugaguacucgggcauugggccaagagcguacaucuaacacaagcuaauccuccaagcacuuaucagauaggcauuauauuaaaaauaaaaauaaaaaccagggcccauggaagcuaaagcuaaagcagaucuugcuaaagcaagaucauauaucuccuuugcuacuuucauauagcuccucagcuacuaaguggcagggaaucauuugcuuacacuuuugcuguuuccugucucuaugcuggaaacacaucguuaccucugcugggaaugucuuuucucauccccuaaccaggcaguuuaacuucaaaaugucuuuuuuguuuuuuuuuuguuuuuuuuuuguuuuuuuugagacagaguuucacucuuguugcccaagcuggaaugcaauggugugaucuuggcucaccacaaccuugccucccagguucaagggauucuccugccucaaccuuccaaguagcugggauuacaggcaggcaucaccauuccuggcuaauuuuuguauuuuuaguacagaagggguuucuccauguuggucaggcuggucucgaacuccugaccucaggugauccacccaccuuggccucucaaagugcuaggaauacaggcaugagccaccgugcccagcccuucaaaauuuauuuuaaaguuuuuuucuuucucuuggauuucaagauacaaccuugaagcaaacuguagaagccuuuuuccuuagucuuaaaauagauucuaugacccuccuuuucucaccguauguacucccuucacacucaucuaacuguaugcuaauaucuaauuaugugucuucuuagaaauuccaggggcuaauauugagacagacagacuuggucuagagacccagcugcaaaauaccagagauuaaggugguggcuaguuaacaacccagccauuguugagacaucaguccaagguccagguggacugggaccaaagacagacagccaccaaaacaagauacaugugcauuguacucagcccaauucuugcacaccuuccuuaucaagcuuucccuuuuuaaaugccugccauccccccaaaaagcgaagcaguuacuuuggauagaaauauggcugcuuccugccgggugugguggcucacgcuuguaaucccagcacuuugggaggccgaggcaggcagaucacaaggucagaagauugagaccauccuggcuaacacggugaaaccccgucucuacuaaaaaauacaaaaaauuagccgggcgugguggcaggcaccuguagucccagcuacuugggaggcugaggcaggagaauggcgugaacccgggaggcagagcuugcacugagccgagauugagccacugcacuccagcugggcgacagagcgagacucugucucaaaaaaaaaaaaaaaaaaaaaaaaaaagaaaaaaagaaaaaagaaaaaaagaaaucuggcugcuuccccuuuacuaguuuugguuaauaaguucacuuucuuucuaccagaucuugcucuuguuaacuggacucugcaagcagugagcaucugggccugcuuggcucgguuacaauccuucuggaacugauucaaauaccaccuuuguaaagucuuugcugaccaccaccaucagucaccauaguugcuucuauucuguuuucccacugagguacauauuguaccuuaaucauaguacuuaacauacuaacacugguuauuguuagaugcuauuuugggggaaggaggccuguaauaccaccauagucaauaaauauuuguugaauaagucaacaagcaaaauaacauuuuaaaauauauacuauaaugcuagguacaucgucaagagguugugauuauuaacgugaacucugaggaauauuauauuuguguuucauaaagacuauaaaaagacaacuuggucagagcaggauauuaggaagaagugaccauaaauaaauucauuuaaauaacuuacauuuccugagcaucuaucuucugcaaagauagaugcucauguacugcagggacaccaagcuggucgcuguccucagaagagauucugacauauccaaaugcuacguacauuaguuugaaaucuaagaaaaagugugcauuaaguggacccagaguuguuacacugccaugcucuauuaguagagaccaacuuaaauauauaccauuuuaucugauagccaaauaccuccaggcaucuuuuaaaauuaaaaugcuaaagaaacugcucuguuuaagcuuagggcauugauuuuuaugauacuucuuuuuuuuuuuuuuuuucuuuuuuuuuuuugggacggagucucgcucugucgcccaggcuggagugcaguggcgucaucucggcucacugcaagcuccgccucccggguucacgccauucuucugccucagccucccgaguagcugggacuacaggcgcccgccacuacgcccggcuaauuuuuuuguauuuuuaguagagacgggguuucacuguguuauccaggauggucucgaucuccugaccucgugauccacccgucucggccucccaaagugcugggauuacaggcgugagccaccgcgcccggccgauuuuuaugauacuucuaaaaaguauuaagggauauuaaaacuucagccuauagcuaagugaccuuuuaguuucuuuaaacuuccagauaauugaucacccuuuguaggaaguugucauuacuucagaaugucuauucccuuugauccaccccuuaaauucuacauacuuagaaaauuuucuuuuuucuuaaaaguguacguagcaacagaauauuaaauuggcucucuuuguccuaguucaucugaaauacugguuaagaacaaaaaacuauuugucaaauacuuccaaaacaaauuccaaagcaaaggcaaaaugcaagaccauuuuugcaggauuugcaaaggacgcagucaaaaguuuugcaguucagcacccacacugaggccauaaagggacugaagacaguaaauauuuaggggaaauuaacugcuguuccgugagucccaccgcccccauagggaagugugagaaaugaaaagagcuacugggagaugccaucugagagcacaguggacagacuggucugaucuuuaccaaagaaaucuaagaaacaggcuggcugaagaggacugugagggaacucuccucuccuuggucaaagguuucaauuuugaggaggcacagucucaaauuucaaaauuuauuccacuggaauagugcuaguaaaguaaaaugauugugcuccaaaaugaaguauauaauaggcauucaauaagcacucacuggauaaucccauacuguccuuucacgaaaaccuuuucuaaugcaaucaagugguuuuaauccauagaaauugauguccacugggagcaauacaguaaagaaucuuacagauuuugaagccaaauucaccauauuuaaauuauaacucucucacuucccccuucugaaacuugggagaaauuguaucaaucucuaggagcuuaguucuuccaucugugaaauauagguaauaaaaccuaguuagaggguugugaugaauaaagaaaacaacuguaaaguaucagcacaauacugaaaagucuaaacauaucagcccacucucucucaccccguuucuauugacgcguucuuucuuuagguauguuaauguuaaauggucuuguuuaaaggggacaucuuuuuugcugcuuuuugccuggcagauugacagucuuuuuaaagugaucuuacaauaugugaauuaucuaccguguguggauuuuaguaguuuaaagucuccguuucggggugacucaaugcaacucuaauugcugccuguuuaucaauaccagccuaaaaaauauaucauuuuggguucaacuacauuugugccuaauacauaccacaucuuuucaaaaguuacguauuuauuuaugcccuuaaaaacacacaucugugguauccaugcgccuuggaaaagaaaucagaacugggucaguugaaagcacaggauauauucaaacuguuuuagucaucaguccucuugucuagaaaacuucagugaaagcugaaugagcuaauuacaggaaaagaaauuaacaaauaaaaaagcugacuuaagaguugcugggaaacaaaggauaaaagaaaauauucagcauccuacauaaguaggaugugguuuaaguuuucuuauugcuugagccuagaaggucaaggcugcagugagcuaugagugcgccacugcacuccagccuggucaacagaguaagacucugucucaaaauuuaaaaauaaacaaacuuuuuuuuauggucuuaaguauuuuuaugcauuucccugaguccaaaaucaaaggcaaagggagacuaguguaugacuguuuauuucuauauugucagcauuuuaauaaaacuaugcauaguuuuucucuuaugucacugaguuauuuuguuucugagaccacugaauauuuucccuggggagcauaggaaagucuucaggaaacuauccugagcgaaugcaucuagugaacaguacacaggacaaagaaacaggagaggaccagucuuuguucuguguccucugaagagucacaucuauucuuauuaucaucagaauauauuucugaaguguuucaaagccuuuugauaaaaacucuuuauaaacagaaggcugcuuaugucaguucaaaaauucugaaauucacuauagcucaagcuuucguauuugaaaaucuccuggggaaaaauauuugagaaaugucuaccuuuugagauauaaguuguugucuaaaaaaacaaacaaaaaauggauucauucuaauuguggcuauucauggaaggcaccauuuuaaaaagucaaagcauuuauacauugaaacauucuuuuauugguaaaucuuagguugucccauuugaagaaucaugauugauucuaucauaagcagccuaucuuuuagaauaggugacaagaacauuggugauacuguaaaccaaaaaugaaauuuuaagccuccaacugacucaauggaccucuccuuuuggccuaggggaucccagagaaaucugaaaauguagcuuaggccuugacaggaauggaggagggauaugcuuaguuauccaugcucccuuuggaguuuaggcacaaaugaccagcauuaacauuaaaauagaggucaucagaaugacaaaacagauucuuuguagcaauacccaccuccaaacugucucugguauagcaucacaggaaagauggcaggcccugaaaggaaucaaaguauuuuaucccaaaauauauuucuuugacguauuuuaaaauggccuuccaaagccaucucuuguggaggaaauaugcauucuguagagaaucccuuucccuuuccaggucuuuuccugacccaggagagaguaacuaagagucugacaccuuuuaaggucugauaagagacauuuaccaucuauucucuuugaagccugcuaccuggagccuugaucuauuacuauauaacaagaaucuucacuuccaccauccccuuuuaccuuacuuaauucaagcauuuauuucuauuaacuucaacucuuuaggcaaagcuuaacuuuuucaaccaauugccaaucagaaaauuuuggaauccauuuauguccuggaagcucccccuucaauguucuagaugugcugcuuuuccaggcugaaccaauguauaccuuacuguauugauuuaugucuuugccuguaacuucuaucucccuaaaacguauaaagccaagcuguaacccaaccaccuugggcauauguucucaggaccucuugagacuguguuccuggccacagucacucauauuuggcucagaauaaacaucuucaaauguuuuauagaguuugacuuuuuuuuggucacuaguaucaauaguaauaucaauaguaguaucaauagccugccaagaaagaagacagagacuuuauagugugguuuuccccuucagaacaggugcuucuuugccucuacugucuaaauuaauaacuagcuucuuuguugggucauuccccuguucuuuccuccccuaaaagguuucuguuuucucccacaaaaauucagcaucagauaagcuuagcuauaucuguaucagaguguuagcggcagcgaauccauacaggucuacaggaaccucaauucuugccuucucagaagaaugaauuugacuaagggccauaacgcagaagcagagaccaaggcaaguuuuagaguaugaaugaaaguuuauuaaaaagcuuuagagcaggaacaaaaggaaggaaaguacacuuggaagagggccaagcaagcagcuugaaagauaugugcaugauuugaccuuuugacuugggguuuauauguuggcaugcuuccaggguguugcaucccuucccuccugauucuucccuuggggugggcuguccacaugugcagugaccugcuagcgcuugggaggggagcaugugcaguguguuuacuagaguuguaggcaagcucacuugagguguucuuuccuuaccagucaaauggcccuagguggucauauaccaguuaaacuccaacauuuugccucuuaauguacaugcuugagcucacucacccagcuccugagaucuuaucagggagcugcugaucaccaauuucagguguuuauagaaagacugccuuucccuagugucagcugugaccaauuauuauuuuagagagacagggugacaauugccugaccaucaccugaggguugccugacauuccugguggugggggcugagggaagaguccucuccugcuuuguucaugccugauuagcuaccuacuguaacaagaggacauacauuauaguagagcaagaaauccaagaaacacaucacagguaggaaacucuauucagugccaaaugcaccaaauaaucugcuauaaauaaguguaucucugcugugucaauuccacaagacuuaacaagaaggaacuauaucagauuacagaauaauaaaacccauauugcuaaacaaauuaagcauuuuauauuuauuauuuuaauucaaauuaaccaaguucuuuaugguagugagguaagguaauaaaaaaacaauucauuuucagagggaaauuagauuuauaugaaucauuaccaugagaagaaucaaugaauugguaauuuguaaugacaggaaaauaaaaaaaaugggucacuagggaaagaagcaaaucagugcacuaaaaucuuuaaaaccaccacaauaugugaaaacauauuuuuaagaguguacuuaaaagauuucuauuugauauauuuuaauauacaggaauuuaaaauucacccauacauugauaucucaauuuucaaaaaaaucuaugccacugagacagaagauuuuugaaucauucuguuguuuugacuuuuuaaauguccuuuucucuccucagcuauuuuuuaagcauaagagcuuuccuaucuugaagacauuuaaaaauaguucauucugaagaaacuaucaaagggacaucaacuggcacauaugcuuggcaucagggcacaccaaauggcccaauuaaaccauuugcagucuuuacaagauacaauuuaaauguacccaagaaaugucaaaugguuccucauguagaauuaucuuuaccaaugagcuaugucccaggaacugagcaccuaaaucccugcagacauccaugagguacaguuugucucagacacacacuggagcauguuaauuaccacagaagagaaggcguuuucaaguugaacacaacgaucagaaaugccuucuucaguauggaaaauauggucagaggaacaucaaacucugccagcaccucccucuguuggcaaguguauuccccauaccagguucuaaaaucaauugcucuaaaaucaaucucaggaggaaaaccucuauacuucuuccuuucuccacugggaaagucuucgacaguucaggauaugucuucccgaugugauaaauuuaaagaacaauaguaaaagauagaagagaauuccuaguaaaguuacaggcucaaucuauauauucuucacuagaaaaccaaaauacagcaauaaauuaggaaacaaaauaguugggcuggcucaaaagugaccaccacuaguagcacugacccucccacccaucccuuucucuagucauggauuugacacguuucuuccuucuuuuuuuuuuuuucccagaaacagggugccacucugucgcccaggcuggagugcaguggugcaaucacgucucacugcagucucaaacucuugggcucgggcaagcuucccaucucagccuccgaguagcuggaacuacaggugugagccaccacguccacuuuuuuuguagacacagagucccgcaacguucaccaggcuggucucaaacucuugacuuuauggaauguuccugccuugcucagccucccaaagugcuaagauuauaggcgugagccaccacgcucagcugaguuggcaaguuucugaacgugguucuacaccuggcacacugaugcaggaagccugcaccucagaaggcagagcucucauagcuuggcugcccuuacuuccucuuuggaagccuguuuccauugcuaagauacccugacagggauucucuuccuaacccguuugcaaaccuuugcucaggccucuguucucuuccgcacuaucuaacuuucugcugggugcugguuucuaauuuucuuugaccccugucuguugucaaacugcuuucguaggcuggauccuugggccgcacuucuucgccacucugcagaagcuuaauugcuguccuuggucaagaauauauaaugacaacugacugaaaaauaauccauuaggcuccaaaggacauaauggguagagggaugaggaaauucaggagaaggagcagaauuacuuguaagccuauaagcaucagccuaaccaguaacuaugcauauaucugaacauacauucuuauaaucaugggauccgaugugcuaaauucuaguagcuaauacgcaccaugccaauaccagaaauuuaucauauugauguauguguggcaaugacauacuuaggcuagugcuuuuagaauuggcauauuuaauaaaaacucaugacauugaacuauuuuuuaauauucuguauauuuuaucaauuaaagccuaauaucaaaaagcuauguuacuuuaaauucaucucuaauucuauauuuacagauacauuuaagaauaaccuguuuauuuaaacaacuaauauaucucugaguauauucauaucuauuuagcauggcauagcauuuaauagauuguuauuaaugaaaaucuaguaaaaauaaagcaaauaacacaaaugcagucuuuaucauuuauaacauaaucaguuccauaaaacacuacacuaaugaccuucugucaaccauauagcagaacauggcaauuuugcucagugauaucuucuuccugccucuuaggccuggaguuaagaugaagccugagauguaaaaccagacagaaaggaagcccuuauauuuacacacaauaauuacuuggaaauacacucaucagauuaaaucccucuaaauauauugauauaucaacaucaucaacaucguuucaaguagcuauguuagauauuuaaaacauuugagguaaagcccuuucguaauaauuacaggugacccuugaacaucacaggguuagaguugcugacucugcacuaucagaaauccauguauaacuuuugacucccucuaaaauuuaacuaccaacagccuacuguugaccugaagccuuacugauaaauaggcagucaauuaacacauauuuugugcauguauuauauacuguauucuuagaauaauguaagcuggagaaaagaaaauguuaagaaaaucauaaggaaaagaaaauauauuuacuauccauuaaguggaagcaauuaaucauaaaggucuucauccucaaucaucuucaccuugaguaggcugaggaggaggaagaggagggcuuggucuugcugucucagggguggcagagacagaggaaaauccacauauaaaugcaguucagcccuguguugcucaagggucaacuguauacaaguaccccaaauuuacuuaagaguuuaacauauuaaguuggauuucacuucuagauguaauuaccuuggaaacuuucauuuuuacucacagauaugauuuuuucaaauuguuaauaaaauucuuuuuugaguucauaaaggacacgacacuuugguugccaccgauaauaacuaauuuuaagaugcucucacgaaucauacucucuccuucucugcauuuuuuagagccugcuucccacauuugauucauuggcauggugcauucacccauagugcaggcugaugccuuccauaagguaggcaccagccaucugccuccuccauuccuccagaauaugaaagggacucagacugcuuugaguuaaucaucucagagaaaagaagacgauacuaaguugguuuuuaaaacaauagucuuuuucuauuguaauucuuauuaauuauagucuaacaccaaaaaaaaaaaacucuuuuguaaaucuuacagaacagauauguaagaauuuuuuaaaauaacaugacaaauaaaaauuaucccuugguuaauaugccaugggcauuuauuguacagaagguuuaacaauauuuaccauucauagaaagcagcuuacauauuaaaugcaacugaauaaaugggaaccuauguuaaaacugccagugaaaucacaccuaucagugacacuaguacucucaaaucuaauaaauauauccuuucauauuaugaggaauaggccuaacccuucugucaaaauucuaaucaacuggaugcucauuaaguauuauguggugcuuucaagccugaugaaaugcaaccucuaauuauuuggcaaucaaaagaaaauaaucaaauaaucacuguaaaaacuucuuucuuuaauguaaaacauguggccauuauaaaacauucuuguucaugaggaauuucuucaacuguauguauggauuuauauauauauacauaccugcacauauauacagcauauguauaugugucuguauuauauguauuaaaugaaagauuauccacauuuuguucuuuaggaucuucagcagcucucuucccaucacaauagaaaggccugagcuaacauuuccauuucugcaaaaggcagauuuuguucaauuaaaaauuauaaugccuuaaauuuccacaaacacaugaauuuaucuauuuuucuuuuacaaacccauauaaacauagaugcaggcaccccaaagagagaaaaaaagccacauccuuuuucuaacucaggcugucaucccacucaaagacaaucuauuauuaugaguucaaacaaaagacaacuaauaaaaauauuaucuacaaaaaauguacaccaagacuguacuguuauuacaaaauuauaauguguauuuuacacucauuucuaaaaugucuuggcuagcuuguuugcaauaauucaaacuucagauuuaaaagagcaaacaauucuuauaaaaaacaagcugaaacuaaaaagaauucuugguguuuguaggacacagucuauucucauuaaauaggaacucaggauagaaucacaaauaacacaauuaaagagaacaggguuccuuauauuauuauuuuaaaaugaauuugcgcauuuaugaauugggaugauuagagaugaaagaauaaaucuuacacagcucaguuugccacacuaccuucuaacucaucuuaaacacaaggcuuuaagaacucacaaauuauaucagcauauagaaacccaagaauacuuauacaaauuauugccaccuacuccacccuuagagaaauuagcagaagucuuaggaaaacacccacccccaacaaaugacccagccuuuacugacuugaguccuauccuacuaaugcuuuugaaaaacaaaaccauugaaaauggagcugaaaacuaaaaucauuaucuugauuuuucuuuaaaaaauucauuccauuaucucacuuugagacuuuaucacuguguuuuuuccuuccuuaugccuccuuucucacaucucuuuuuuuuaacuuuuuauuuauuuauuuauuuauuuugagauggagucuugcacugucgcugcggcuggagugcaguggcgcaaucucggcucacugcaacuuuugccucccggguucaagugauucuccugccucagccucccaaguagcugggauugcaggcaccggccaccacauccagcuaauuuuuuauauuuucaguagagacaggguuucacuauguugcccaggcuggucucaaacuccugaccuugugauccgccugccucggccucucaaagcacagggauuacaggcaugagccaccacgcccagccuucucgcaucuugucaaugguagauaaguaggcaguaccuuugccauguaaaauaggaccauaaacuaaaaugaaauuaaguguauuguuuaaaagauuuuaacuucucuauccacauauaggauaguggaaaacauaaaccuuuucugauuguucuagggaaaaguaagcauuuuccccucuauagcaagugacaaaagccuguaguucucuaaaauauuuaauuauuacagaccuaucuccccugcuagacuaacacuucaugaggggaggggucuauguuauuaucaccucucuucucccagggacuaaaauaguggcuaaaacauauaaggcacucaaaugcucacuuaauuuuauauauuuuagcaugaguauuugucauuuacauauucugcugaccaaaugggauaggcaauaagcuacugcucaaaauuuuaacaggagaccacaaaguaaauucuccccaaggguaaacuuaauauccuugccuucucaugauggugacuucaagugucuaaaaauauggcacucuacaugccauaagaagguacugccuuuucauucaggguaugaauauauaaauauaucuuugacuuuacagcauaugguaauaacuuaaaaauuauaugccuaauugugaaaaaaaaaaaagaaaaaaaaagaacucuucuugccagaauccaagucccaugaaaguagccaaugcugucucauuaguuaguaagcuaauggaaauguugccagcauuucuuucagugucuagaaaacagagugugcaaugugccaagucuucacugauuuauuuuuguaagcagcaguguaauaaacccaaagaagccaaaaaagcaaauuuuuaaaaaauaaauauucauuugcuaucaagauggguaugaccuuuuuacccaagccuauuacugacaauucagaaagacuaugugaaauagucacucauuuaucuuaauugcauuugcagguacuaccaccacucaaguuuuaaaauguuuuuaaacacucaaguuugcauuccuuuagcuuuuauacaagaaaccacauuauuuuacauacauauuaauuauuuucugaccuuucaggaaaacccaauaauauaaaucuacaaaaugaaauaauacucaagaauuccacuuuucucccuuagcaaugccugcacauaaccuucggcuuuaaauucacuguguuuuaugggaauucuacaaauaagcaccauagcggggcucagaaccaggcauguccaggaguaaagcugguugaguucuggcuccaggacuuacugguuguuaauacuuuggggcaaguuaucucagcuuucuaagcaucagucuuaaaucuacaagauggagauaauucaguauccaucuuaguguuuuugcaaaagaucuaaaugcauuaauucauguaaagugcuuagggcaacugaaaagucaacagaacucaauaacaauuauuauuaugcaucaauauggauacuuguuuaaaaauaagcugcuugggaaaauggauacuguguauauuuucaaagcuugcuuucucucccuguuuugauucagauacuguccuaaaacuuuagcuauuucacuuacuuagaugaauuucauccucacaaacuauaagaaaccuacauauuacgguucucggauuuagacaaaguuaggacccaauguuccuuuuuaaaacaucucaacauuucuauaaucuuuuaugcauaauaaaauaucaaaaauagacuagacuugcaauagaacaguguuuauuuucaugguugcauuccuaaaacaaauguauaugcgugaagucuggcuauuuaaucaccugagacggaggaguuucaugcuggagauagaauaucagcuaguuuucaaaaccaaguaagauuucagugguguacauggcauacaggcugggcuaaguaagauuaacagacugaagauaagugggcacauuauucagagcacagagauuaaucagacuggcuagugagccauauauacuagugagaaggugaucaaugaagcaggaaagacuaggaccaaaccacagagggccuugacugacucgcugagccuggacuuuguuuucugggcaaggaggauucauuuucaauaguuugcagguagcacugcuuggaggagcuggaaaugacgaaggggugaauuuaugaauucagagacugguaucaguugcucaaagugggggacuuaaaggguggccagggguaauuaauacucaauuccucucucucccucacauuccucaucugcaccuccuaucaaagcuacccccaaauacaucucaaguccacagguucuucaccauaagcacugccaccucaauuguccaugccaggcucaggucuucgacugcuuuagcaaacuucuaagaggucuuuugggcuccacuuugcacuguucccacccaguuuccaaaacacaucaauucuccacaguucagccaaaguaauauuuaaaaguguaaacucaaugauuucauugauuuacauaaagaccuuucaaugauuuuccuaugauucuuccauuaaaaucuauguucuucuucuuuacuuacaggagucuagcugcaugaauauucuuccauuuacucuucaaaccaagcuuccuccugccucaggaaauauuauuccuucuuuacagagugcucucccgccaccacaacaucauuucagagcuggcuccuuuccaccuuuagcaucucagauuuaaggugaucuccuuccacacuugcuuagcacccuuucuuuuccuuaaaguauuuucuguaauuuagagcucuucuauuuuguacauguguauuaguccauuuucaugcugcugguaaagacacaccugagaucgggcaauuuacaaaagaaaggaauuuauuggacucacaguuccacauggcuggggaggccucacaaucaugguggaaggugaaaggcaugucucacaugguggcagacaagagaagggagcuuguaaagggaaacucccauuuuuaaaaccaucagauuucaugagucucauucauuaucaugagaacagcacaggaaagacccacccuauaauuaaaucaccucucaccaaguuucucccaugacacaugggaacuaugggaguuacaagaggagauuuggguggggacacagagccaacuguauuguucugccccuaccccucccaauucucaugucuucacauuucaaaaccaaucaugccuucccaacaguccccuaaagucuuaacucauuucagcacuaacuuaaaaguccacagucuaaugucucaucugagacaaggcaagucccuucugccuaugagccuguaaaaucaaaagcaaguuuguuacuuccuagauacaauggcgguacaggcauugggcaaauacagcuguuccaaauggggaaaacuagccaaaacaaaggagauacaggccucaugcaaguucaaaauccagcagagcagucacaucuuagagcuccaaaaugaucuccuuugaccccaugucucacaaccaguuuacacugaugcaagacauggguucccauggucuuggacagcucugccccuguggcuuuacaggguacagcccuccuccuggcugcuuucaugggcuggaauugagugacugcggcuuuuccaggcacauggugcaaguugucaguagugcuaccauucuggaggucugggggacaguggcacacuucucacagcuccacuaggcagugccccaguagggacucuguggggacucccaccucacauuucccuucugcacugcccuagcagggauucuccaugagagcuccaccccuacagcaaacuucugccuggauauccaggcauuuccauaaauccucugaaaucuaagcagagguugccaaaccucaauucuugacuucuaugcaccugcaggcucaaaaccauguggagcugccaagguuuggugcuugugcccucuaaagccacagcccaagcuguaccuuggccccuuuuagucauggcuggagcagcugggaugcagggcaccaagucccuagacagcacacagcacagugacucuaggccuagcccacaaaaccauuuuuuccuccuaggcugcugggccugugaugggacaggcugcugugaagacuucugacaugcccugaagacauuuucccuauuuucuuggggcuuaacauuuggcuccucacuacuuacgcaaauuucugcagcaggcuugaauuucuccucagaaaaugggauuuucuuuucuacugcacugucaggcugcagauuuuccaaacuuuuaugcucugcuccccuuacaaaacugaaugccuuuaacagcacccaaaucaucucuugaaugcuuugcugcuuaaaaauuucuuccuccagauaccuuaaaucaucucucucaaguucagaguuccacaaaucucuagggcagggcaaaaugccaccagucucuuugcuaaaacauaacaagagucacuucugcuccaguucccaacaaguuccucaucucuaucugagaccaccucagccuggaccuuauuuuucauaucacuaucaggauuuuugucaaagccauucuacaagucucuaggaaguuccaaacuuucccacauuucucugucuucuucugaacccuccaaccuguuccaaccuuugcuuguuacccaguuccaaagucgcuuccauauuuucuaguaucuuuucagcagcaccccacucuacugguaccaauuuacuguauucaucaguuuccaugcugcugaugaagacauaccugaggcugggaaauuuauaaaagaaagggguuuauuggacucacagcuccacguggcuguggaagacaacacaaucacacggcggcagacgagaagagagcuugugcagggaaacucuuacuuuuuaaaccaucagaucucaugggaugcuuucacuaucauaagaccagcucaggaaaaaccugcccccauaauucaaucacauuccacaacacaugggaauugugugaguuacaaaaugagauuugggugaggacacagggccaaaccauaucauccugaaggagguggauugauagaaugguggaauggcuuuuugaagucacaauuacaaugccaacuaggugauaauacuuugcagggcuggggaaaaguucuccagaaggcuguauaugcucugaaucagcauccaaaauaugauacuguuucucccauaucuaggauucauggguccaggaaucaaaggguggaaguagaaguggcaccauucaccaucaucccuagugauccaauagcaaaauuuuugcuuccuguucccacaguauuauauucugcugcccuacuggucuuaaauccagagggggaaaugcugccaccaggaggcacaacaaugauuccauuaaacuggaaguuaagguugccaccuggacaccuugggcuccuccuaccuuuaagucaacaggcuaagaaggggguuacaguguuggcuugggugauugacccagacuaucaagaugaaagcagucuacuacuccgcaauggagacgaggaagaguaggcauggaauacaggagaucaauuagggcaucacuuaguauuaccaugcccugugauuaaguucaaugagaaacuacaacaggccaauccaggccggacuacaaauggcccagacccuucagaaaugaagguuuaggucacuccaccaggaaaaaaauccaagcaugcugaggugcuugcugaaggcuaagggaauacggaauggguaguacaagaaggcagucaucaauaucagcuacaaccucaugaccaguugcagaaaugaggacuguaauuaucaugaguauuuccuucuuuuguuaaaaacauguuugugcauguauacacuuguaauaagaaaauaucuucauuuuauuuccuuuuuccuuuaucaugugacauaagauuuauugacuucauaucagcauuuaaguauugcuaacuuuauauaauagcauuugguuuggggauuggugcauuuccgguuguagaaaggauagcuauauuauguuagacauaacuaagacuuuauuauugucuuuauuugaagauuagguaugaucucaggagauguguauggguucaaguugacaagggguagacuugugaugauuaauacugagugucaacuugauuggauugaaggaugcaaaguauugguccugggucugucuaugaggguguugccaaaggagauuaacauuugggucagugggcuaggaaaggcagacccacucuuaauuuggaugggcaccaucuaaucagcugccuguguggccaggauauaaaggaggcagaaaaacaugaaaaggcuagacuggcuuagccucccagccuacaucuuucuccugugcuggaugcuuccuguucucgaacaucggacuccaaguucuccuguucucgaacauuggacuccaaguucuucagcuuugggacuuggacuaucuuccuugcuccucagcuugcauacagccuauugugggaccuuguaagauaauacuacuuaauaaacucccuuuuauauacauaucuauccuguuaguucuguuucucuagagaacccuaauacaaugugugugugugugcgcgcgcguguaugcgcgcgcacgcuugguugguuggcuuggcuuuugucugucucccauagcaggcuguaauuuuuuuuuuuuuuuuuuuugagaugaagucucccaggcuugagugcuauggcgcaaucuugacucacugcaaccuccgccuccuggguucaagcaauucuccuaccgcagccuccugaauagcugggacuacaggugcacgucaccacgccuggcaaauuuuuguauuuuuuaaaaguagagauggggcuucuccauauuggccaggcuggucuugaacuccugaccucgugauccacccaacucggccucccaaagugcugggauuacaggugugagccacugugccuggcugcuaggcuauaaauucugaggacaggaaccacaucuguaccaggaaaaaguaggccuucaauaaauacuauugagugaauauuuuaaugaacaaagaauaauuaaaggaaugaaauuuuaaaauaugaaaauauuaacaauaaaaacaaagcagaaggcauuggaaaaaaagauuuuugugaaggaaauaggagauggaugaaagaaauugcuucagaagauaacguuuaaaauagacgggaacuguguuccagguaccgcacuagaugcuuuacauugguuaucucuuaauguuaagaauuaaguaauucucaaaggcaauggccaaauagcuaacuuuugcaacuccagauccacucucccuauuguuuuccacuguguaguacagaauuuaaccuucccccagaugggaucuggccuuuguccuuggcuucugauggguaaucucuaggcccccgaaaugucaggagugucugauugccuggaggccuugggucaugcuagagagucuaccaauaugaauuacgguagggccuggucacauuaguaaaaccaauaauucaauuuaauguaaggguuuuggguuacaugguaucagucaaccuagagacugagaucaaccacagaggcaauccaucaugucuaugauuguauauggagccucaguacaaacugugaaccccaagaccuagguaagcuccccugcucagcaguacucuauccauauugucauacauuuauucuaggaaaggaauguguccugauuccacagggaaagacaauggaaacuucaugucugguacuuuccuggaccugcucuaugugcuucuuucacuggcugauuuuaguuuguauccuuucccuaucauaaaccacaaccaugaguauagcagcuuucaguaaguuaugugagucccucaagcaaauuaucaaauuggaauauaguuaugggaaccucuacucagaugaaaucaguaucaaaggagagaucaguguugggaacuguucucucuaacuuuguaguuggcuuaaacucucauaucuaccacagucucugaccugggaagcugaccuauauggaugacauaaauaggcguaaccucugccuuaaguuugggugggaccaaugcggagcccagauaaaggcuagaggcagacgggagggagaaccuagcauuuacgaaugugcuucucccccaguggaacugccuuagauuggcugugucauuuuuugauaccaagucacugcuccuucccuucucccuuuggaaaagcacauuuguaauuagauuaguuccuuuaaaaauaaauauuucucaacuucuccuaaucugaguggacuauuuauuuuacuguuggcaaggucaccaauacagaaaagcacuauuucguaggaaaacugaugcucaaagagacuaugaggaaaaagaaaaaaaagacuuguuuaaaguuacaugguuaagaggugguaaaagugacauucaaacccaaguuugucuaauggccaaguauaugcucuuuccauuaccuuaggccaaagaaaaauugacaaaggagauaaagaacagcaagagaaauagggaaugaaccaggaauaugcauggucauagucucuaacagauaagagaaucgcagcaagagauuaaggauguggggagaaguaugaaagauauaaaauccuucaaagaagacuuaacgcuuaguaauccuucaauuaaaccagugugcuaccaggauauuugaagugugaagcauuaaauauaaaaaagaaaaauaaauaaauaaaaucauaaaccauuuugcacuguagaucaauuaacagugguaaagaagaguauauguauauguguaucagcaaauguauacacacucaccuacauacauacauacaucaagagaccacagagaauacagacuaagagaaggaaagagugugagaagacagauggcuaaauuuauuuuguguaucacuaguaauuuugcaaaaauauuugugacugaugggcagcauuuuucauugugagaaauaaauauuucauaauaaacuuugacagagaaaaauauauuuuguauagaauaauuucucacaguuccagacugauauaaauuaauauguaaaaccaccaagaaacaagugauuggucuucauauuuucaugaaaacaauaugcagcuuaaacuugucauuuuaugaauauuuugcaaaacaguacugcuuuacaguucugugggggaagugagaaaaagcucaagauguaggguuuaaaauuuagcaaacauucuucaaucaaacaaaagaaaugcuuucaaggaagaauauccaguaauaaauuacaaucauuccaaguacuuauuguuuuuauuauuuauaauagcacaaguaucagcuuuuagcaacagagcaaccucucagugauaucguaagccaauuaaaaagccuccuucaauuuccaacuaaaauguaaauacagaaaauagcaacauuaauagacccugucuagucucugaacuuuaaacuucccagaacaaaccaugagaucauucuaauaauuuuagaaaugacaugucagaagccuaacucaaaucccauuuguuguucuguccacuaaguuagugggcuaucagggaugauagccaauacaauaaaguaaugauugccaacacaauaaaguaauaguucuuugagagagucgcuuuuuacucagcacucagucuccuuagcuaugcacauggauaacuucugguaauguagaauggacacuauauugagccaagaggcuugcuugguaaaugauuccuuuugcaacuuaagcaaauaacuucauuauuuuauuuuguaauguucccaucuuuaaauugaggguacgagacuaggucuauuaaagcaaacagauuccuuccuuuguaccaacuuguuuuacuggugaugacugcugggcaugaagaaggaugcuuugugcucagugagaaggaccacuuugaucaauuagcaaugacuuccaugggcaagcugcaguagaaauguuguuuaucugacauaucugggcuagaugauuguuagcugcccuuugaacucaaacauuugguaaaaugaggaauaguaaugaacuaaucuauaacaauaggacauaaagagaacugaaacugagugaguuuuuaauccaucaaauuagaaacuuacaguggguacuaccuagggucuuugaaaaguaaaacguucuguuucuagguaaaaaauauuuuaauauauuucuuuacugcuauuuagagauuauuauaaugaagacugauuacuauaaugacaaauguuuaguagcauuuggauuccaaacacauagauauacauguagauacacaaagcaaugaguguccgagacucucugcaguauugcucauaauacugcucacccaguuaccauuuagggcucacaugaggaggcgagauggggugaucuggaacuggucuccuuccuggagagaaagcuaagguagaaugacagcuacacaaaucauacaaaaaaauugacccccaggaucucauuagaucuuuccagaguaugcuauugaacaaguuuccagggccaaagacaggacaauguuccacuaaaaaguuauucuacuauuugcaaacauaucaugaaagaaaccacauuuuagccuuggguaccggcaucccuaaaguuucacauccagggugcccuccuucaaagacaguccauauauaacauaagaaaggugauaaauauuauccagaaccucacaacacagauuuacagguuggaaggaaaacaguuuuuagcuaaaguaguucacauuuuugugaggaauguaggacuagauguaaauugauagugaaaaaaaaauauguaaagcguaaaguauaaaguccaaagaaucuuugaauaaugaaaagaaaguuauaaauucaauuggaaaaaauacugagcaccacaaaacuacaaaggguugcaggcuucaccucacaaggcagccuuugcaucugaaaauaucagcagucuaacaugcugcaaaacauuccacaacguuuaaaguagcauacuguauggcugcacugcuucugucauggcaaaugaugauuaguguucaguccacgaauucuauuaaugguauacagagaaaaaauuacagagaaagacaacagcuagaaaaaacuuauuuuuuuuuugguuaaauaaaaauguuaucugucuagaaaggaacuuaugauuggauauuuuugacuaagaaaauaaggaagauugauaaaaacuuagaguaaguuguuuuugcaaaagagacuuuauaaguuugccaaauugagccucauccaagaaauacuaauugaguuuaaaaggauuuucccuagugaguugaaaucacuaauacacugagaaacuccagaaugcucugcugcaccauaguggccauauuuggacaauauguaaggcaccuuggacagcagguguaguauaugauauuuuaacugaaccuuagauacuuuaaaauacaacaaaccuacacuucuuaaauauaaguagacacaucuucaaguuguaguuagguaauuucaaagauuaucuauuugauauuuuccuugguacuauuauuaauucaagucucucacuuaaauuucggaucaggagaaaaaucaugacuuuaaaaacauuuguacuuuuuaaauaacaugauguuauauauuacuaaaaguuuauagcuuguaaagaacuuauauaaaucaauaacaaaaagacagauaacccacuuuaaaaauggguaaaggacuugaacagacauuuauugaaagaagauaaauaaauggccaacaaguacaugaaaaaaauuuucaacauaauuagucauuagagaaaugcaaaucaaaacuaucagauguuacuucacacacacuaaaauuauaagaauuuuuaaauccccacacauacaaaaacaaaaaauaaagacuacugguaagaaaguggagaagaaauguaacccucauacauagcuggugggaauguaaacuggugcagccaauuuggaaaacaguuugaugaugcuucaaaaagguaaacauaggauuaccauauaagccaguaauuccauuccuagguacguauacccugaaacuaaaaauacguacucaagcaaauacaugcacaugaauguucauagccgcacuauuuauaauagucagaacaugaaaaaaagaaacaaauaucugucgauggauaaauggagaaacaaaauguuauauauacauaauacaauauuauucagccauaagaagaaguacugauucaugcuacaauguggauguaucucaaaaacauuauacuaagugaaagaauccagacauaaugggucacauauaauuccaacuauaugaaauuucuagaauagguaaauucacagagacaaaaagcagauggguaguugccaagagcaaggggaaagggagaacaggaaauaacugcuuaauggguacaguuuuuuuuugguguggugaaaacacuuuguaacuugauauagguggugguuguacaacacugucaaugcauuaaaugccagcaaauuuauacauuguacauuuauaaaugauuacuuuuauguuaugugaauuucacuucaauuuuuuuuaaguuaauacaaauuuucauaaaguucccaagacugcugaugauaccauccacuaaaaaaaugaggggucaugacaaaugagugaaaauguuaaaaggaaauauuacccaccagccaaauauagggcaauuuaagaaucacaauaaauaaugauacuaauagcuuacaacucauuguugggaaaaaaaauccauuaguccuuacuggcacuaaacaagaagggagaagagaaagcucuuccuuacaacggaauggaauuccaacuaguaaauacaaaaggaaugacagaguuagaaacaaucauuuuacaacaucauaauaguacuugauucaggcaagaaucauuggugacugcaaaacuauuucauaaaaguugaugaggaauauaauauguauacaaaauacuuaauaccagaaaaaguucacccuacaguggagaaaccuggcagauacuauguuugcuaaagagaucacaguugaugucaccgaaucuggggcaaacugguaucuugugccuuuugauaugaugaacuuaaugcaguguaaacugcauuacucucaaaauguguaaccucaauccaugcaugaggaaauaucagaaaaacccaaaaauaaaagacauuccacaaaacucaaaaaaaaaaaagucagcaugacaaaagacaaauaaaagcugaaaacuuucagauaaaaccagucuaggcugggugcaguggcucacaccauaaucccagcacuuugggaggccgaggcaggcggaucacgaggucaggagauugagaccacccugauuaacacagugaaaucccaucucuacuaaaaauacaaaaaaucagccgggcgaggugguaggcaucuguagucucagcuacucgggaggcugaggcaggagaauagugugaacccaggaggcggagcagcggagcuugcagcgagccaagauugcaccacugcauuccagccugggugacagagcaagacugucuccaaaaaaaaaaaaaaaaaggagucuaaagagacaugacaucugacaguaaugcaugauccuggauuagaucauugguaaaggcaaagacauggcuauaaggaacauucuaggaauaacuggugaaauuugaauauggaauauauauuagauaauagcacuguacugauguuaaauauacugaauuugauaauuguacugugguuauguaagagaaaaacuucuagaaaggaugucggguuaaagggucauuauaucugcaaugcacuuucaaauaagucaacaaaaaugauggucauaaaaaugacaaugaguguauauauacacauaaacacacucauauacagccauaucgcuauauguguguggugggggagacagagagaggaggagagagagcaagaaugagagugggugugacagacagagaaagugcauaaagguaccaaaauguuauaaauugcugaauauuuggggguucauugugcuauucuugcauauuuuuuacaaguuuaaauuuuuuccaaaauugaaaguuaaaaauuuaaaaaguaguaucccugagauaguuuuuuucauucaagccugcaugcuuguacagaucugagacuauguucucagccauauucucucuuccuggccauuuuccucuuagaaacauggcaaacagaaaugagaaaucccauuugcuuaacaagucuaccugcuugccagugccagauuauucccuguggcaucauuuuuacuucaacuuugaguacauuuuuaggagucucaaaugugugggauuccauuucccuugagaggcaucuucuguuaacucucuuuuccugaaauagagaucacccuuaaauguuuccuuaguuguguuaccaauuauguagcagaacucugccacucaggaagauacuacuuauuucuaauggucuguacacuaauguucuuuaauuauuaaccuuugucuuuguuguagggaaauuugagaaauguuguauuugggauaaauuguugcauauaaguaugcauguguuauuggucagucuucuguuccucucuaucccuuggucuguccacagaacccaggacaauguccaagcucuaauaucugaccauucaaauggaaaucacuucugcauagauaacacuugcuggacucugcuuuguuacccaguaauuuugacuauugaacuacaugcucacaaaacaucaaagcuggaagggacaccagagacaaccagguuuauacccucauuuuacaaauaaauaagguccagacagguuaaaugaccuacccaaacuaauacguuaaauugaagucagagcaaaaauaagaaaccuaguuuauucacuuccugaccugacugucaucuuuccaccuacaaugaugacucaucgacugucauuuagcugauuaucacuuuguguuugagagaauuuauagaauacuaauuugcuuuucauaaacaccacacuugcaauaaacuuuuaaagcaagauuuauuucuagcaaugcugaaaaagccuucuuucuuaagguucggagcaaaacccaguuaaucuugguccuauguaaaauacaugggcacaugaugcauaucuuuagucuucucauuuuuggacauauuucugccuaaauacuuguuucucugccaacuaacuagaauucucugaacaauauuuagaucacuuuggaaaagggaaguuggcucacagaguuuucaucuacacagacacagcuggaaaccaaaauucuaauguucuuccuaauggggcuugaucacaauagaaaagggugacagagucucaauuuuucuucaaaugccuuuuuaacuuccacauuccaauaccuguuuuuccuuucauuucugguuuuggccaagauugcaaucacguauuugguuuuagcaauaaggauaguuuugcaguacuuuuggcuacgaucaaaaaacagaaaugcggaaaauaucaagagaaaaucuauuuguacauagaaucuuuaagaacaaagaaauuugagagacuuuggcaacgugcaagugacugauaagaaccauucaacacaaugacagagaucaaaggcuaaucagcguggacggaaaagaucaugggaagcaagaaaguggagagaagggcuaggaggcaaugggguucaagaacugugauuguaaugggagcaaaaaaauuuggcuguuauauuuuaaauagcuuguuuucagacuuuuuuuuuuuuuuuuuuuuuuuuuuuugagauggaaucucucucugucacccaggcuggaguacaguggcacaaucucaggucacugcaaccuccaccucccggguucaagugauucuccugucucagccuccugaguagcugggaccacaggcaugcacaaccaugcacugcuaauuuuuuguguuuuuaguagagaugggguuucaccauguuggccaggcuggucucgaacuccugaacucaacugauccaaccgccuuggccucccaaaguacugggauuacaggugugagccacugcacccgaccuuguuuacagacacuuaaaaguuuuauuuauaucuaucauaaaugaauauuaguaguugccuaaucugauagugaauauucuguuuucauaauacucgaaauugcaggaacauuuagaacagucccuccuuucuucuugagaauguuuuuucucugagccuccauaacacuaggcucuucuggcuuucuuuuugcugguugcucuuucucacuguccucugcuggcucuuccaucuuuauuucacauuagauaauagagugcccgaggucagacucucaggacuucuugucucuguguacacuuuuuccccacguugucacaucuaaagauagacaugcugaugacuucuaaauuuacaccuuaaacuccgaucucuccucugagcuccaugcuuuuauauuuuaaauuugauguguccauuauuucgcuaaaagguagcccaggcuuaacucacuauucugaacuauuagaaaaaaacauaauguuuuacuuuuguuuacagccaauuuaauuguucaccucucccuuccacuugccagcuaccagaaaaucaaaugaacuaaauuucuuaucuaguuaaaauuuggucuagucuaauaguuucauagauccuuccaauaauacuucauuucucucuaggaaaaaaaaguuugguucuucaaauagccccccucaugauauugguggggaggaguccauuggccuucaugaugauccuguaugugugcuagcucuuugcuacucaaagugugaucuguggaccagcaccaccaaugucuccuggcaggcuguuggagaugcaggcuaaacuccagcccuacugaaucagaaucugcauuuuaacaaaauccuuaggugauucauaagucugagaagcacugaagaucugauaucuauucaaugugccccugaguacuacuugcacugcugacauugaaagcugugaucuaugguugguaacauuuuuguggagguuuggaugguugauugccuuaauguggggauuuuuuguuuuuuggccccauugguuugcugagagccugauaguucuuuguagcugaaucagccucaccucagccuccacuggcagcaaccuccugaaugacucauuugucuuccauucagucuguagcucaggaaucagcccagccucugcuguugggacccuuuguccauuagccuucugucucucaacccagcaucugugguucagaaaagcuaaaucauagggaaucccucuguccacauaauaguguggucaauuugcuguggcacaguauaaaagugaugggagaacaaagaggugauauuuuaccagagaugggggcaaugauguuauuguuuacuuaaugcaccuacccaucuccaagcuaaagccacaaggguacgucagaauacaccucucuaacuaccuuacucucaucucucuccucucuuuucucccuaaaaauccucagggcaaaauaaaaggcuuuuacuuuccuucuacuauauuuuauuuuucuucuuucugacucuagcuagaccucaauagugaaugaggucucuccuccaacuagggaaaaauugcaugagcugagucucaggcucagguggaaucaggaaaaucuuaucucaagaugaaaggcuggcuugcuguauuuggugcagaaauucacaaccuaaggccuuuguauuaguuguuucuucugcugguugcauaguuauauuuuugcaaaacaaagcugcaucuuauacugacuacuucuuggaauuucuuguuacaaaucugaaucucccuucagggaaauaaaugacuagggcugaugagggcaaaguuuuuuguuugguugguuuuuuuguuuuacaugguuaagcaacagauaaaagcauuuuaagcauuuuaaaacauuacccuuacauuacaugagaaagacagaauucuguuuggggaugagggcaacuugcucuucucucggaaucccgccucucacuuuauagcaccauuauccacauagcagcaccacugucuacuaugauguagaagucugacuuaaauccucuuuugucauaucccuuauacacaauccauuaacagucuuuauaggucuggguuuaaaauaucucuggaauacugucaucucucaacaucucuucagcuaucagggaaguccaguauucagcaucuguugcuccccuuaacuccuaccugccucuaaccaauucuccauguagcagccuagugaguuuugaaacagugaguacaaauuuuaaguguacuaauaucuccacccuacuuaaaauugucuaauggcugcccauuacaauuaaaauauaauuccuuuccaugguucgcaagacuauaggagaucucaucccuggucaccauucaggccucgcguccuaacacuuccucuuuguucauuacucaugcacacuggccuuuuucugucccuaggauaugccaaggaccuuugugcacacuguucuucugcccguuauacuuugccuuuguuucuuggccugacucuucuuucaacauucaugucugugcucaaauguuaccuucuaaggcugaaccucuuuaauacugcauguuaauaaucccucuuuguuauucacuauaauauuacuuuguuuuaauuuuuuaaugguauuuacuaaugucuggaaucauuauuuacuugcacguuuaucguugccuauuuaucgucuaccucuuacaucaccccaaguaacauuucugaaaacagugacuuuauuuuucaccuuuauaucccaagcaucuaggacaaaaccuggacaguuguucaaauauauuuccugaaggaaugaaugaaaaaauaaaugcuggcaagggcaugauagaaaugagacucauacuugcugugugaacuugguaugcgcuuucaggaaagcaaucuguauaauauaucaggagucuuggaaugccucaaucuuuuggucuagaaugucacuuaaagcaauccgguccacugauuauugcuacugcauuaucugcauuauucacaauauagaacauuuuuaaaaauuaggaaacaaacguccaauauuuggagaauggaguaucuauauaguauuaauaugggcacuaaaauaauaaagauuauuuuuaugacauaauuuuuaaaauauggaauauuuucuacuaugcaagggcaaaaaaauguaccaaaguauaccaaagugguauauacaauauauccuuugaugugcaaaugcuuucuuccccauuucuuuauccuuuuugaguuuucaaaauuuuuuacaauaaagcugugguauuuuuuauuuuuauuuauuuauuuauuuauuuauuuaagauggaaucuugcucugucacccagccugaagugcaauggcacgaucucagcucacugcaaccuccaccuaccagguuucagugauucuccugccucagccucuggguagcugggacugcaggcaugcgccaccacacauggcuaauucuucuauuuuuaguagagacgggguuucaccauguuggccaggcuggucucgaacuccugaccugaggugauccaccugccuugaccucccaaagugcugggauuacauugugguauuuuuuaaauaaacauuuuaaaagccaacauuaauuuaguuaaauaacauagaaggaaucaaaaucaauacauguuucauugaauuaaauaugacauuaauuuuuuucuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccacccaccucggccucccaaagugcugggauuacaggcgugagccaccgcgcccggccuaauuuuuuucuaaauucacuaaaucuaauacuauacaaauuggcauuuacuuauauuuaaguucacuauauuuuaaucauucuuagaauuuuaucuacccuaggaagacuaguuuugaccugggccuuaagacaaugucccaaaucgcacaugagguacugcauaauucaaagcacaugugugcuugcauaugcauaguaaagaccauaacauuuuuaaauuaguaaaugagcuccuaacuuuaugauuauacauauauacugauaauuuggauaauaacuaaagucuccauuugucuucaaauuauaaucuccuaugguuugaauguguccccaaacuucauguguugaaagcuugauccccaaauucauauacugauggcacuuggagguggggccuuuuggaggaaauuugguuuagauaaagucauuagagcugagcucccauaaugagacugguagcuuuauaagaagagaaagagagaccugagcaggcaugcucuugcucuuuuaccaugugaugcccucugccaugugugaugucauaagguccuuauuagaugcagccccuuaccuugaacuucgcagccuccagaacuacaaaaaaaaaaaugucauuucuuuauaaauuacccagucuaugguauucuguuacagcaacagaaaauggacuaagacacaauuccuuuguucuaugaacaaauuuaagucuucuaaacaguacuuacuucuccaaacaaaaugaugcuugguguuaauugaaauguaggacuguuacaguggacugcagaucuuauugcugcaggcagaaacagaauuauaaugaauaucucauguucugugguacuuggaggcauuuugaaaacucuuccauuaagagaauaaaauacaaacauaaccacuguacuugaaacaaaacaagggcuguuagauuugacucaauccuuucaaugcaauuuuauccaauauauauauguaaacauacacacacacacguauauacuuauauacacauguauauucuuauauacauaaauauauguauauucuuauauacauguguguauuauauauuauguguguauaauauauaauguguguauaauauauauuacauauguguguauguauacacacagaauauuucaaaaaagauuauaagugauugaaaggacauggaaaaauuagacuuuuuagcuaauugucuaagacaguuaaacauuugcuguuuccaucauucuacacucaauuaagccaggcuaaggaucaucuuauaaaugcugacuuuguuguauuuuucucauaucaaacaauucaguucaaucuccucuuacuaaaugcuuacuauacgcuaggcauugugcugaggaccaggaauacaaagaugcagacauccuguucacugccaaauuuugacaagggaccaaauauauauccauuuuacaaacagaaacuucauaguaaguuucaguauuagaauuuucuugucagcagccaugauaucuaaacugcuaaauauauacccuaaguaaauauucuauaagcacaucagaucagaaacagcuggcagcuucaggcuguucauuucaaaaugaauugaagaccuguaaucagacuagugaggauauuauugauaggauaaguauuuguguacuuucacaugaauaaacuuucuucuuucaugcuuucaaauuuagggccuuuuuagugguguugggaugccccauuaaaugcuagaaaacuauuuaguuuauccuuagucaauucuacugaauuuggcaccucuuaaauuugguugaggaagaaaucugcaaaagacaauuacaugaaauauauguuuauuaaaaaugcgagacugccaauauauuuaaggaaaaaagaaaauguaaaaacaaacaaacaaaagacuuucuucugacaaugcuguguuaguguuucacauuuauaauuuuuuaguauuaaucuguaagaauccaugaaagaaauaaacuuguacuugcuuauugugccuguuucuagauuuuagacaugcuagcaccucuuuguaacaguggucuuccaaagagagacuugaccaaccugugcacagagggaguguccuuagugcagugcuaaagcucugggcuaugaguccaaagaucucauucauucauagacucuuuugcaggcaagacacuaacugcuaugacagucagcaaaaaguaaaacaacaaguaaucuauacauauuuauuaauuucugcauuuguggauuaacuguguugauacaucucucguuugcugaaaggauuaaaguagcucaacacagagguaagaaugacuuccuccugugacuuucuauauggguguagagguggcaaccucugacuaggugucugcauagcaaauuguauacuuuuaaaauaacgucauugaccauaucaaaaacagggagagggaugauaaagaauauacuguaaugaaagucccgcaaacccuacuuuccagagugaggaagaaagaaugauugccugauauuuuaaguaggagcugcuuucuuugcuguagguuggcagaagcuggagaguggagcaggagucuccuagaagcaguguuuucucacuccaaaucugaguuggaugcucauuaaugagcaccaagcaccaguuugcaguagccauucugaauuuaacaguaaccauuuggaggcuacaaauccugaggucugacucugaacauguguuuguuuauuggcacagggauagcacuacaccauuuaguuauaaaguacaacggagcaaaucuacauuaauaugagaauccauauuuuguccugcuuuuucuauaugucacacuucucagugagacccuaacaagagcaggaauuaagaauaggucagaagaacaucugcuuuucuuauuuugauuacgugggcaagcaaaggaauuugcuuuuauaacaccaaaauaacuuggaaugcggcaaaaauaaacgcaccuucugucucauggaauguuauuacaguacaacgcuuugugaaugcuuguuggcauuuucaagcauuuuuuguucuccucauuucuuucucagcuccauaaugcaauccucaugguuugagcacuagacuucaaaugagacaucuauucagagaguguucagacaaaacgagugguuuccuuaguaaugggaacuaugugaaagccuucagcacagccccuucagacagccaggcuucucccaggcuugugguucacacauaggcucucagugagcauuauacagcuggggagcacccccaaagucuaaacugaccaaagcacugaauauucauugcauuucuaaucaaauguacccuuuauaaaagguuaaagauguaagaagugcucuuaauggcgaggguuaauuugcucauuuucugcaucaugucuauggaauggaaagaaagauaagcgauuuugccaaaaaaaaaaaaaaaaaaaugacacguguugcucuuuuguuugauuguauuuuacauuuccuuaccuuaaaaaccuaagccuguccuauucuuguuccuucuaugccuaaagacuacuacucugauuuuccaguuuucugcauaacaaucaucuucaauaaagcuuugaaacucugcuauuaaaacagggugcaaauguugccuuuuguagucucaaauauauuuaaaauauaguaaaguaguuucauguauaccaauguugaaguuuuauguauguguaucgauccauuuuguuauuuaguuucaggacgacacaauaauuagaaaaagagcuggauaauacaauugucauucaucuuaaauauugacucuuaaaggcagacaaauaacaacaacuauccaaaauaaaaaccaacaugaaaauaauaaaaaauuaucucagcugauauaauguuugccuuugaggaauaaugauuuauagauaccuucacacuauguuaaucauccaauuaggagaauaaaaauauugucaaacauuuugggguugaaaaacaugagguauagcuaaauuguuagucuucuaccaugaauauuuuuugucaaucugguuacacauaagcaaacacaggaagcaaaaguuaagcuauaaaacccgcaaaggagaggagaacgagggccucaaaagaucacugaagagaagaaaauacaguuuuaagacuguuggcuuugaagccugacuugcauucuagcuuuccuucuucacuagcgugacaacuguagaaguucaccaaccccaguuuccucuucugugaaaaggggaaagucccugacugccucacgguacuguaagaaugaaaccauaugugugcagggucuaccaaguuucagugucuugcaucgaguuaaacucaacaaaugcuauuuaauauuauucuagguacuuuaauuucagcauacauaauuucugcauguguacagcuaugcauauuuuaaaaucugaucuauuucauugugguuuguggauagcucaaggaaaaucauuucuauuuucugaauaauaccaauaauaaauauaacaacaaaaauacuaaauuugcugucaagaaauaauugaacugaggaaugaagagugaacaguaagaaguaggcuugcuaaacacaagugugagccugacuguguuguggaggaagggaagaauggacuagaagguaugagauuggaagcaagaaagaugaacuagaaaagaugagacuggaagcagggaaguuaggagaaauugcagcagccaagguaagagacgaugaauaucuagcagacagagaagauaauuuaagaaaacuucagaguaaaaucaaguuguauauggugaaaugcaagauaugaggcacaagauccaaaguuccuguaauucucuagguaacgaggcagcagcagaaauaaaauuaaaaaaaaaaaaaaaaaagaaaggaaaaaagaagaaagccaguuuaggggagcgcuuaagaggucagcuuuagacacguagaguacagagugccuggggaucacgcaaguagagacauuuaccagacaauuggagggaaggauugauagguagaaagauagauagacggauggauggauggaugcacggauaaagagacugauuaauuuuacuugcaagagcacugauauagguuugaaaguaguaauuacauaguaguagagacaauauuaucuaagagagcauauaaagaacaguaggcaaaagaacaagccuaggauaaauacuuaagagguagaugaacccacaaugacaagagacagaaugugcagacaagcaugaagaugacuuaggaggcuuugaugugcaauaaccaaauugggagggcacugguugagauuccaaagcagaauuucaguaacaaguuuggauuagaaaucagagaaaagucaacugacaaaguagguagaaagugaugauaugauuguagcaaauauugauagcucuucugagaaacuuaaugugaggagaacagagaaggaaagauagaugaggguucaggauuaaagggaugauuguuguuauuauaguaugaguaacaaguaaauguauggauuuuguggaaauauugcuagauauuguuucacaucgcuagaaaaggaguaaaagucaauccccugagugaaaagaauggagagagacauagagaaaagccaagaugagagaccuuuuuggaucuacagagaaauauaaggagaaacauagggaagaauaaaggaaucugaggaagagacagagaaaaaaauuugucucauugauuccugacaugucauccuugauugugaauuucuuggcauagugagauuacuuuuguucuucaaaugauucguaucuuucauuaaaaguaagaccuuuggguauauacacaguaaugggauugcugagucaaaugguauuucugccuuuaggucuuuguggaaucacugucuuccaaagcaguugaacuaauuuacacucccaacaacaguguaaaaguguuccuuuuucuccacaaccucgucaguagauugaagcuaguugauuaggauauuuagcuguuaacuaaauuuuuguggguuugcgucccauuaaucuaguaaggacucaguaagguguuuuuugacuuuuuuaauaguagccauucugacugaugugggaugguaccacauugugguuucuauuuccauuucuguaaugaccagugaugcugagcuauuuuucacaugauuguuggcugcacauauuucuuuuuuugagaagugucuguucauauccuuugaccgcuuuuuauaaagacacaugcacauguauguucacugcagcacuauucacaacagcaaagauaugaaaccaaccuaaaugcccaucagugauagacuggauaaagaaaaugugguacauaaacaccaaggaauacuaugcagccauuaaaaaagaacaagaucaugucuguugcagggacauggaugcagcuggaggcuaccauccuuagcaaacuaaugcaggaacagaaaaccaaauaccacauguucucacuuauaagugggggcuaagugaugaaaaaucaacagccacuggugccuccuggaggguuaagagugggaggagggggaggaucagaaaaaacaacuaauggcuacuaggguuaauaugugagugaugaaauaacaugcacaaaaccccgccccaugccccauguuuaccuuuguaacaaaccugcacauauaccccugaacuuaaaauaaaaguauuuaaaaaaaagacguggacugguacuguggcucaugucuguaaucccagccauuuggaaggccgagguggaagguucgcuugagagcaggcugggcagcauagagagaccccaucucuacucaaagaaaaaaaaaagaaaaaaaaaaaagaaaaagaaaaaucagcaggauaugguggcuugugccugugguccuagcuacucuggaagcugagguaggaggaacauuugagcccaggauuucgagguuauugcagugaacuaugaucaugccauugcacgccagccugggcaacagagcaaaaacugucucaaaaauaaagaaaaaaaaauuaaaauuaaaacaaaaccuauagguaaauaagaaccucuguuuuucuccaauucuacuuuccaaaacuccuuugaaaaagaaaaugagaacucugacccaacuugcuuuaguucaacauucuaacaaacagucaguaguacuacuacucaccuuacaucauguuucuaacugaauugagaacuaaucuguuauuagaauuagaccacaaaggacaaagucauugaagaccuuccuagcacaaugucagccccucaccaucagugacucauucauauguauuuagcuuucugagcauaucgacucauuuuuuccacuaggcacugcauuucuucagagcucuacuucucaaaucaugacagcaauaaaaauuccgucaucaaaccugaacaaccacuacuguauaaaagcaaccacugucuugugcauaaaacuaauuccuuuuuaaaaauaguauuuuauuuuuggcaucccuuguugcugacuauauugcauugguuggcucagccauccaucaagcauucauuuauuuuacaagugaauauugaguaccuugugcaguagaaagagcuuuggcucuguaagcagacagaacugaguucaaauuuuagccucauuauuuaauaguuuugggacauugggcaaguaagcuagcuucuuucagccaauguuucuacacugccaauugaagguaaaaauaucuaucuuugccgggcgcgguggcucacgccuguaaucucagcacuuugggaggcuguggcgggcugaucacgaggucaggagaucgagaccaucauggauaacauggugaaaccccaugucuacuaaaaauacaaaaaauuugcagggcaugguggcacgcgccuauagucccagcuaccagggaggcugaggcaggagaaucacuugaacccggaagguguugguugcagugagccgagaucgugccacugcacuccagcuugggcaacagagcaagacuccaucuuaaaaaaagaaaaaaaaaaaaaaacaacgaaacacuagaauagcuauaauucaacuggaauagguauaauuuauauaucaaucccaauuugaauagaauauuuuugaaguuaauauauauaaaauauacaaauauauguuagugcucgacagauguuauuuuauccauuuuauaugcauuguggagcuuaaaaacuuaacaagacauauacucccucuaggagaaucuuauaugcuaaaaggggaaacagguaaaauuacagaaacaauuauaauaccaaaaaaaugguaaguaauaagagcgauaaagagugcuauugugggucaaaugagagauuauaucuuguuaaaggaggaaaacaaugaccaugauaacaaugaccacuaccauaauaaugccaguaauaaugucaaacauuuguucaagacuacuauauuucagcacuuuucuaaacccgguauacauauuaacuguuuuaauguucauaacaauucuaggagaaaaaugacaugcagagauaauacuuuuaaaccaagaugcacgaugauacuuaacagagaugauacuuaacaugaugcucagagucucuaggaaguggcaagguaaggauucaaacccagacauuguggcucuaaaacccacauucuaccgacuguccaggcuacuuuucuaagaaaagcacacaggcgaauaaagcccaggauuugaugaaauagcaauaaacaaguuaaaaaucccaaccacuaagucagugaauaucuacuguacccaauauuuucuuauuugaugaugaaggcaaaacucuuucaguauaauuuaaggguuguaauuauucauuuacauuuuaaaaccauuucaauacauuuccauuaaaacucaguauucaucuaggaaacccuguagacauuuccuacaauguagguaacauguacaaccauguaauacugugguuuacaaugugaaauuucucugaagcuuuagugccuucuaaaggaagaaacuuaaaaaaaaaugaagggagagaaggagggagaguaagaagaaggaagaaaagaaggagaagaaggaaaagaagaauuagcagagaccugucaaucauccaguagaugauaggguaauaugguggaaaaaaccuggaauaccugaggggcucuauccuggcuuuaaugugccaacugugugcuaagauuccaugguucucauuugaugaucacucacaauuguauuaauucaaaaacccuaaaauccuuacuguauuacaauguaacgucuucauaugguacuucauuauauagaugugauaccaaaauaauuuuuucauguaucuuuggagagagccacauuucauauuuacaguuaaggacugaacgcccugauaagugaaaaaacacccaaaacacacacugauuccauaaagcugcugaugcucuuggaacaagauagaaauuccagucaaagaacagaaucgccauccuuuucauccaaagccagagucauuuucucuuucacauuaaaaucucauuucuagugcuccaugauauuaaauuuauaaaaaugaguauaaaauauuuuaaauuuaucauguaccuacauuaaaaggacaauugcaggaagagcacucugaucucccacuuucaaaagagugaucauuuaguuaaaacaacuuccuaugaaauaauguaagauaacauauaaauggcuaccuuuaacaauucuaacugaaucaaaacugaaaagauuuuuucuugauuucugaaacagacugaaauuuaagauauuagguaugacugcaguuucauuuaaaaaccaagagaggaguuuaaucauguaucugacuaucacaacuuaccuucauuaugggagugcauuauaauugguuugauuacuggacuugucaauuauacagucaauaccaaucaaugaaaauuaaucacuuaagauaccauggcauaaauaaaaauucucuuuuuacaaauaauuaucacaauuuuaagauuauucuuccauauguggaaauaaauccugcagauacugaaauaauuuggaauauuaaagaaacuaagauuugcuagauuaaaauuaagggguaagaaggaugauuauuacuauuauuaaaaguacauuaaauuauauguaaauauacucuaacacaacaucccaacacucaaccaugaucccuaacauacagaacugacucagugcuuucugaguaaauacuagaguauccaguaaauaauaaaaccuuacaauaauauucugaaauaaguauuagguuaaaugagaugcuacuuuuaucuugaacuuauuuugauucauuugaauaaauucuuauagaaaaaaacauuugggaacuguuucuagaaaacuacagagugaaaauauucaguauuuaaagacaagccuacuguuuaaaauuuuuccugguauuauuauuauuauaauaacugcaaacuauuguucuaugucaugucaauaagcacuuaaggagcaauuagaugugaagguuuuguuuuuuuuuuccuaaguaaaucuaauaagugccauuucucuuuacuccacuagaggguagucucucaaaacugggguuggagucaugacuagccugcuuuugaccuguugauauauuaauccucauguuccauucuccucaacaagauguuucucuaguauacuaauuaagguuguaaaacaugcauuuuuaaaacugcuuuuugauuuuucauguauguucuuucagaaauaugcacugcuauguguuucuguguuuuccaaauuucugguaauuaauaaaaauguuuuacauguauggcuuauauaguauauuuuccugggaaauauccuuucagaguuaauaggccuaagaauaaagauagucuuuuaaauaauuuaacuuauuacaaucgaaauauuuccccagagugguaaaaaauacauccuaaauacacacacacacucacagauacacaaacacaccuacacauguacccauucauauguagcuccuagauuuauuacaucauauaaagagaagucagugaguauaauuagaaauacauauuuuuaaaaaguacccccucaaaugccaauguugugaauuacagagaggcaaauauaugcuuuauuuuaaaaaucuggucaauccagacaagaaaugucauugcuaaaaaaaaaaaaaaaaaaguguuauugaacaccaagcacauaugcuaaauuaaguaggaucuauagagaaccaaaugccacucaaaacaguugcaagcuucucuucuuaaauaaugcagucauugcugaacuucagagacggaguuggagguuugagucucuaccagguguuuuuaauauuuaggaaauccuuaucaguaguguguccucucuauuugcagacugaaaacauauuucucugaaugacugauaaccuaaaauugagaaaacuugucaaaaauucccaacauucccucagaaaggaaaaaaaagaaggaaaaugauaccuaggaaaacaugcaagccuguuucauuuauuuguauccuaagcagcagugucauagaacagacaguuuguuucagccaaccagacuggagcagcugcgagugcuacaucuuggcugucugaagcgauuggcuccucucuggggaguggaggguguucaguuauuaaugaccgcugagcaggcagcaccaugucagugugacaacugaucgggugaacgaugcaccacuaaccaccauggaaacaaggaaaaauaaagccagcucacaggaucucucuucacuggauugagagccucagccugccgacugagaaaaagaguuccaggaaaaagaaggaaucccggcugcagccuccugccuuccuuuauauuuuaaaauagagagauaagauugcgugcaugugugcauaucuauaguauauauuuuguacacuuuguuacacagacacacaaaugcaccuauuuauaccgggcaagaacacaaccaugugauuaucucaaccaaggaacugaggaauccagcacgcaaggacaucggaggugggcuagcacugaaacugcuuuucaagguaaguuuaaaauacacauauauuuuaaaauacguucuauuucuugucucuucgaugaucauguuuuuacaccuaaauccuccuuugaugucuucuucuugucugaauucuaagagcauuuuucuuuuauugcacuuuugagaagaaauucacaugcaaaacccagcuggcucugugugugccuagcuguguuugugagauucuccaacaugcauuuuacuagcuugaaugcccauuagaggaugugagugggagagaaaaagcaguguuggggggaggagaaaaaggagggagacagaagagaagggaacagugggggagaagagaggaggagagggagagagaaggagauggggaagagagaagacagagaggagacagagaggagaggagagucacgggugauggggugcaauuuuccuuuuucuucacauuauuuguagugaaaagcagaucacacauuauucucuguuuugaaaucaacccaccaaauggggcauuuuuauuuugucucauccaguggaugcaaauuaaggcaaaugcuguuguauguuaagagcuaaaccacuaagcagaguagcagaaugagcauaucacaaacaguuauugaauuucugccaggcuacaucuuacggacugggguaaaugacuucccuuuaauaacauccccucgcuggucugaagggacagugcaaaugucugauugcuaaugcagcuggaacugccacacacuaggugaaaggaucccaugaaccagaagaguucuaaucuuugguaauuaacaggaucacagcaggauggcuuuaaaguacauuuccuauuuaagaaaauuguuuguucuaaccaacugcuauauucccuuugcuguuguugagcuggauggcuuaauucggcucuaauuuauucauuuuuaacaauauguccuuguuucucugccucuaauuucagugaaagcaggcuaugaauaugaguagaaccguccuaauuuagugaaaaggggauaaugugaaaacaaaaauagaaguaaagguucaaaauaucuaccuagaaaauagugugcucugguaccauaaauauuacugauauauuucucaucuuuaguuucagaagcaaugccuuugagacagaauuacucucaguaaacucuaugagcauccauguauugaugauucauggaauucaguguggguuaauuuuuacuuccaaucuuguaaagggaagccagcuacuuagaauaugcuuucaaacagacaacaccaauugaggauauucauggaaacauucacugcccucuuuacuggguccuggaaagacaguaaaagaaaccuagcauuuguauuucaucuucuggagcucucuccugccuucuuuuaguucaacuaaccacacaguuaacagagucagcuucuuugaaacuguggguuauuuuuuuccacaacugugauuucagagcuauuauugguuuccuaguuuguaauauaagccaaagcaaaaagacaauaaccagccacuuagauccugccacuuucccauaaaugugucaaaaaaaugagucaguuuacaacauguaauauaagaagucaauuaauuccagugaccuuuguaaaugaugacaauaaagcagcucugacaauaugccaguggcuucgauuuucucucuguaagaugaacaaguuuaagaagaggguuccugcucagagaaaaaugaaaggugcugaagcaucagcuugcaauauuggcagcuuugcucgcucugccucaaaugccacaugcaaucuauaaaaaaaaccaaaaugauuuauuacaaaaaggaaaaaguguuuuauuugcuuuucugcuauuuauuaaaagugcugcuuuugaaacagaccagaucugauauuuugagguaccuccuaaguuccuaaccaagaggaaaagacuugaaguagauacucaacccucugauuucaaacuccuauauaauguagcauugcaguauuuaauucaguuuuucuuagaccuuuuccagggaaaguuugcaugccagacacacauucuuaaaucuaacccgccuuauuuuaaaauugcaauagaugacaccuaagaacaguggauucacucuuuaaccuuaguaaagcucacauacauauuuuguggauuacagagaucaguaaugugcccacuucagucugagaaauaccaacacuccaggcccccgguguugccacucagugugugccagugaguuuggugauuugaucagcaccuacgaaugccagaugauggacauuuguguaugacuggaagauuuacccauagucuccccaaaucauguaacuauaccagaaauagcaccuuccuggcaagacaauucaaaggaccauuuuuuucagggugucgcuugucacaggcaacaugcugaguuagaaugcugaugaguagguggaauuuuuuauuuggagguggugguuguuguuguuaauggcuuaauaaacggugcuaccagccuuccaggccagcaauuuagugaccuacaaaaaaggugaucaacuuaugaugcacuaacuauauuucacuguuucuuuguucuuuccuuuuuuguaacaucuuuugcuuucgccaugugauggguuugauguuucacuccuccccccgaaucugaauuuuuuugggguguaacauuccuguguaacauggcacuaugguauuuauuacaaucuaaguugaucagaaagcucuauaaccggaguuucguuuuaaaaaaacacuuauguaaguuaaauguuauuacuuaauuagcagccccugaaaaugggcagaggugagguaucuguuggugaaucugaaggagaucauuaaaagaaagcuaauaguagacuaaaaaaugaguuccuacuucuagccucaguaaggaugcuccucuaaaaugauuuaaaauaauguggcuccagccagucugaagaaacacuagacauguguacagcacacuaaaauguuccauguagaccugguucugagaguuuagcuacuuauguaucacucuuugguacaugaaacuaaauaaagcagguaaacucuaggcaaaacaucaguacaucuugucagugcugucaaagauaaagcucucugauauuggcuaugcaaugaguacuuaggaaagcuucacuguauaacaacugaacauagcuccugcacagagcucagggaauuccucuccucuccuucugauaaagugauguauuguuagacaucuacgaagucacuaguaaaacaugauaacaauuauuucuuuagccacaaugugaaaggaaaggaagucaaauucuaauauaaagacaguagcuggugccagaggaugggaaaaaggaacagggauaaaucggaacguuuuucuaacuuguugaaaggaauggaaggucucaauagaugcuauuuagaggucauuaaauacaggauuaacaaggaagacuuaauguccaucucaaaucuuucugaagaaguacaguaccuacagggccauuuacuauauuugcauaauugucaaguuuguauacaccugcuugcuauuauguuaauucaucuuuaggccauaauaagggaagaauuuucuauggugccauuaauaaaaacacaugacacagcuucaggagacggggaauaaagaggggagacaugcuuucauagaauaaaauuuuugaacugaaagagacauuaguagcuagucuaauauguucauuugauaggugaaaaacacugaggcugaaaggguuugaaaucguuauaauguaauacauuauacuuuguauucacccagcuauuuauuggagaggccuagguuagaaccccuuacaauacuuccuccagaauuccauuaaaauucugccuccuuggucuuucaaaaauaauguuuucucaaaaaccuccuaugugcaaaaaauccccccaaauucacagauauguacaaaaaagagaaauauuuauucagauaaucaaauauucuaaaaggaaaagccaauauucaauaauagaagcaacgauuuauuaaguauauaacacccaaauauuucaaacccauaauucaucauuugaauauaguuuaccauauucuguaaagucauaaaaauuagaguuuugcccuguuuuuaaaacauguuaauaauaauacugcuauccuucaccuacagagacucagcuauugaucauccacuauaaguuuuaagguuuuccaagaauucugaagaggcuuuccacaucuguuuuuacuugguuucacuguaaauaauuuaaggcacuuaacaugugcccuuuuuuuauauacaguguccacucucaggauccaugcuuugcuuauacaucucacuggaaaacaauaaauauauuaucaggacagcaaucccucucccucucucccuccccuaccccaucccaacuuacuuuuugauuucuagagucagacugagagcuccaguaggcaaugauaucuccuuaauaucacaauccuauucuuuucuuuugggcaaauuucucuguuuuuaaaugugcucuccaaauuuugcuuaacauaauaguaauuaauugacucaacuuguaagaaggauacaaaauauaaacacaauaauugugaauauuuguuuaaagcucuaccauuuacagagcaauuuuucaacaauuacuuugcuccucacaacaaucuggugaaguaggguagauaugaugaugauuaacaucuuuaagacaggagaaugagguucugugagguuagagacuugcuagcauguugaggugcaagggucucugacuccagagaguagaagaaaauaugggugcagcacuggucccuggcauuucugaaguuaguaauaaauguuaguucccuuuuuauggaacuuccacucuagaucuuacccuuccaacaacuauguccuuuguaccauaccacacuauaucuggauagauucuugcaaauuaaaaucuuuauuucuuaauuuaaaucacagcuauugcuaugccugaguuaaauuuaaaaaaaaaaaaacaaaacaaaacccacaaccaacaucuauucuuggagaaaaagacuguauguuguucuaccuacucauccauauguuugucugacagcauuagcacuuugauaaacagacacuuggcaaaggucucaaaaacuggaaaaaaugagaugaguaaauuauuuagggauuuuccagguuacuaaaaauuaugaacaaagucuccaaagucacuuaagaacccccaauggaucaagugucaacauaaaagcaacuuccuuagcaucuccuuucugguuugucuuggguugaaaaugacacacuaaauaagauaaaaauacuaguuaauuugaaaguaaacugguauauuuguaaacuacuaaagucaaaaugccaguaaacuuacauacauuauucugugagcccuuucuaggggagauugugucugucaaaaguaauauagaccuuaaaaugaauaaaaaucccuuuaaaaaaucuucuaaaguuugucauuucacgcuuuacuuccaggaggugaagcauuccacagauaaucagcuacucuauucagggaaggaguguaaacaucaccacuuuuugcauguuugcauaaaaaaggcccacugaaucaguuaaagguuaguaucaauaggcaacauucucuauuuccaaaggccugaagcuccugggaucuaauucccugaggaacaauggaagaggcacuguuucccaacugguacaaaacaggacuucaggaacagcagaauguguucuccagggauuaagcccccuaacgugaagcuugggacucacaacacuuacaagugacaugaauaauaguagauauuuuaacuauagaagacauuuaagagacuucguuuucacugugauaaacagguuugauuuggacuuauaacuuuuuucuaaaauuaucaaauuaauaacgacuauaaugaaauagaggcaaauauuuuagaggauucauuccuugggguaacauuuguucuauaauuuauagucucauaauguugagagauuaaagcauuuaaauaacauugucaacuaacuuucagcuuaccuuucuuaaggaaaaaaaacaaaaaaauguuaaaaauagacauguauuuuucaaacauacaauucauguuuuuaugucauuagacuguuuacuguaucgcuauauuuauaugccucugaaauauggaguguuaauggggucuaaauuuaauucuauuuuuaucaaaacucagucacucagaaauaccaaacacugaacauguucuacaaaaaguauucaacaucuguagaauacauggaaccacaaugaccuuuacugaaauuucaauaguugcaggaaauaauuucaauauauaucuacacagauuauauuuugauuucuacaaaggccaagggguuaaugaccuuaaacugcaggugcccaaggcauugagaacaaaaaagauagagcaagcgaaaagagaauugugucuaggucacaaugcuguagcauugaaaagaaagugcaacagaacagaauggaaagagcaaaacaaggugacugccauauaugaaagauaaacauacucuaagaacauauaaacuuugaaagcucuauucacagucauucuugaaugaaaaauauauaaaaugccauuauaagauauaaacaucauccaagucaauuuguugugugacuagcugaacugacucacuuaccaaacacauaguuuauauuuguuccucuuauugucauuuauuacucacguauuuuuuacacaaacaccacaguuguugaaagaguuucauaaggugauguucagcuaacuuuuuaaaaucagugaggcauuuuccaaaccauuuccucaaucaauuacuuuuuaaugaggaagcaaaauuuauguaaauaucaaagucucauuuuuauauuuaggcuauaaauuauaccauaauaugcugcuguugggcaaaauaaucaaaguaaugaugaauuaaaacaaauguucugacauaaauuaauguaagcagagcccuuauacguucaaaccacaucaucucucuuagacaauccuuuacuggcuaaaggaaugguaauaauacuggcagaucucauuuacaacauacaagcauuuucugugccaaacauuaugcuaagcacuuaacauacauuuucucauuuaaucuucauaacgaccguacuaaguaagcgcuauguuuaacccauuuuaccaacgugaaaaauaaggcuuagagaagaaaaguaacuugccauaacuaaugaagaacacgaaaaggaaccuagguuaguuagcucgaaagaacaagccuuugugcaugaggcaacacugccucccguugguacugccuaaauauagcuaguugauaucgccuuccaagagucagauucucuaucaaaauacaguaacucuguuucuaguuucauaucaugcauucugcucauacuagaauauuauaccuuuguaggauucuucuuuucuuucugagaaaggagugaugcuuuaauuauuuauaucugaguuuugcuauccacuagauuaacuaaaaugauuuuuuguaguucaauucacagcuagaccugugaacuggcagcuuauaacuuccucuaucaucauuuuuccaucgaguggaagucaacauacuucuucaccugaggucaugcaguauaauaagugacacaaaagaaaaaugcaaaacuuagcucauuggucucaaauuucauuauuuauaauaagcuuuccuuguaucuaguuccaaauuuuagacacuuuuuuccccucaugcauucucuuuuaaaugaugaagaugaaaauagucugaauacaauuucauugcuacuaugagcaucaauuuucaaugaaauucaucaaucuucuucaguaugaauaagcugcuagcccugcaaaguuaauugaugaaagcuguaauuugcuuuucaaacugaggaugcugagccaaaccuaaaacuuuaguagaagcguucuauauuagcuguuuguaaaacuucagcauuucuugcuaugucaccuccugaaagggcuaucaggggaguccuucaacuugacuguccuacaaaacaaaaucugaauguaaaauuaaagcaaaaauguugcugaggauuccuccagugauuaaaaauggaguuuagagagcucacaucaacauacauuuucuauucaaaaugaaguuuuuuuuuugaaaguuauaagcaauuagacaacuaaaaaaagaaauucaauuuugaggugauaaaagguuaaaguauugugaaucaugaauaaccuaacauguaagaaauaaagaaggacauguauaauuuaaaauuaaacuuuugggguuuuuuuccugcuacuucuuacauacaacaaagacgaggaagaggaggagaaagagaaagaagaggaagauguugggcaacauuuauuuaacaugcuccacagcccggacccuggguaagcucuuuguacaacucaccucauuucacuuugauuccaugagggaacugaggcuugaaauggagaagcauuugcccaacuucacucauuggaaagguccugauuugaacccugaaugucugacucugaagcccauguuauggugucuuccuuagcauguauuucuuuuuuuuaaauuucaauagcuuuuugggaaacagauggugucugguuacaugaauaaauuauuuagaggugauuucugagauuuuggugcacccaucacccaagcaguguacacuguacccaaugccuuaucacauauuucuuagaauaagcauaauauauuuauccuuagagaagcauuugacuuuuuaugcagaagcaucuaacaacaggcucuuucuacaguuuuaaacuucucagccaagaucaggaguauauauauauaauaauaugcuuaaacuuuauauauaauaaaauauauguaaugaaaauauauauuaaaauauuuauaacauauacagauuuaaaauaaauacaauaagugcaucaaacuuuacaguuuuaccacaugguacaaccugauuaguauaauauuauuuaauaaauaauauaaugauaaugaacacuuaauauaauucaacuaaucuaaaaguauuacuuguggauuuucuacuuaaacauucuuauuaaucuguugaaaaugcauagagccaaaagauaaaaauuuaggcucuggcugaacuggauuaagguuuuuuuguuuuuguaauuuuagaaguguaauguauguaaaaauaucaugguugaauuccaggaggauuuaugaacaucuaagaucuuuaucauuucuuagggaauggaaaucaguaaugaaauaaggaaaguuuuauugaccauaaauaucuugcaaauugaacaaguagaacaauguuuuaaccuuauucuuucagcccugaauguugcucaccaguuuugaaaauauuugaaaacuuuuaaauaucuuucuauauuuuguaaagaugaugaacauuuauaaguuuaaaauucccccauaaagaauuuuuccuguccagaaugguaacuccuccuccuugaucaccacauucugccuccacaccugcuagcaguauaucgaauucucaaccccauuuaagcauggugcuuucuuuucacaucaucauauuuaguuuuuaagcaaucugcugcucuggauuuuacuugauauagacuuuuaugucuuugaaagaagaaauauucuaagauaauaucuuaccacuuauucauuuagacauuucaucucauggucauuuaaucaaugaccaugauauagauacaucccuagucauugaacagaaccuuggcauacugauaagcgauaaugucuauaagauacaacaagcagaaucauauauucgugucugugaugauguacuaccaaacucacuuggguacuuuuaauguaugaucucagaaucugugagaguaacaccuaagaauccauacuuauuuucugcacaaaguuacagaauuauuggguuaagauucaagucuuuuucuuuuguccacugucuaccauuuuuguuguagauuuaguaaaaaaaaaaauuacuugagacaaucguucgaauuaauacagaauauacauagguacaacagguacaauagguauacugucuuguauauuuccugugaaauauacaagaaaaauaaagguucaauagguauauugucuugugucuucccugagaagacugagaagaggguauagcuaaaugaguuagggguuugauuuuaagggaccugacugggacauucaaaguaaauagucucaguuaauauguaauaauguaaggcugugguaaacauaguuccuaucucuacugcccccaaucuaaaaagguauaccauccacagucauuucuuggcagucaggugauaucuguagaguacuagguuauguauccuuaggagaaacaucuaccaaaaauggacaaaacucuucugcccacauguucaugaacucuaauuuucauacacuauaucucacuccauauggaacucaaaugagggccaugcagaaacugccgccaauaugauuaaugagugaacucuacacugccugucaauuucuuuaaaaaaaaaaaaugagucagaauauaacaaaaucccuauauugggauagauuuuacagauuuuaggucacuuguucaaagugacuuacagacauaauuagaaccaaaaccaggugauucaauccuuacccaguggguauuucauagcacauugacuaugauuauaguuuuaaaaaguuuggaccauaugcuccugucaaaucauucuuuuuuuuaaugcaucaugaugaccaaaacuucccaaacucaacccuauagagaaacucagcagugccuuaucugugaagggcccauauuuguggaaccucuuagcugcuggaguuuagcagaagcacaauucacugucauccagucaguuuucaagaugucucuuuagauugucauuuuauugacaguaauguguugcugcugcuuuacaucaaacauguuaauuacuugagucuggaguuuugaauuuuugcccuaaagugauuuuagcugaagcauuauuuuguuuuguuuaaaucagucaaauaaaagagagagagaaaaauuacuaaauggaagcccacaaguauaauaaaagaauggaaaccacagaaauagcaaguuugaaguuucauaccuaucuaaaaaauaaauagaauaauccagcuucuucgugcuauucuauuagaaacuuccacuacucugggacauuccaucucaaauuuaaaaagcuccgaaaccauucuucacuaauccucuuugcuagggucauaaaagacuucauaauauguauaaaauaauuacaaucuuugaaauuauaaaucucauuguaaacuuauuuuuuuaaacguuaauuaaaaccccaaugucccaauuuccccuuaaaagaccauauaguauaggacaaugagcacucaagcccuugaguugcuaaaauuuaaaaauugcugacaauaacauggucuuuuuuaagacuacaguguccauugaucauagugacuucacaguuuucauuucucucuuauuuguacucuaauuagcauuuugcgugaguacuaaugaauguuguuaaauuuuaacaauaucuauuagacuuuguuuccugcaaaauguaacuauaucucaagaaauaacaacugcauuacuccaucaucucaaaaaaccuguauuagcauuucugcagauuuaugguuaauaauuguacuucuuuaucucuaucuauuccguugccaacaagcauacacguauacauuuacacuuucacacacagaccaauauuggauuuuuucaaauauuugccaacugcuaauaguuuuuaccaguuuauaaauauuuaacuaagucuagccacacugauuugcaccugcuuuccaaggauuuuuucuucuucuaagacaugucauauaacuaacaugguaaauagcgugauacauuuuuagaauuauuuucacagaaauaaccagaaaaauaucgauuaggcaaguaaaauucuacaaccuuuuaugauaaucagagccaaaugacauuuaaguaguucuauuuuguucugucauuucuccuguuccaauauuuucaccuguaaguuuaaguuacagcaaauucuaaugaguucuuauccguaugaugacuucuuaauaugauagugauuaacauuuaguaaccacucuguaugugucgggugcagaagaacuuuuuuauacuaugaacuuuuaacgcauuauuuuauuuaauuuucacaacauuccuuucaaguagguaccauuaucacucaccuuucaguagaugaggaaacaaugacauggcagcagcacagaaagaacgagaguccaugccugaucccuuaaugacuaggcugcuucuauugaacaccauuuugagaguaccagagagcaaaauaaggcauuuguauuggcaauucaagaaauuuuaggguuaaauguggaacaaaaugggaacacugaaaagugguacuccuguaauaugugugugaaaugaaaaguuacauuuucauuuucacuuccccagcauaacaacucuucauaucucugaguuugggccuauauucaggcaacuuuuuugaaaggcaaauuugcuggaggauaccuuccuucauucaugcaugcacauaccugccuuuacuauucgcaucuugagccaauuuugcagaguuggaaaugaugaaacuccagguaggggagagacaaaagucauaugauuuuccuucucccacucccucugugucccaauuuccuguaaauguuuacuucuguaauccacaguucaaauuuauuguagagaaugaaacaauuucuuuuguuaucugcuuuagauuuaccaaacucuacauuuuguucuagaaauuguucucacuucuguugauaaugcuccauguuuauauauuuugauaugaugucacuuuaguaacuaauaccaucacuucuauugaagcugauaucaauuuuuuaaaaggcugaggggacauuauaugugaaacuacuuaguaugguugccagcaauaguuguaaaucaugcuaaauaacagaaaagucucaucauuaaucccccuaucuagucuuuuugauucggggagcaaaugcuaaagaaaaauuuuuaaauguggagaaaaggaaaauuaauagcagggaugaaaagugugaaggacuugucacaagcgaugagauguuaauguauucacaauaagcuguaagcuacacuuccuaucaaauuaaaaauaugcauagaaauacccagccucgcaucucauuggaagcagggcaaaaucuauuuagaacgagagggucauggcuucuagaacaguggggaagacagaaaaagaaagcagagagaaggggacagucucucacacaaaagaggaagaaaaacaaaaagaagagauggggaguuccaaauauaauggcuguuacaagugauuugagucuaaaaugugaaucuacuugccagaaugcaaagagcagagaggcaugaccauagaauuccagaagcucccaguccagagcuauuuccuauuuccuuacuaaaggucucauugagacaaaaauauauucuuaacucuguagacuguaaauauguguuuucaaauaaaauaaccacaaaaccuuugaagugcccuuuaaaaauuaauuugauucuucuucaugaaauaaagaauucuuaugucaauaggcugaaaaauuacaaaacagaugucaaauaaccuucauuuugcaacaaccuucuaugaaucugacaucuaguuauuucaguuaacaucauguauaaaacucagaaacuccgaaauuaugcauccaaagaauggaauacuaauucaugacagcauguugaaaagagcagauagaacaauacaccacaacaguacauaaauugaccaaaugagacugcauacguuaccaucuuccaugacaacagaaacuuacugacggacaauuuacaucugguuugcucccuuauucugcaaaucacaaaaauggguugcuguagcaacugccacaugcaauuuagcuggcuggggggaaaacacccuuagaguacuuucuaagaaacaaauacaacauguauuuuuguuguuccuccuauccuaaauugaacaaaucuccugacaggucuauuuucccauagcuuuaaaaaugggcuugcucucuguuguuugcauuuguauuauguguacuaacaauuuaugcaaaaggugaaaagaaaaaaaaauccauaaaaauauaaaagaaauagauagagaugccuauaucuagucacaugaaugugauagggccauugucuuuuauagcauccccacuuuuuaucacugacagcucuuuuagccaguuuaacuccacugauguauguaucaaaucuacgcaugacacucccaggaauacacaacaucucaauuccuaaugcaccagcaagggcaagcuuauuuuucugaaucagaaacaagagcaaguacaaauaauaggcaguuaauuuucuuagaaacauauuuguaauaucacaguaacacauaacauagucuuuuuccaaggauacagcagaggaccuuagaacauauaauaccaacauuggugcacauuggagcagacaaauuagcaccuacaugcuaaauaaaaugggaggaauacucauccuuuaccuacuuacuucucaauugggaacuaagagaagaagcaaaguaccuggaacacucaaagcccugaauguggaacaauugaagcacaagucauuguucuccuuauuuaauggcaaguuugacaacuuuucaaacucuacagacauuggucugaugugggaaggucaacuuuuuugaaggaucuuaacuaucagcccuugaaauaauagaaaucucuucucucuggaaacucacugguuuugagaaacucucuaagaaaaacaguccaauuaaaaacaaacaaauaaaaugaaaaacagauaugucuucuaccaucaccauuuuugccauguggaaacuucucaugaacuucucacugccccaggcuugagugaaaggcuugcuauuuugagguggagacucaaauagggcaagaguuggugaaguauggcugcuaagagaugugagggacuuauaaauaauauuaagauaacaggaauuaaagucucggugugugaaaauacuguauaucuaggaugcacauaaaaacugcccuuacagaucuugcagggaaaaguaccugacuauacuguauaagacuucugcuguaccauuuaaucauaccaaaaaaaauggaaucaacacacaaauagauuucuuuuccacuguucucaauuuaaaaauaauuggagaaaugugugcuuuguuuagaagaguaaaggaaaacauucauucaauaguaccaugcagaaugauuugcuuaauagcauuucuaauauguuaugcauguauucaaucuacuucuuucuauauuaaaaugcaaaaacaauuacucuggauguaaauccuagaaaacaaucaaaguuucuauuaaaucagagaagagacaguuaagcugcaaugugauuugcagaugcucaugaauagacaauacuuagaaucucucucacuagaaugugaaaaagauaggugggagagauucagaaacuuccuucuuuccccuuucccucucucuccuucccucccuucuuccuucucucuuuccucucccauuuuuacuuucuuuuuagacagacuuugaagaaaaguuuuuauauaaagucuaauaauuuaaauuauaugggcauguaaaauugccuuauauuacaacgccagcccuacagcagguagaaaauuccuuucaacauucuguuguaaacaguuuagauucaacugaucagucacaggggaauaugggcaguuucaaccucuuaccaccuuugucucuaaaaagaaauucuggauaguucuuuguauacuuauauuaaagccauuucuguucauuaaaaacucaauauaagcauguugaagaaggggcaauggaacaugaagcaaugaauaaaaagauucugugcauguauaacaagcauucuguauuuuacuuuaucugaauagaauuuuagaaucuacaugcuuuaauuggggcacuaguaaaguaauaaucucaaauaugaaauacaauagaugcguuucaugcucugauuaaaugucaaggccacagauuuguuauuucagaucuagugaguaauaauuuuguuggcuaauaaugaacucccaaagauuuauuugcaacauuuggcuguugcaacauuucaaagcucuuggucaagcuguaguauuuccaauucugcagauaauauuauagacucuagcaugcaaagcuuaaacuuuuaaguaaauuuuacuaguuucaugugugcugcauagauuuagaguucugcugaaauuuugcaccaaaaauauuucccagucucaacuuacagcagauauugucuugauuugcaucaacuuuuucuuaaccgaguauauauggcuuucuuuacaauacuguuuuuguuuuuauuguuguuguuguuguuuucuccuaaaguacagugucuucuguaagugucacuuucuagugcagauucuuaaccccagucuggguuuggagacaaaaaccucacagauuguugauguauuccauuugaucacuaucagcuggcaacaagcauggucuggccugcagccacaucaaaccaauuuucuagaggacuuuucucaguacuuaacacucaauuauauuaauguuuauuauugcucuuuuuguuguugauacagcuuuuuacauuaauucugaaagucuguggcacuuucaaucauuaagaauacauuuuaaccuaaauuacaugguuuucuauguucuccaaauacaaaugucacaaauuuuaagaaacuaaucuguauauauuauacccccacuacacugugcuauuacuagagauauaauauauaaaaaucaauugaaaacuauaucucaaguaaaaaagauauacgaacaaaacauacauaucuccauuaguuuccucacaacagauuuauucgagauauaaugagaguagacauuggcuuagaagaaauuuaugauucuuuuuaaacaaucacagauuuaauuauacccuucuaaaguggguauuguuacacuuuuguaaucuccugaauuuaaaaaaaacauauuuauuucuguuugccaagcuuacaucaucacucaauaguucaugcauacaaaccacaugagucaauucagcauucaccaacaaaacaaaggucacaaaugaguaccucguacagcaaauuuuuuuaaauguauaauaagauggaaauuuauaauuaaaagcaacugauauucauucauucauucaguagauauuuauugaacaacaauagcaggcaauauucuagcuaggcauuggagauccauagcucugaauaaaacggaaacaacuuuaauaaagcuaacauucuaguggagaugaugggaaguaagcaauaaacaaaaagcaaauaauuucuagcagucuuaaaugaucuauaaagaaaacaacauggugagaauaagaaugacuuuaggggauauuuuaaguaaggugguccguaaauaagguauuaucaagaagaauuaaagaccaaauuaaagaacaaacaucuagaauguguaaaacauuuucaguacaauuuaacauguucauugccagcuacaugauaaaccauuaacuuuccuuccauaauuaaguuuuuuuuuucaagucagguuuccaagguaugacggaggcacaucucauacaagagcaagaaaacccaaucaucaugcuuacgaacuacaaaagcaucuuaauuaaguuuuaaaagaaaguaucauuuaauuucacugugcaaagaagacaagucagcacacaaguauaggcuuacucagugaguaagacauaggucuagacaugaagguguuucauuaacaacuaguaagggggcaaucaaguacauauauaucugcgacacaaagcuuuauuacacagagcucacaggaagagaccugaaaauggagucaaggaccuggaauagaguucaggagccaucacugauaaugccccuucaacuuucaccaccucaugaaaucucucugaguuaucaccuguaaaguggguauaacugcacaugcugacaggauuauuaggggaaucagauaaggucauauaugaaaauugaacugaauuuguacauuguagcacaauaugacugugacuacuaucgcuguuuucauuguuuguugcuauuguuauaugauggaaaacugaaguuaauggaaagggcccuuaaaaagucuucaggggcugggcgcgguggcucaugccuguaauuccagcacuuugggaggccaaggugggcggaucacaaggucaggaguucaagaccggccugaucaauauggugaaacacugugucuauuaaaauuacaaaaguuagccaggcaugauggaugaacaccuguaguccaagcuacucaggaggcugaggcaggagaaucgcuugaacccaggagguggagguugcaguaagcugagaucacgccacugcacuccagccuaggcaacacagugagacucugucucaaaaaauaaagucuuuaggaucugaacuauacuaaaauaugcaaagauaaguaaagcaucaaagauccuaucuguucauggauauuagacaugaagacaucauuagggaaaaugauauucuuuuucaaaucuuuguuucuccacacaauugauaggaaucagucauuaaagaaaaccucaaaacuaauauuuuucaaguccauauucauuauuaugacaaaguuuaauuaugcuucucauauauuuagaauagcuuuuauucacugaaauaauaucuuaucuuccaagaaaacauaaacaauaccaggaaugaucacaaauauagauuauaucuuacuaaccagugucaugaauuagaauuaacagaaaucaugaaaaaguuuuauucguuuuucaguuuggauguugagcuccaagcccaaaaugguuuagcauaaacuuuacuacauaacugucuugaagaauauauauaaaaacauaaguauaaauaucaaacauauaaguauagaauacaaauaacuuaaaguucaaagaauguuucuacauauaugaaauuaauguugaguaauucuugacugagcaaugugaacuauuucugcaguagacauuacugauauuaauuuaauaccaguuauuuaauuauaaauuuccuucacaaaauaauuuugucuuggcauauuggaacaguaaaguuaggugaaugucccagaucaaauuuaagggauuccagaucuuaaaucaugugacugugaagggaaaauuucuucuccuaacucagauccaauaaucuaacacuauucauuuuauccauaaaaauguauuaaauccuaaccugugaagcugcuauaacauaauauaaaaccauuugcuuuucugagccuaaacugauagucugaaacauaauccuaaauuaucuggaaagaguuuaucuacuaagaaauuuucccaaacaggugauuugucacuuagcuuucaccuaauccacauaugagaugaauaccaggcuucuaagagugaaaugaaugcaaauuuauaacccuguuuugaaagaacucuuuuucuccauuaagauuuagaacucccuuuggugcucuagucauguacaaccuugcaaaaagacgcuuaugugggcauaucgcccaugcucuucauggguagcaguuguaaaaaaaaaaaaaaaaaaaaaaaguuaauguuagcaagggccuacauugcccauuaacaaaaauuaaaauuugguaggcaucacaaauuacacugcuuuccauccccccccaaaaaaaaauggcccguuaguauuuuuacuucccccgcccuuaauuuuagcccucucuauucaacacauaaggcaaaauguauuucauuuacuaugccacucuuuugggggaucucauauuucccaaauguucauaaccugauauagacuaguccuuaaaugguauaguagucaaauauuauaaacacauuaaaguagaauucaccauaaagcucuuacgaacagaaauaaugugaaucaacuaaugucccccccugcgucaauaguaauuuuaaaugaauucaaggggguuguaggcaaccaaauuuugcaaagucaucuacauaaaguaguccuacauaauuagcuucaaguaaagaguuauugugaggcuucuauaaaguuaagugacugaacuccauccugggcgacaaaaggagaccuugucucugaaaaagaaaaaauacaugccuuuaaguuaaguuaggugacaggaaaaaggaaaugcaaaacuuuauuuauauauuuuauuuauauauauauauauaguuuguuuuuuuuuuuuuuuuuuuuuuugagauggagucuugcucugucucccaggcuggagugcaguggugcgaucucggcucacugcaaccucugccuccuggguuccggugauucuccugucucagccucccgaguagcuggguuuacaggcgcaugccaccacacccggcuaauuuuuguauuuuuaguagagacggaguauuuuuagcagagacuggguuucgccauguuggcuggucuugaacuccugaccucagguauauccgccugacuucgccucccaaagugcugggauuacaggcaugagccaccacuccuggcccugaaaaugaaaaacuuuaaccugcauauagugccuuuaauuuccacacaggaacuaaaugacaaagcuucacugaccuagcauacaucaagaacuuuaacucugucugucacuucguacuucagagugccaccaagucaucucauauuaaccauuuaacacgaguguuagggaaagagcucauguccuguacaguaaugaauuuccacucacaaaaagaugcacaaacaugcacacagccauaaauauggccuccaugucuugguugaaacucaaagccauaauucaggaaguuuuuucaaagcuuacaguggaauguauguuguucuauuuuuaaaacuuuuuuguauccucuggacacaaauauagcaauguuguuuaaagcagauugucaggaauuuaagcaggaaacaaaccacagagcaugagggaaaucugacacacuuuugaaaagaaaauagacaaacaaucccaugcuuauuauagggaacuaaaaauacagcccacaucgcuauuaucgucuuccuuagguauaguaacagaaaagcaccauccaacucugaacucauggcaggcaucagcuaaccccagcacacccgaaaauguggugcuauaauuuagucucuuguuuauugcauuugaaaaaauucuuucaaacugaaggagcuaauuuuauuuccuuucuuucaacguauguuuuaucuucucaauucuuaguaaaaacguaaaacacugauauuaguguuguuuuauuuaauagcaaugagaaccauauuuuauuauaugcagaacagaaagugaacuacccagaaaccuucuacucugaguuccuucagaguaauguuccccuccaaaauauaauuuuaagauuucuguaauaauauuguaacuaaaauguucuucauucucuaucuauacuaggucauuggacucuuguccacaggcuuccuuaccuucuuuacaaaccagugacuuucuauucugucaaacugaguuaaucaaggaauacaaaugaguugaaaaccuuuuugcugccauccuuuuacagcauaucuaugcuucaaaaccaucccuccugagauugauaaaagcauuuacuuauggcaaucaauauagaauagucuuuuuuuuuuguauacaugucuaucauguccucccauguauaaggcccuagagaguagugcuugcaagaucagaaagcauaaggcagcauacuugugccuguucauaaaaucaacucaagcugcaaucacuucauuuauuuuuuucuuuuaacuauaccagggagauggacagucuucaugugacauaaagaauggagacuucaaagacaggauauuuggcuaucuuccaauaaaaaaaugacuuaaaaauuguuuaaauuaucuggauaauuaccccaaauguuuucaucugaaaugcaggauaauugaaagagggucuacaugagacacacauuucccaaaccauuguacugcaaggcacaauguaagucugucuccugucauucaagcaggggaauuuccaaaucuaguuggaaauuccuuugaagauaaaaggaugacaucauuuaccagucauacuaccacacuaacuucucaaauaaacuggaacuaaaucauaagaaugagcuuuuagagaccaaaacuuacgagagaauaaggaaagcauauuugggcagacuuuuccucucaauuuaugugaaauguguaaaauacaaauuaaggccuaauuaaaucccucuaaauaucuauugauagaaauaaagaguggacaaaaugggaaauuuuaaugcauaaauuuagucagucacauucaaaauuuucugaacagaacugaagucucucaacauacacauacacauaaaucuacacacacacacacacacacacacacacauuuuugccaggaaaacaaugauuucucuuacaaguguauauaaauuacuccugacauacaaauguuuaaaauucuucaaauuuuucaugaauuuguacagcuccuaaggaucuuuuuauagacuacuucugauguaaaugaaauuagcaccuugucuaucucuaugccacuguuugacagacacauaaaacgugaauaagcaugaaaaacuaaaaauaucauaaaaucucugaguaaauccuaucgguauccauccaaguacauuguauuaaguuugcacaaagaaauauauuggcugggcacagugacccacaccuguaaucccagcacuuugugaguucaaggagggcagaucauuaggucaggaguuugagaccagccuggccaacauggugaaaccccaucuguacuaaaaauacaaacauucgcugggugugguggcaggugccuguaaucccagccacuugggaggcugaggcaggagaauuguuugaacccaggagguggagggugcagugagugagccgagaucgcaccacugcccucuagccugggcaacaggcgagacuccaucucaaaaaaaaaaaaaaagaaagaaagaaaaaaaaagaaauacauugaaaccauuuugagaauauuuaaggguuacuacaaaaauuauauaauaauagaauuugaaggugauuuuuauuuuagaaaugaagucacuaaaggucacgaggucuccuccuaacucccgggucugcauacuuacacaauagccuacuguuaaagugcugguaauuuuacagacaggcaucacccaaauagagaucucuaguuuaauuauaaccugaagcaaauuuuccaucacuauggaaaacaagaugauuauacuucaaucuaagaugagugaauauuaaggauaaugaauaaaugaguguuuuucccagagagaccuacauuugggaccauauaaaugcuaaauaacaagguaaauaaaagagagguuaaaaaggcaaaucaggcaaucaaacuccauuggcucucaaacaauauugaauaauguacuguuaugacauauuguaaauuagaauuccccaguauauggugugaugcuuauaggaaaaaauauaagcaucaagagacaaguuaugacuuaaaauuaucauuuguuuuacuaaucauguacaaaagucaacuucacaaauaaugcuauuaaugaagugcucaguugagcaaaaucaauaauuaaauauaacuacaaaucagaauuuucauaaaaaaugacaguaucaugacaagcugguaauuuaugaguauacagaaaugacuaccccaauaugaaaugugccugugauuaagauuucaucccccccucuguaaaagaaaauuauaaagagagauuucuguacuguaaacuacccuuucuaaauuauagcuguacuauaacuagauuccacaaauuggacguauuagggugagacauuugcaauuauuuuuuauuuuuauuauuuauuuuuauauauuuauauauauuucuuagacagacucacacucugucgcucaggcuagagugcagcuggcaccaucugggcucacugcagccaccgccucccagguuccagcgauucucgugccucagccucccgaguagcugggacuagagaugugcaccaccaacucuagcacaccuggcuaauuuuuguauuuuuacuagagacuggguuucacuauguugaccaggcuggucucaaacuccuggccuuaggugauccacccaacucagccucccaaagggcugggauuacaggcaugagccaccacauccggccggaauuauuguuuaaagaaaacuauccccauguagcacaagccucaauucuaaaaacaagagaagaaaaaagauaaaacauccaagauucucucaaaucugcccaaagcauaucuugagacucaggagagagaauugugcuauuuaaguuacuacugguuucucugagagaacuuuauuacaaggccuauauugucaucuaaaggacucaucugagcccuauauccagaggaauggaaacagcacaugauuuguuuaugaucugcauuaaugcuugcuggguaaaaauaaaaguucuuaaacaugacaaggacauaaaauaaaauugccccuccuuuuaaaaaaaucuauaguuauuucuauaaugauaauaagaggauuuuugccaguuugaaaaucucaaaauaucagauuugagaaucugaaaauaucagaauccacucuaaaaccacucuaaaagacagcauccauuaaauauauggguauacaugacauacauuuuacuauauaaauuuugaacaauaacaaaaauaauuuuucucuaauaaacaaauuucuuuauaauggcaaucccacacaaaaucucuacaauuucacaggacauuaacaaucaacuugaaaacaagaguaaaaauuuagugcauauuuugugagaaacuaagauucagagagcgaugugauuacucucacauagcaaaacuaggccuagaaaacaguuuuuauuuuauuccuuccacaauacucaacugccuuauaauuucaucugagugaaacuuuauuaucaaaggaagagaaacacccaacaauaauaacaaaaaaggcagugcaccuauacaguuggaggaaacaccuuucugagaagauaccaagguguguggugcuguuuuaaaaauaaacauuugagagaaaguagaacuuagugguuaagacugagcuuuagaggcaaaaugaaggaauuugaauucacaucugaauuuagaugaagugcucuaaucgaggcaauuuacuuccuacugguuagucugccuuaauuuaaugauuaaaguaacucucuaguuuguuuacuacuguguagauaaaaagauaaaauagaaauaauggcagguaacuaauuugauagucuuuaaaagccccauaaugacuaaaauucacugauccuaaauuuguuaauggcaugggacuagaguauugaauauaaacuuguaaucaauuaaaaaacacaaagguuaaaaucagauaagugaguuuacacacauucaauuguuagacaccuuuggaaaaaaucuuugauguucacagaauaguaucauguaaguuugggaugugaaagaaucuuacaacucaugcaaccaaauuucuaaauuauagagaucaauaaucugagguacaagaaagugagguauccuguccccaguuacaaaaucauccaguaaaccuggcccauguuucuuaaugcaaaacaaauuuucuuucgguguaucaauuucucauugacaucaguuuuuaaggauagcauucauuaagcuauucuaaauaauuaccauuauccauuuccugagaguugucauauaaauucaaauaauuuguuuugaaaaacuggaaaagaaauauuucccaaggaaaauagaacagucuuuuacaaggaugcauuuaguauaauucaacaauaccucugggauauggaaccuucaauuagaacuaaagaaagaucaagucuuacaacaagggaauaugaaguuagauagugggagaauagaauuuaaguucuuuauacaaaugaacuuagccagcaauuugcuauagaagaaaaggaaaaacuggguuuuaauguacccauggcaauuuuuuucuucaccaauuuuucaacuuaaguaucaaaauguuucuuuuccucacacucuguagucuuuauaauacacauaauaaagugcaaagaagaaggcacacuuuguucuuaagcuuuagcauugcaaaaacucaucuaaaagacaguggauuuuaaaucuucuuacucacauguccucacuauaccccagcugauuuuucauaaguaucacaaaagaccacagaacauucauguugcuccuuuuggaggaacagaauuaagcauucucuccuuugugcauccacagagcauugcacacauuuuuauuguaaaucaaaucuacugugcaucauuguccucagcuauuuacuccuuugauaacugaaaacuuggugagcagauauuuuaucuuauuuauugcugacuuuccagugucuaugauaaugccugccaaaaaguagguguuggaucaauauuucauaaaugaugaaaaacagauaaagaagcuaaagaauaaagaucucuuuacuaaggaaaaguagcuuuauccauaaaagcuucuacauauaauuauaccaagaaacaaucuguauuuucacauaaagaaaucucaaauuauaaguguccacaggaauuggauauauaagauaugagaauucuuacaauuguuugauuuuaacggccuaaacuagguuuuaaucccaccccaccauuuauuuguugugugguaucaggcagaugggucucaauaaccuuacauuaaaaaguggagauuaauguaccucaccaaccuaucucacaaguucauuaauauuaaauuaauaaugaauaagaaaaggcuuugaaaacuauaaagcacuaagaagauacuauuauuacuuacuuauuauccugcaaauagcccauacuaaauagcauauuaaugaaauaucauaaucauuuccacagacuuaagaaaaagucaauauuaugcuaaagaaacgauaaauuucuauauucucuauuguguuucccauacuauugcuuccuacagaccaggagaaacaacauuugaauaugcucaccacuauaaacacucucauuugcaaaagcuuucagaagaaaucuaauucaaaaugugguuguuucuagcauauggcuauguaaaugaugaaauaagaaaacauuuucuaauuaaacacaaauauaaauuuuaagacacccaccaggauaauuucaaaaaguggcauuauauuaagacucccccagaaagaaugccucaucuuuaauauuuccaaaccucuaguuaacuuaaagaaggauauagguaccucucugcucugcuggagaaagcagaccuaacgaauuaauugacagaaguaaugguuucuccauucucagcuaagugauuuauggaaacauacagaaaugcaauuggacuuuguaccuagguuuuuccuucauucuggacauacaggggcaauagauuucuauuuucauuuuauucggagggguauaugcucccaaaugagcaugcauacggaauuguaaccaucuguuuacuucuguuuccccuccagacugaaauuuuacuaaagaaaucaaccauaucuaagucaucuguuuucccucuagcuauuaacccaguaauuggcauguagaaagugcucaauaaauguugacuggauaaauugaagaauaaagcacagauauaauagauuaacuuuucucuuaaagucuaacauuccuuuguauuagccugaauuuuaaucucuggauuuuaguaauauauguaacacaaauuugauguuaguaaauacuuauacacauuaaaacagauuuacugaaauuagaaauuaagcagauagaauuacuuaaguaacauguaaaaggaugcauacaggauucuacuaauacaauucauuuaucaguucauucaaaacauuucuugagcacauacuacauuauaaugauaaugcccagaagauaggaugcaaagccaggcaggccucacgcucucaaggagguuagugccuggugaaggaaaggaucaaggaaaugccugacagaaacaagugcuggagccaugggaccacugugaaggggcagcuaaguacauguggagggagggguuauaugaaagucuuguaugaaagacuucccagaggggagauucuugaacugagguuugaaaagacaguaaaacauaauuuaaaacaaagaaagaaguauuccaggcagagugaugcaaccauagcucuaccaauagggagaagguugccugcaggaaaauggcagacggugagguaaacauagaaggaucuccauauaucaaauuugcaacuugguguuggaaaugauuauauuucaaagacacugguauagauuuaaaagaaaaauaucuaggucuuuguguuacugauugcauuaauccguucucaugcugcuaauagagacauauccaagacugaguaauuuacaaagaaaaagagauuuaauggacucacagcuccacauggcuggaaaggccucacaaucauggcagauggcaaaaggcacaucuuacauuuaggcaggcaagagagaaugagacucaagcaaaagacauuuccccuauaaaaacaucagaucuccugagacuuauuucacuaccaugagcaugggggaaacugcccccaugauuuaauuaucucccaccaggucccucccacaacacaugggaauuaucggagcuacaauucaagaugagauuugggcggggacacagccaaaccauaucagugauguaauaaaauuguuuuuucauuguuaguaauggaagguaaguuauucucagggaaaaauaaaacagccaaauguuaaucuugugaacuuuaguuacgaaugauaacacacagguacaucuacagcaaguuaaacuuaaucuucucugaauacugcaaaacucaagucacuuuaugcaaaggagacuauggagagaaguaugaaugaaaaugggaaacagcuaauaccacuacaucuagcuuacuuaacauuuuauaauuuuugucucuaaauccugucuccugggaaccuguugaaucgcaaucuaacucauuugguuguaagugaacaguauuauucauuuauuggccuuuuauguugccucucuaacaggcaaaaaaaaaaagccaugaacaguugaaagauuuaaaaguuguuuuccuuuuuucccuauaacuaaauuucaaagcuaaugaaaauauaacaaauaaaauuacaagguauaaacaagcaaagauuugaaauaacagaaaacuucuggaaacacauucauuaaaauaauaaauguuuaaccuuuuaacgauuaaauuucucagccugcccaaugccuaggccaagaauuaucaaggacauauccuucgcccacuuuuugaugggguuguuuguuuuuuucuuguaaauuuguuugaguucauuguagauucuggauauuagcugucugucagaugaguagauugcaaaaauuuucucccauucuguagguugccuguucgcucugaugguaguuucuuuugcugugcagaagcucuuuaguuuaauuagaucccauuugucaauuuuggcuuuuguugccauugcuuuugguguuuuagacauggauaugaacagacaauucucaaaagaagacauuuaugcagccaaaagacacaugaaaaaaugaucaucaucacuggccaucagagaaaugcaaaucaaaaccacaaugagauaccaucucacaccaguuagaauggcaaucauuaaaaagucaggaaacaacagcugcuagagaggauguggagaaauaggaacacuuuuacacuguugguggggcuguaaacuaguucaaccauuguagaagacaguguggcgauuccucggggaucuagaacuagaaauaccauuugacccagccaacccauuacuggguauauacccaaaggacuaaaacaugcugauauaaagacacaugcacacguauguuuauugcagcaguauucacaauagcaaagacuuggaaccaacccaaauguccaacaaugauaaacuggauuaagaaaauguggcaaauauacaccauggaauacuaugcagccauaaaaaaugaugaguucauguccuuuguagggacauggaugaagcuggaaaucaucauucucagcaaacuaucgcaaggacaaaaaaaccaaacaccacauguucucacucauaguugggaacugaacaaugagaacacauggacacaggaaggggaacaucacacaccggggccuguugugggguggggggagggauagcauuaggagauauaccuaauguuaaaugacgaguuaaugggugcagcacaccaacauggcacauguauacauauguaacaaaccugcacguugugcacauguacccuaaaacuuaaaguauaauaaaaaaaaagaauuaucaaggacagucaugaaaaagauaaagucaccaaacauacugaaguacuuaaacucuaagaauauaauuuauacaugaaauaauuauaauuagguaaugaauaucaauuaugguauuuuucauuuguacuaauuauuguucucuuuuuucuuucauauuucauuuuauuacauuuagcaucaugcugcuauuccugcaaauacugaagaagcaugggauuuaaauauuuuacuucuaaauaaaugaauuacucaaucuccuaugaccaucuauacauacuccaccuucaaaaaguacaucaauauuauaucauuaaggaaauaguaaccuucucuucuccaauaugcaugacauuuuuggacaaugcaauuguggcacuggcacuuauuucagugaagaaaaacuuugugguucuauggcauucaucauuugacaaaugcaagcaucuuccuuaucaaucagcuccuauugaacuuacuagcacugacuguggaauccuuaagggcccauuacauuucugaagaagaaagcuaagaugaaggacaugccacuccgaauucaugugcuacuuggccuagcuaucacuacacuaguacaagcuguagauaaaaaaguggauuguccacgguuauguacgugugaaaucaggccuugguuuacacccagauccauuuauauggaagcaucuacaguggauuguaaugauuuaggucuuuuaacuuucccagccagauugccagcuaacacacagauucuucuccuacagacuaacaauauugcaaaaauugaauacuccacagacuuuccaguaaaccuuacuggccuggauuuaucucaaaacaauuuaucuucagucaccaauauuaauguaaaaaagaugccucagcuccuuucuguguaccuagaggaaaacaaacuuacugaacugccugaaaaaugucuguccgaacugagcaacuuacaagaacucuauauuaaucacaacuugcuuucuacaauuucaccuggagccuuuauuggccuacauaaucuucuucgacuucaucucaauucaaauagauugcagaugaucaacaguaagugguuugaugcucuuccaaaucuagagauucugaugauuggggaaaauccaauuaucagaaucaaagacaugaacuuuaagccucuuaucaaucuucgcagccugguuauagcugguauaaaccucacagaaauaccagauaacgccuugguuggacuggaaaacuuagaaagcaucucuuuuuacgauaacaggcuuauuaaaguaccccauguugcucuucaaaaaguuguaaaucucaaauuuuuggaucuaaauaaaaauccuauuaauagaauacgaaggggugauuuuagcaauaugcuacacuuaaaagaguuggggauaaauaauaugccugagcugauuuccaucgauagucuugcuguggauaaccugccagauuuaagaaaaauagaagcuacuaacaacccuagauugucuuacauucaccccaaugcauuuuucagacuccccaagcuggaaucacucaugcugaacagcaaugcucucagugcccuguaccaugguaccauugagucucugccaaaccucaaggaaaucagcauacacaguaaccccaucaggugugacugugucauccguuggaugaacaugaacaaaaccaacauucgauucauggagccagauucacuguuuugcguggacccaccugaauuccaaggucagaauguucggcaagugcauuucagggacaugauggaaauuugucucccucuuauagcuccugagagcuuuccuucuaaucuaaauguagaagcugggagcuauguuuccuuucacuguagagcuacugcagaaccacagccugaaaucuacuggauaacaccuucuggucaaaaacucuugccuaauacccugacagacaaguucuauguccauucugagggaacacuagauauaaauggcguaacucccaaagaaggggguuuauauacuuguauagcaacuaaccuaguuggcgcugacuugaagucuguuaugaucaaaguggauggaucuuuuccacaagauaacaauggcucuuugaauauuaaaauaagagauauucaggccaauucaguuuugguguccuggaaagcaaguucuaaaauucucaaaucuaguguuaaauggacagccuuugucaagacugaaaauucucaugcugcgcaaagugcucgaauaccaucugaugucaagguauauaaucuuacucaucugaauccaucaacugaguauaaaauuuguauugauauucccaccaucuaucagaaaaacagaaaaaaauguguaaaugucaccaccaaagguuugcacccugaucaaaaagaguaugaaaagaauaauaccacaacacuuauggccugucuuggaggccuucuggggauuauuggugugauaugucuuaucagcugccucucuccagaaaugaacugugaugguggacacagcuaugugaggaauuacuuacagaaaccaaccuuugcauuaggugagcuuuauccuccucugauaaaucucugggaagcaggaaaagaaaaaaguacaucacugaaaguaaaagcaacuguuauagguuuaccaacaaauauguccuaaaaaccaccaaggaaaccuacuccaaaaaugaacaaaaaaaaaaaaagcgaaagacugcaguugugcuaaaaacaaaacaaaacaaacaaacaaacaaaaaaguaaaaaaagauuacuuucgagagagaaguuuaagcuucaccaaugcugcuccugaccaauggaaauauguacaacuucagcauuuuaaguaacuggcuucaagggguacuguggcaaccaaauaaaauaacuccauuuucuaaaacuuucauguaacuuuuaugucuggacuacaguucaaguggacaaaaacauuucuguauuuuuuuuaaguaaauaagaguaguugaacugagcaauaccuccuccuguguuguauuacacauauuagccacgaguuuuugcagugaccagauaaacuugaauugacacgugguguaauaaaauggacaaauucuguagaguagacacagugaguauguggaccucuuuuauaaggaaaaauacauuuuggauuaaaaucaauugcuucugucuuguuuuguuucuaaauaaagaauaauuucugggaaauaucaucugaucagauaucauuuaaaugauaaaguuuuuaaaagguguuuuucuauaaugaaauuuggaaugcuaagaguaagacacuuuucuugggugaugggacuaccuacauuuuuauaaagccucaaauauggauuucagaaagcauuuaaucaauauuaaauagcaaucauaauuuguauuuaacccuuuaacuauugacagaaacucuaggaaauuauguauucacuuaaggauuuuuuuaacaaguagcuuuuggaguagauuaaauuauuagguugagauaauauaaauucaguaucugggcaacauaaagucuuauuuuaauaauuagcaguagcuuaguuuuaggccgcuugcuuuuuuuuuuuuuuuuuuuuuuugagauggagucucccucuguugcucaggcaggagugcaguggcaaaaccuaggcucacugcagacuccgcuucccagguucaagcaauucuccugccucaaccuccagaguagcugggauuacaggcaggugacuacaucuccggcuaauuuuuguauuuuuaguagagaaaaaguuuugccauauuggccaggcugcucucgaacuccuggccucauaugaucugcccaccucggugccccaaaguauugggauuacaggcaugagccaccacgccaggucuaggcugcuugcuuugcagaaacuauugccaaauuucauuaugacuuaugcucuagguauaauuuucaaaucucucucugauucaaaacaguuaaggagcuucacugaaguaacaagcaaauaacuuaauaauuuacuauauugaaacauggcaaggaaacaacauguuucaguccaacacuaagauuuuaaaauuacaccauaaaacauauagcauuaguaguagaaguuuaacagguucgacuuucugaaauuucuuuuauuuagcucacuccaauauaaaaaugacacaauucagauacuuucagaguuugacacaaauuuaagaggaaugauguuaacuaaaggaaaagcuucugaaacuauuuuaaaguaaaagaaacaauuaagaauuuaauuuuuuaguccaguccucuaaaaauauauuuaaggcacuggaaacccacagcuuaaaagauuacaaaucauugaauugaagugccaaguacauuaguagucauuuaaaaaucuuauauagggaauauacggauuucacuuaaaaaaaaagagaauuaagauuuuugaggauuucagucauuuuuacaaacaaacccccacaguccugcaaaaauagaaguauuuuuguacaaagcaaacauucugagacaauaaaauaccacaguuuuuauaggcaaauuguuuaucucucaaaguuacaaagcuuucauguuaauugcuacugugucugcucauaagcaacuuuuaacuuuucuuacaauagcuuucugcauaauaucaacaucucacuggccuauaaacauuuccagcacuguagucauaucaauuuauuuguuaauauuagacauuuauuuugugauagcauggacaguuuccaguuaaauccuagcuguuuuugacaauguggaaggcaauuguuaagaauuucuuaaaacaagaggguaaauugaguugauuuuaacacaaccaaaauaugaaacuugcuaauucaacguguuucucaaacacaaauuuuacaacccgaugaaucacuaucacacagaggcugacguuagaauuuaucagccagacaugcucauacaucaugagagguuucagcaccacaaacagagcuuuacagagcucagcuauuugucaaaaacauaggagccaaaauacaaccuauuaggaggcaggcauaguauaggucaguaacaacuugagcauguaccuuguauguuucuuugaaaccuaucugccugaagaaguauuacaaacauaucauagcacugggaauucauuuuaaucuacauauuucuuuuaaaguuuguuaagaaauaugcauucugaauagacaucuaguagugagcauuaaaaugaaguauuucuguuacaaccaaaaauauacagaugcucaaggcaaaucaugaaccuacugauuugcuuaaauuuuaauauaaauuuccagugagagagaaaagacaucugcuucaaugagaaugguguuucauacucucucuguuaccucuuaauccucacauaaaacuaagcauuggucaaaguacucaaaccauuuaacuuacaauuuugugauaugauauggauguucuuguugcaaaacacaacuuuaccuauaacaaauaaaacgcuaaaguuuauagcuguaugaaugcuaccuaaucugcucaccuuguauggagaaaaacaccuuggcacaaaaauaauuuuugaagaauuacauauuuuauaauugauacuacaaaauaaaauuaagauuuucuaacaauaagcauacccaauugaauacaaaaauauauaaaaacagugcaaaacaaaauauguauuuuauaauguauauaauugucaguaaagcuaagcagcaacagguuggcagacauaugcuaaccauuucaccaagaaagaaaugaaacagauuuaugguacauauacuagucauuuaauacuuauuuuaguguuaaaguuuuuauucuaauuagacaaaaaguuuuuaaguaaaacuacacacaaacauaaguuuaaaacaauuccuuaguuuauucauuuaauuaucuuuuguuuauauucaauaaacauuuauuguauggcuauuagucacaggaaaaagagaaauaaauaggacaaauuuucgaccaucuaaaacuuauauucuacuagauuauauucugguuuauuuucuuuaucaguguuuucacaaauacauguuaacuguguaauuugguaaagucccagccuuaaucauucauacuuucacaaaaugauaaugcucagaaaaaauacaagguuuuuuucuuggucuaaaauguuuuacucaucacaauuuugauguaaaagcuugcuucaaauguaauauugauuuuauucacuauaucugcagaaacuagccuaauaguauucuuuagacuggcuaaauuaagaggcauauuuaggcugagugugauggcucaagccgguaaucccaacacuaugggaggcuuaggugaguggaucacaaggucaagagaucaagaccauccuggccaacauggugaaacuccgucucuacuaaaaauacaaaaauuagcugggugugguggugaaugccuguagucccagcuacucgggggccugaggcaggagaaucgcuugaaucugggaggcggagguugcagugagccaagaucacaccacugcaugccacgcuggcaacagagugagacuccgucucaaaaaaaagaggcauauuuaguuaccauaaauuauuucuaugcauaaaacauggauaccuguuaugugaccccuauuucaaacucaaagagaaaaugagaagugaauuucaaaaagguuuaucuagcauagacaaaaugucuacauaucuuuacaaggaggagaaccaacuuacucuauccacauuaacccuuacaagauguuccaauaacuacaaagcauagucuuaaaauuucagagauuaacauuuuagaugaaaaauccaaaaugugucagaagcuacuaaagcaaacaauaaaaacaacuaaaaaguuuaaaaguaugcauguauuaaggagugaaaaaaucucaauaacauaucucacagccaucaaaaauaugaggaaauaauucuaauuauauaugucaccauucacaguaucuugggcuucaucacaaugcugauuuucuaggagauagggaguaauuaauaguaacuaaauuguggcuauauuuucuuugauccaaccuuuuuccucaaguuucccacgacauuauagcaaauaaguaaaaauuuuugugaagaauauaguugucaccauuauauuuacuauauuauauguuauauauauuauuaccauuauauauuacuauauuuaagggucccaaaaggauauuuugcaaucaauuaaacagaaaagacuacaaugaucuucucuuucagaugcuaauauuuucacuacagcuuugcuucuauauaucauuuuacccuaacgaaugcauugcuaacuaggucguugcuugggagaacuacagcguuguacuggaaugccacaucuagaaacagcuacaaucaguaucauggaguuuugggaaaagacagaacugacuccaguuuucacacaauagugacuacuuuuaucuguucauuugaaaaguaaggacuugaguguuaagagugaccauggccuagauuuacguuauucuucuaaaggaaaaugaaaauauuauuuuuacagaggagcaaagugcaaaaucagaguuaauauuaacagucauaaaacauauauccaauuauaagaaaaauuauuaagagaaaaaacuuuuaaaaagaauauuacagcagaauauagauuauuuccaaaauuuggccuaaacauuucauuuacaauauacacagaaggcucaugaauugaguaguaugcauuuaguauucucaagugagaagacaucauaugaaacagaacaugauuccuuuuuguucauacuaaaaagagacaagccuacagagauuugaauuuaccuauucuaguucacuguauauacaucucagaaggcuccuagcucaucuuugaaauaagccauagagcauauaccaacgaaggguguaaauaacucacagauaugucaauacgacuuuuucuuaggagcaaacugaagaauucaaauaagugauaaauucaaagcuaguaucauacacaauuucaaaauuauugagaaguggcccagaguaacagcauagcaaaaagaauugugguugaccuuaguaagccuuuuagaaggaugagcuacaacgacauuuggagaccucacaguacuuuguguguuuauauuuaccuuuucuaacucuacuacaucaccaagaaacuaauaguaugaugugaccauuguaaagaaaauccagcuucucauuaaaauauaugguucagugucugaaguuauugauucaaaauccaacugugauacuccuuaguaauguuuaccagacucuggaacaaauaauggagugagcuuggaacauaaauuaacccucuuaauccucacauugagagaaucaggcuguaauaaaauaaccucccugucauuugugguacuagacucaaggcugguaaagacagaaauaguucuuaaaccaacagagguaucauuauuaaagcaauauagcuaaacacacccaaauggucuuucaaaagaauacgauauaaaauugaaauucauuaucagaacugggauuaaggucagauaccucuaguaaacaucucuuuaauaaugguuucagagaagagucaccuauucaauaaaaaacaagaaaucaugucuccaaaacaacuuuaaagcucuuaccuuccuaucccuauuuccuaguaaauuaaucaaugaaacaaaauucuaguacagaacuuucauauuaaaucacuuauuuuuucaagauuuuaaaaaaaauuacauauaaaaugcaugaauucauauaaguauaugaugcuaacaagucaauucaaaccuuugaguguaaaaaaauuucuucuaaccacggauauggcauauauaaaaugcauuuuaaaaguagaaaaaaaaagauucauuucuuucuacaaacaauauauuuuccacacaaaucaauaggaauuaagugauugcagugaaaaaaaaaaugaaccacaacaaaaauaacugugugaggcuaaagggaauuagguuuuccuuccaguggauuaugugugccacaguccaggcucaguccuaaagugacagugcaacgcuugagauauucuguugacgcaugcauagaaaauaauaaauauauuauuaacauauuauguuuggauaaacaugcauuuauauuuacuugaguagaaagauuacaaauuaagaaggaaggaaaaaggaaaggaagaaaagaaggaaacauucacuaaauugugaauaugugccagauuaacaauuugcugugcucuuaggaaauccacuucagaucuaaagaagaggugugggaaaaugaacauuugccaucuuacaauaugacaggcaugcugauagacaggccugcacaucucuuucuguacauguauaauguaauauauauuacauauaaauguguauaauacauuacauaauuacaacccaauuuaugugauccucaugaaauuucuuugaguucagcauuaacauuccaauuuauauaucagucucagagaaguauuuaaguauuuuuccccaagaaaacauacgaacuauauauucauauaguuaauaugaaugcauauuaacuguaacaaaaauaauaacauagagcaaaaaaauaaaaaaccaaaugacucaacaccaagagaaauaauaacaggaacuuuauaagcaugccauaacucacaacaauaacuaauaggugauuuuuuggagagggaacaauccaucaauaguacauuagauucauuaauuguuccuauuaucuucuaacucuccccaucaguauguucuuuuauaauauuccuaucucaguuucgcaucagaaaauggggauaaagagucuuuauuugucaaauugcaguuacuacuuauuugccaaacacaaagaacacuaguuuaucaagaaaggaaaaccuaugcauauucuuauaaauaaaaccuuuaaaauaggaauauacaugaaguuccaaguagauggaaggcuagggacuuuuaaaagaauuuuucugcaauuauuuccaugcaucuacuucacauucccaaucuauaaagcucuucucuuucucaguccauuacaggaaaauacagaauggucaauuauguuuaaccugcuugccaacucuccgauuacacuuaucaugcacaauaacucaaucuuagaagguacauccugcauaaaaagugaaguuugagaagacagaaacuucucuucaacauuuucauccuugugaguacugacacuauaggcaugggaaacucagaacaccacaucaacaccaacagcuuagagagucagaugucauugugagcugauaaugcuuagcuuuguugacugacguguaaucuauugcaaaucuuggguucuuaggaguucuacuuuauaaauuguauaauguaguucaagagaacaaaauuauuuauuauaguuuagaugacagggauugcauauugauaaaagagguagcaaaaaguuuaaauaaaaacuggacaccaucaaacuuaucugugugauuaaaaucuauagcuacccauagaggaaggugaucaucuauaugucugagugaaagaaagaaggugguucuuuaaaagacuuucuuagguuaaugagauucuauggaauuaaauugacaugcagaaauauuuucauguauaaagaagcuccucaguauucaacgaguacuaaagucacuauguugaccuauguucucaucccaaaugauauggccaagcuuaguuguuguuacuguuguuauuuuaaugagucauuuguguguuagugcuccuuccaaggaucaggucuaauaguagcaagguuucuaagcagggaagcaaggaguggcccaugcuuuauucacacaccauuuauugaagaucuacuguguaccagacaaaauauuagcuacuagagauucaacauugacugcaauagacaaaucuccugacauccuaaaacugagagugaaaagguaaauaccaacaaaugaaucuggcaauugcaauucagggaaacaaaaguaugauaggcagagggacgauuacacauauuuggggggaguacaacauucucaguuacuguaacguaguccagagaggcuucuaauucagagcuaagacaaucuuuauacaauaucccaauuagagggcagagaaauguuaagguagauuagggauggcaugaagauacuaauaggcugaaaauuuuuaguaaugacagagugcuaggcaacugggagaaaguucugaaggacaaagcaggagcuggcuucagaaagaaaaaucaggagguggguaaaaaucaaacuucauuuugugcuaaccauguuagaaaccaauauccuaggaaaaaaaugacuaugccaaauuuaaaagaccagaauuaauuuauaaggguacaaagauucguuugucauauuucaauccuaacucccuauguagucuagcacccagcuuccuccagagguagaaauaugagaagacgugggaaauaaaagacaaaagaaaauagacauaggcacacucuauacuccacccucuuaaaccuucccuaaucugaaaucacacauacucaaaagccucauaagcguacucucagaaacaaacacccuuuaucuucaguuauuauaguccaguauuugauugauaucuaauuucagauauuuuaaaaauacaucuccuaugaaauucguagauggccaaaaugucacuccagcuuucuacugucuccccaaaggacaaauaaaggaaagagagccuaaguauucuggguaauuuuguauauagaagcccaaauguaauguaaaauugugauugaugucuuugauuuuaagauugaccuaguucuguuuccacugucaauuguauuucuuuuucagaaauuucacaaauauguuacauagaguuuaaugaguauauaaacagauauaggaaaaaccaaaaaaaguacugugucuaauuuccuuagacuauauuuuguauaauaccagacauacuucuaacuaccuagauuuuuauaucacuuucuucagauaauauuuuuaaaaucuucucuauuauguuuccaauuggaacguugaacucaaaacuuaaagaaagaguauuuguagauguacugauccacauaaaucagguauccauucuauauuuucuauaguuucuuaucauugugcccuccuaagaagcaaaguuuuauuaauauuaucuaagauaagguagucuaauuuggauuauuaagaguaaaaagugcauuaugucacagcauuuuugaaagcucaguuuugaggaugcauuuuuauaguauuaacuuaucucuucuguuaugaaaaacauaaaauuuggagauauuuuugcuaugaaauuuuaucagaaguguuuuggggaacucugauacaugcauuaugaaaauaguuauuuuucaauucuucaauaauguuuuguuugaaaaaaacuuucggagauuuucgccugaaaccaaagagaaaauucuaaacaaaaaauaaauaggauaaaagcacaucacauccaccuuccugugacauuuaaaauacucauaccugaauauacucuaaaaagaccucuuuaauauccugaugcuagcuccuaauuuaguggagaggacuccaucucaccacagcagauguguccguuccauuucacuaugguaucaauaauagaaaagggccagguagccucuuaaacaaaauauuuacuaaauauauuuaacagaguaauuuucauuuuauugauaaggaaauucuaccccaauacuaggcuauacuacucaggccaauuguuucagugugaauacucagaauaucagguagaacauguaaguaauucggcacaaacugucaucucauucuggaaaaaaaugaauccaguuuuagcuuuacugaaaccagaagauauaaaacaccauaauaucuaugagaccaauggccccugauuuugaaacuaaaaucaaauaugaggauauuauaacacucuacugauuacauaucuauaaaguacuuuuuaagauauaagacauacucauacauauuaugccugggauuuaauuuauuauccaugcuaaccuaccuugaugaauuauuggucauaaggaaggagaaacugaauaaaaauauuuucagacaaaucugcaaucccacugagucuuuccauuccuccaaagugagcacugugacagagcugugucuuucuuagaagugaugggccuuaucaauaaagauuuuuacuguauugggaaaagcuaacccugugaucuuuaaauacucuggcuucagaaaauaauuuuaauauuaaaccucuuccaaaguucuugacuugaaaucccaacauuaccaucaugaugccacauuauuauuuuaaaauacaccauuucaaauaugaaauaauuuuuacauguuaauaacuuaguauauuuuauugcagaauuaacauaugcuuauuauacaaaaucaagaacauacaaaaaagaaggccucauauucucccugucucccaaauacacuauuacaaaagccugucauucugccuuugacaaacuuuauaauauuaucucuugacuccacuauuucacucuuaauccagacuagagcugcccacacuuucaagguaucaucaaagaccucuuaucucagaauaaaagauggcuucagugcccauccuguuauccuccuacagcccucaaaccucccaaugaugugacugacagacauuaccauuauauaguaaauaguaggucaguugcuuauaugucacccuacaauuuuuuuuuuuuuugagacggagucuugcucuguugcccaggcuggagugcaguggcaugaucucagcucacugcaaccucggccuccuggguucaugcaauucucugccucagccucccaaguagcugggauuacaggcacccgccaccaugcccggcuaauuuuuguauuuuuaguagagacaggguuucaccaucuuggccaggcuagucuugaacuucugaccucaugauccacccgccuuggccucccaaaguguugggauugcaggcgugagccacugcgcccagccacccuauuacauuuuuuaaaaguccuaggaguaaauagauuuuuccaucucaugguagccugagauauuuguuucuuucuaaucuuaaccaauucuauuuuagaaauaaaaaaaaaugaaucuaaucuacaucccauagggcagcccugcaaguuauugauuaugcuagccuuucucuaaguuuuguuuguuccauacugaagaaacccauguccuuaaagcaauucaggucacucuucucuggauaugauucaagucauuaaagucucucuuaaaauauaguaccagaaauuggaugcaguccuccaggugugcuaaucucuaaucucuggaguaguauuaaccaaauuccugcacuauuuucaaauggaagcaaagccagcuguaaacggacaaagauaauucuacuugaucccaaaugauguggcuaacagcaucaucaauaucaucaucaccagcacuuaggaaaugcuaagcaugaacagacauauaaacucauuuaaccucuaugagaaagauucuuucagcaaccauauuuuauauuaucaguaagaaauuucagguaacgaacuuuaaggaacaucacuagcaaguuuuuacaggugguagugacagggauuuguucuccauguuaaacaaauugaaagguugaaaggugguuagcuugcuguugaaaggugguuagcuugcuguuauuaucauaacagcacagaauuaagaaucucacuacaaacaaacagaaaugcauaaaucuagaggcuaacgauauauagucuucgucauguugaaaugcugcaaaaauaugguggguuaguucacuuucuaguggcaauaagguuugguggaaaugugguaaauuuccuccaccucagcuauuugauagcauuuauagugguauaacagaaauaaaguacgcuuuauuuacgagaagacucauucuauauucaauuuauaauaauaagcaugcuggaagagccaucuggauaccuuauaaaaaugguauuuuccauuggaaguaaagaauuuuaaucaguguuaguugguaauuauucauuucaccauuuccuaaucaugucaaaaaaaauacguuaagccagaauucacaauuuuuccauuaugcaaaaacaccaccauauuguuuuaucuacuuaguaagaucauuuuuuucuauuucauacacucagaccacauugcucaaaauaagaaaaggcaaauauaauaaucaagcuugauaagccaagaagcagagcaaagauaggaaaaaaauaauuugauuugaggaauaaaaauauuaaauuacuacuucaaugcucugaaugauaaaagcacagucagaagcaguccauuucuaaaaacuaagugguauuucaacagcucuaacaaaggagaacagaaacuagucuuggauuuuuaugagaacuuuaauaugaaugauuuaagaaauuauacuuuaaaaaucucauucaguuaaaguacagauguauaugcuacaacuuuugguuuugguuuuuuguuuuuagacagggucucacucuguuucccagccuggaguacagugacaugaucucagcucccugcaaccucugcuucccaggcucaagugauccuccagccucagcuuccugaggagcugggauuacuggcaugagccaccacacccagcuaauuuuugugggguuuuuuuuguacaaaugggguuuccccauguugcgcaggcuggucucgagcuccugagcucaaagcuaucugcuccccuaggccucccaaaaggcugggauuacaggccugagccaccgugaccagccuugugcuacaccuuuguauaaaccuacuuuaaaauacaaaaagguacuccauucauucuuuucaaaagauuuagugaaugugaauaaugucauauugccuagaguaaucuugauguuuuuguuccacuggaaaaaaacaaggucccuuuagcuaaagcuuuucuucugcuauugucacuucagcacuagcaaaacuagggugacagcucauaaagaaaauaaccaaaagcucucacuuuguccaaugacguggcagcccuccagcacuggcauuuccugccccaaauuaacuccaggggccauaagaucaaaguaagaaggaaguagcuugucuuucucuuuaguugugguagcuacuuuguauuacauaggcaauauaauucauuguuucuuauauaaccgcuuaugcuauuuuacauuguacuaggcaucugcaaacaaacaaauguuauuucuuguuccaaguuagguaaaacuuguaaauaaaacccugcaaaauggcucacaauaaaucaaaauaguccuacaagaaaacagaaagcuagaaaaagauuagagauaagguccugccaauagauaauucuauuuuaaaagaaaaaaaaucagcugaaguccuauuugguucucaugaaccugaaaagauaguuaguuguuuugccagaaaaagagucccagacauuauuuggucacuugccuggaauagcuuggcauuucugcacccucaaguaauaaaacuuacuuguaaaacccuuuaaggcaacagagauugccuguauuuauuuucuaggaagggaaaauauugaaaauuaugauguauucaaagaccacaacuauaggagaaaaugccauacugcuaaauguuuuucaguugacaugaucuuuuaaaucaucucuauugaucccuuuauuuaagauucgauuuggcuauugugagaauaaugaacaaauaaaugaaugugauauccauuugauaucuaguauuucaccaaaaaaaaggaauaagccuggauuuuuuuaucuuugcccuauuuacauuguacaaugaggaagaaauuuuggaacggagcuaacaaaagaucuaaauuaagacaccauuuuaaagcucugggaauuacaguggcacuauuacccagaagcaaaaauccuaaaugauucuaugaacagguaacaaacuacaaaaaacagguaacaagggccagagacuggacuagguugguauuucuuuuuguucaacaaguauuuacugccagagacuggacuagauugguauuucuuuuuguucaacaaguauuuacuaagaaacuaaaauguuagaagcuucaggggauacaaagauaggcaacuucccugaaauaauugagaauuaucuauggugggaaaaacuaugagaaaggaaagagauuuuuuaaaaaugcuauagcaauuaagcagcuuccagauauauuuugggaaaauuacagauaguaguaauuagccuaacccugauaugcaaguuaaucaucucucccaucuagaaaguuguucuuuuuguaacagaagacacauaaaauagugucuauucacuuuauaaaaauagcaauaaaccucaaauuccucaaguagaaacaaaauacauuuuccucuaaauaaaaaaaacuauuuugagcuaggaaaagagaauaccuauuaaaauguauuuugcuugcuggaaaucugguucaacucacaauuucccagcaaaaggaaaaacuaggauaauucuuucucugacaagauugccugugcuguuggcaacacucuucaaaaacugaaacucuaauuuuuaauucuacaguuaccuccuagccuuccauggucucaucuacuaaaccacaguuagaauuacauuuccuacauauguuauuuucuuggaguucaaugaacaggacugaaaauaaagaucagaaaagaaagaagagagacucaaauuaaggaaaccaacuaaaaacagugagacauaagaacuaaaaggcaagggaagaaaaaagagacagagaaaagacagaguuggggcaagaaggaaagagggagaccaagacucaggggggauuucagaggacaaagccuucugucuacuuuaaguauuagcuuacuugacuucauuaaauguuggcuugugucuauuaucagcugcucuuuacugcccuguaaaacaacaauaacaacaaaaaacugguuggcaaaggcagauaugacaugaaguagcaaugaccuggcuaauaugaaccuuuggacaagaucaugucuuccugagcccaggugcaucaauacuggauauuuucugcaugcccauucaaucuacaggguucugaaaccuaaauaaaauucaauguaauagcugggugccuuucaaaacacuaugcaucauuuacuaucauauucacuguugaauaaacuuuguaaaaacugagaacguaagacaugagaaagcuaagaaauguaauugggaagggcuaaauaaguuaacagggccaagccauuuuggccagauggcuuuuugcaauuuuggaaauaucugaacuucucacaaaugucacaggauguagaacugaaaauauuuccaucugccccaaccaaagaaacuauugcucuucauucaugcaaauguaauuccaugcuaucccccaaguuauuaagacuguucggccauuuaagaagaaaaauagucuauucuuccacugaaagaguaauucuaaagccacuuagguaaaugacugagugacaaagcaaauaagaaauuaauacauuugagagagcugcuggaaauaguuucuucuuacauacucugcuuauaauagaggaaaauaucuaugagacauaguacagaacuugggugaugaagugguuuaagaauuaugaaauaauaugacuuuuuaaauugaaaaaugaauggcuaguuggugaaagagucaggacuagcacucagaucuuccagcugcaaucgucucuacccuaugcauuagugucuguaggcucuggggugacuggggauggagaaagcaaaagagaaucaauaaaauuaacucagauuuuuuuuuucugguguuaccaccaaauuccauacuuauaauacuaauguuuacuuuuaaagucuuugauacaauuuaauuccuuugaaauaauacuacaaagaaugugaauuuagcucccuuaaaccccuccacauuuccccucccaaucuuuccucaaauuauaauuuuaucacaauuuuuuguuaaaucaacauuaauauauacauuauuauaaauuauuagaccugagccacauaguaugccaggguuacauuucuuucuuuuuuuuuuguauaauuuuguauucccuacagauaaucacugccuuagcuuuaucuuuuuuuagguugcuuaauuuucuaucuaccuacaauaauuuauucccaaacugucuauagaauuauaaaucugcaaacaucucuggucuacuauaguauccuucccauccucuguaucauuguggguuuauggggguuuuuauuccucauuggcauuuuagugacauuucaaugaggacagaugaacacacgugcucaaucaaucauauuuaaccaggagcuagagauguucauucguuuguuuguuuguuuaagaaauggucucacuauguaguccaggcuggucucaaaaugcugggcuaaagugauccuccugccucaggcucccaaaaagcuagggcuacaggugugcaccaccaugccuggcuaauuuuuaauuuuguuuuuguagagacagggucucacuauguugcccaggcugguaucgaacucuuggccucaagagauccuccugucuuagccucccaaagugcuaggauugcaggcaugagccacugugccuaaagaucaguauucaauuuugcauacaugaaaaucugaacacagggucaggcacgguggcucaugccucuaauaccaccacuuuaggaggccaagguaggcagaugaccugagaucgggagugcgagaccagccuggccaacauggugaaaccucaucucuacuaaaaacacaaaaauuagcugggugugguggcacaugccuguaaucccagcuacucaggaggcugaggcacaagaauagcuugaacccaggugguagagguugcagugagccaagaucgcgccacugugcuccagccugggcaacagggugagacucugucucaaaaaaaaaaaaaaaaaagaaagaaagaaagaaagaaagaaagaauagaaaagagcuuaauuugaaguaagaaacccauguauuauauauaauaucauaauaucagaaguauuacaaagcugccugcauaacuuucauaaauaguaucauuuuauacacauauugaaguaaucagaaaaagugcaacaaguaggguucauuuugauauuuuucuuuccugaacaggacaagcagaucacuacaauuaacaccuaucgugaauuuacagggauucagguagaaaauaauucauguuaaacagagguuccaaacaucauuaacagagacugagaaauugggccaguaugcaugagagcacauaucauaaaggucauguguguuaaugagaaaaagacuauuuauuagcuugcaauuuaaauacaaagcccuucucccucaauggcuuaaaauggagcaauauccuauaccugaggacaagaaaaggcagugcccucaauuagaugaacaacucucacggucccaaaacuuuuauuguugucacugaaauucaucauucugauuuuauuuuuagauagugauaucuuuuacguuacagacagaaagcuugugaauagaacccauccuguacuauuguauacuuuuuuggaaguuuaagagacuauauauuuacuuuuacucaguugccaagcagcauauuuccuaacuuuugugugugcuccaaucaaugcuuuacauuuguucugaggucaaaaaagacaaaaauauuugcagauaucaugaaaaaaaucaacaugucauuuaaaaacuaaagacauccaucuuuggaaacugccauuuuauuacacaaugagaagaaaacaaaagcauggauuucaaaaagaggugacagauaauuaugauacuguauaaauauuaaaugcaauugugauguuauaacuacuaagaaguaauuuaauuuucugaauacauaucugaggaauccuacccccaacccccaaccucugcgccaggcuaaauaagcgagguaaacacucaugacacaaggcuaugcagcauucacacuugaggucaaaaauuccaaaaauaaauccauaacaacagguguuauccuaaaagcacugagauguuccccgugaaagaccaacaauuuuggauuuuuaagaaaauaaaguagaaaugcucuauccaaacacauuuuuuaaaacucaccuugggucauuucacaaauauuuauuucuuagcaauccauuuuccuuugcuuauaaauuccuguuucacugauuucaaaugaaagaauucuuuuacaggcaccucuuacuaaagccaagaaauggaauaauaccuuuaaaaaagauaacuguaacuguggaaaggcacagaaaguaaauauaaaccacagucagugacugauccuccaugagggccauaugaaucucaggauauuuauugugcuaucuacgugagaaaaugcauucucauuuuaaauaauaacacuaguaaucucuuuguccauuagaaauaaaccagugcagauacuguauauucaaaguagcccauaugcacuaaucaaucaucuaaccaaagcuuuaaaaugguuaguuuucuauuucccuuauucauucauuacccuacccuguuuggaaaacuuuaaaaaauuauuauuuccaucucagugucacagauacacugcaacauugucaaauaaaaugauuguuucuggacuaacaaaaucucuauuuuucuuacaaggcaaacccaucauguugugacaaaaccuacuacauuuacuagagaaaagaagagccaaaacuaugagcacaaauaauacuucucuaugucuccccaguauuugacauuaguaacauaaugugccagaguuucccugaauaacugcaaguuccucuuccuacaauacuucuguaaauacacaauauggccacauucaauuuaaacuuccaguuagacaauaucuagucaaugucuaccucacaggaauagucguaaauucuaggaacauagcagugagcaagauagaucauaauuucugcccuuguggaucuuagaguucgaaagucacauaagcugggagucacauauauuuggagaguuuaagggagaaauuauaccuuccauagagaagcugaucauaaugcucauugguacaguagcucaaauacagugugucuaucucagaagugacaggaucauccuuuguguuccuacaguuuucacuucuuuuuccccuuucuuacuauccaaaauacuuacgcuuauuuaagaguugcugaguuaaaacauauuaaauccacgggggacagaaauucuaggagacuggccauauaaaaaacaguagacaagaaauaagugaauggauuacaaugaaagagauaccucccacaagcaaaugaggauucuugagcauuuauucaauagauguuucuuaacuauuuaugugccaguacugaguaaacaaugucgagcaacacacaggcccuaauguuacuaacagucuugcaaaggagaaagacauuaagcaaaugaucauuaaauauauaaauacaaacugugauaaauguuaugaaagcaaaacaugaauauugucuuaaaggggccugaucugaacuguagguucagggaggauuucucugagaagauauugucuaaccugggagaguugagcuaaauaggugcaaagaaggaggaagaaccuucaggguagaaaugugcauauguuguguagaguuugggaaaagcaagguaggaucuacaacaaaagaauaugucuagguacaguguggcuggaggagaggaaacuagagaauaugcugagaaauacaacugaagacauauacucaugcaaguauaugaaauauacuaaggauuuggaucuucaucuagcaagaagcagcuuugugaacauaugcacauaagucaaaagggaauauguguaguugccucuguagagaggaaccauggcuggaggacagaagcaggaaggagacuuacuugucacuguauaggcuguugugccuuuucaauuuuaucuuuguaugucuauuaccuauuuaaaugaaaacaaugucaucuagauauuuaacucacuggcucuauuaggaagaauuaauuaucggagaccaaacaaaaggccauugcucuggucuggguaggccaagcagcagcagagauaguaagaaguucagaaugauaauggauuugauaauaaaaucaacaauuuguuccaauggacugccaaguaaguaagaagauacaauaggaacagcauguacccuagaugaggcauuaggugaacucuucccacuugcucucaagugucaacugagcaucgcgucagggugaaugcugagucuggugguugcaaagacuuaaguaauacuaagggacuauuagaaucaugagccacuucuuacuaagaagcacaauucuaugaagcaaaaacuugggagaaaaacaauguguauaacucagagcaguuaaaaauaaauaaacaaauaaaaacacuauuccaaaggaugcauuuggcaaauugugcuguuaaaggcaaaugcuaaaagucagcuauucucuggauauguuggcuccauucaucauucaacgcccauucagaguaauuauugaaaaguauggaagcuagaaugcacauauacugacuuaggagagauuaaaggaauaccaacaaaaacuaaauuuugucugaagguuaaaaaugaauucagaggaauauaaaaauaagugaagagaaguuguaauguaauauacccacaaaugagugcaauagcuaaaauaucuuucagggaacuacaaaugcuaauuaaaaacuuauaauucaaaauagauggaucugugcuguucuugucaauauaacaugguuuuuuaugaggaaggaaagaggugggggagggaggggaggaaagggaggaagggagggagggagggaagauuaucuuguuucucugauuucuugcuagcuuuaaaaagagcuaaauauuauuuuucuuuuaauauuaaauucccuuucacuuaucuggaucaagaaugucuucucaaauccucucucuaauccaagaaaaacacuaaagaaaaauaagcauacuuauagggaguacagaaauugccacuagaacccaaaugacagccuguuuguuuagcuuagaaccagaccucaaaaacuaauaggagaacagucaaacaucuuagaagugcauuuccagcagccuaggcagaguuaauauuaaauguugcacagaaagcaagagccccuacauccugcucuaucaucuaaauuguaaacuccacgagggcaagaaccaagucugcucuaugccccgggucaacacaguaacaggaauguaaaaagauguuaaaaaaauauuuauuaaguuaauggaugaaaaagggaauuaagaaagaaacguuuugaaaaaaacaaaucgauauuguucuaucugcaauugaauuagauguguucuggaggcagaagccuuaacugggugccagagguaacacugaguucgacagaugcugcuacuacuaaauguauccuccaucuccuaacauuucuuucauuggcuccaucuuugugucauacguuucuuggcuaaggucuuggcuuuauauucaaaauaauuaauuuguucuuccuguggcuccauuuuauuucagagcucuucuauuuaguuuucuacuuucacauucacacuuuaauuuuaaaagcuauuucuuauuaucuguuccuuuuucuuagaugcuaaucuuguuuuagagacucaauauucucucaaauuauuuggaagaauuuauaauuucuauaaguuuuccauuauucccuaacuaaauuuuguuuccucucaggucagggggcuguuguugcugccguuguuguugcuguuguuguuguuguuuuaaauucaguccuauacauucacuguuuugaaucuuccucaaauaucuugugauugaugguucacauaaaucaauaagaaauugguuuaauuaauauaaaggucuugcaugggacuuuucugaaauucuuuaucuuucccaacgguuucccuccaaaaugagagcauugacugaaaguugucuguaggcaacagagacuuguaaacuggaaggguuacaucaacaugcauggaaaaauaugagaacaccuguuggcaauaucucuaagcagccacauaaaaagugauuuauccaguaggucacuuuagugcacucuucucugagacauagcuccuuucuccucucauuacuuuuccaccauggagauucagacuccuuaggcugaguccucugcuucacucugggccugaaagcacauuaguggcucuagcccuccauagacagacuguuuuaauuuuagugguugcgaggcaggagcgaccacuucuggaaugguaaaguaaggaccuccaaaaaucuacuccuccauaaaagcaaccaaaacacaaacaauugucaaaauaaacuuuuucagaauuccaaaaguuaaacaaaugcuugcaauguuccaagaagaauuuauucaagaaaaauagcugaaucuugcuaagaacagugagcuuucuaugcuuuuaaauugcugcuuugggaaacaguuugguaguuccugaaaauguuaaaaauacaguuaccauaugacccagcauuucaacuccuagguauacaccccaagaguaccgaaaacauaugucuaugcuaaacccucuacaccaguguucauaguaacauuauucauaucaggcaaaaaauagaagcagcccaaguuuucaucaucuguugaauggauaauaaaacgugguacaucuauacaauggaauuuuauuuggcaauaaaaauaaaugaaguucugauacaugcuaaaauauuguggaaucuugaaaacauuaugcuaacugaaagaauccacucacaauaaguuaaauauuguaugauuccaauuacaugaaauagugaaaacaggcaaaucuauagaaacagaaaguagaaguagacagugcuugcuagcccuaggguagaggaaggaauagggaaugauugcuagagugugugcguuucuuuuggggauaaggacaaauguucugaaauuccauagugguaauaauguacaacucuguaaauauauuaacauucauggaauuacguacauuaaaagugugaaaccuacaguauaugaauuauaucucaauaaaguuguuguaaaaacauuucaguagaugacaguuuuuaccuggggcaaaaauacuauuuaaaaaagacauauuaaggugagauuauugcaauaauuucugucuuuuaagcuucacagaggacacuucacagauuuauuugcuucuaccuuuauucauucuaaaauuacuucugggaguauaaucucacaauugcaaacaguggaugacauacguguaugugugugugugugugugggucuguguguguuaccaaaugaguauauuaguuuauuuauugucaaaugauuauacuuuguuaugaaacacuugaauacuaauaguuccucuaagugcuucauguggaauaacucacugaauguucaaagcuauucuaugagguugggacuaucauuaaccauaggaaaaaaacuaaaacagagauaacuuaaugaggccaagaucacagauagaguaaauaaaauuugaaucuagacaggcuggcuccagagucugugcuuuuauccacuugcugugcugcugcuguaauaaaaaauuuuaaagaguacguuaaaaguaauacaguaaguaguuauguugaagacaucacaaauauacaacacagagaagauaaaauaaaacagaacuaaaaccaaucccuucauguuuuauaauaaguuauuacagcuugggauauaauuucagugauaacaaguuagaagucaaaagaaagaagauguggucugaaacuguugagugacucaaaaaguggaucuaauaaugaaaaacacugauauugaagaugcauguaaaacacugaaagauucuucaugaaauauaagagcagaaaaaaguaauaugguuggcccuugaacaacgugggguuuaggggugucaacccccaugcaguugaaaaucugcauuuaacauuugacucccucaaaaauuaacuacuaauagccuacuguugacuggaagucuuacagauaacagaaacagucaauuaacacauaaauaaacuaguacuuacauauauuuuauacauucaugacauaccuaacuuuucuuaacuuuuuugauauugcuagacuaauugguucaucugaguuuauucaaauuguugcaaauguccaaaaaauuuuccaacauauauaggaaaaaauccacguacagacggaccccacaguucaaauccacacuguucaaguaucaacuguuuauuuaaauaaguauaugugauuuauauaaccuacauaacaaaauuaauaaaauaaaauguuaaauagcuauuugagucaucuacaaugauguauaugaaaaagugggagaaucacuuuauguucaagauuaccuuucuuugaagaaagaagcaacucaucaaauuuuuauuuaaaacauccaaaaaacaacugcuggcuauucuuauaccccgugaaguaauacacugacaguucaccaacaaauuuggauaugucagggagccaaaccuuaacaaaauuccauuuuacuuuuuauuuuauuuccaguacuacuucguuuuauuugacuuugucaugucugccuuuauuaugcagugacuugcaagaaaacguaaaaucucaaccaugacaugaaaaccaaauagaauauuaugaucucuuuguagguuugacaauguauugcaauuugacauagggguugacauaacccaccaaagauacaugcucucuauuuuuaauuuuuaaauaagucuugucaucguauguucaaaucuuuauuccucaagcaucuccaagacacaggguuuacucucauuccuaggcugucagucaaggggguccugguucugccucccugacaaacuucccucaauagcugcucccuuuccacuacaggcaaaugaacuuccugguauuaaagaguacauuaccugcuauuacauuaaagaucgugaaaaaaccacucaucuugacaguacaaacuugcaccaaaccuccaacugagucccugggacagagucugacagacauuugcuauaauuggcucugccacugagcuggcuucacaauucaaacaugaaacaaagcuaacuaaggagaagcaagguugaaguguguuuuguccuuuguuuuuccuccaagcacucaaaauacucauuacuauagaauuuuacgcucucgaaguaaaaacaauucuuauauaaauauguaagugugucuacagauauacauauguauauauucacuuuauggcggaaaaugcaagccuuauuggcuauucuuuucucagagaaauaagcaugcccuacuaaucuuuuuugagauuaauuuucucuuuggucuccuagcagauuacuucagguuaccugcuuuucugcauggcuuccauauaaccaacugugccauuucauuagccacaguccauuccugaugccuggagagauuacaagcacugguggcuuuuauuccauaggaaaagcuguuucccaccagagaacugcucugucugccuguguuagggucagaauguucuagagaauacuguccugggauucuugagcaagcuggccagugugacuccuguguaacagugaacuauuauaagcacuugaaaacagacuuugaauuuuacugaucuguauaacaucuaggccaccugccaguguaccugagcauaaagaaaguucaaucagcauuuguugaacuuaaauaguaauugagaaagggaaggccucaguucuacugauagccauuugggaucauacaguuuauuuuucauucuuuuuccacaucuuuaaaaugucuagaaagaucuaacaaccagcuuacgugaaauauagggcacagagaaacagguucaaugaaaauacagggauauaaucaccaaaauucaacaugugggaaacuacagcaaaauuaaccugguuucuucaacaaauaaauuguaaugagagagggggaggaagagagaaagagacagagacagaacgagacagagacauaaacugaccuauggaauugaaacuauauuuaagggacauaaccaaauguaaaauguggaccuccuaauuuuaccaaaacguaacauguggaccuccucuuuugaaaaaaccaaauguaaaaaauaaacauaacauuuaugagucaaucacggaaaucugaacacagggccagaugcgguggcucacgccucuaacaccaccauguuaggaggccgaggugggcagaugaccugagaucaggaguuugggaccagccuggcaaacauggugaaaccccaucucuacuaaaagcacaaaaguuagcugggcguggugcaugccuguaaucccagcuacucaggaggcugaggcacaagaaucguuugaaccugggaggcggagguugcagugagccaagaucgcgccauugcacuccagccugggugacagaguuucacucugucucaaacaaacgaacaaaaucugaaaacaauauuugagauuaagagaguacugucgaaguuuuagaagugauaauaguauaauaacucuguaugaaugaccuuauccauagauauugauggaaauacuuacagauaaaaauacuaugguguuagggauuugcuuuaaaauaaucguggaagggagaaaaucggugagguuauugaagcuggaagaugcauacaugguauuuuacuagacucuucacuauaauuuaguauauguucaaaguuuuaauauguaauauuaauugcuauuaauuacauaaucauaaugaauuugaaguuuucaaugcuuaaaauccauacauuccccucccuuugagcacuuaauguuaccacugcauuaccguuauuuaaaccaccuugccucuuauguauaacuuuuccuuaggcucuuccucaauucaccaacaguauaguacucccuuuucccacugaauccugaaaacaucucuguuacugcacacaucacauuuuagcacugcauuuguuuauuucucacacuagcaacuucuuaguagaacaaauuuugagaaagaaaaucuuaauuuauuaagcauaguauaauagaaaaauaguuacauauacccaaaguuauuccuuugucauccucccuaauaaaugagauuacuuguuuaagcuucagcucaguccauaaaacucuaccagaacaaaagcagaugcuagcaagauguaguaucuacucuauccccaacucagcuccuccucauuaauagacaaaaaggccauuauuucaucuucuccgaaguuuuacuacaaaaauaaugucuauuuacuuucuucuaaucccaucuucucacuuucucuuuuuaaauuauuaucuaucucuacugaauuaugagcuaacaagaaguaaaugccauucuucuuaguauuccagaacuuaggacagugccagguaaauaguggauagcuguauauaaauauauauagaugaaugaugaauggauagcuggauaaauaucaagacucaauguaauauuuuuguugauuuuucugguuaaauauaaaugcaaaaaccugcaguuuuacuguaaagaauucuaaaggccuuuagguaggccaaaauagaauauaucauacaugaggggaaaggaagcauauaucucuaaaauagcauuuuguauguuuaggaguacugccuuauggcaaauagcuaguuacucaauuuuucuuuuuuaaaaaaaguucuuaacagaagaguauuuaaaagucaucaugacuuugggaauuuuaaagaagauuuauagguauucaaacuucacugucaauaaaaugucaaagcaaggccuuauaccuacuaaaguuaauuuuuuguuuuauauauugagacauacucuaacaauaaacacuaugcuaccacauagaaucagaacagugcaguaguuugucuuacaacauaaucaguaaauaguauaacuuucuguuaguuaauagggguaaucuuaacuuugcagccuucuggauuguuaaaggauguuuugauuuacaauauaaacuaaacugggccuaucuuuucaugguaaggaaauugaccaguuuauguauaaaccuacucuugacuaacagaaaucaguaaacuaugaggccaugcuauuuuucuuuacuuauacuguacuuggaaacauaguaaaaguaucuaaaauugcaaaugaaaaaugauuaaacucuuaacaaacauauauacaacacaggaaaaaagguacucaccuuuuaaugagaacuauauauuuucuuuaugguaguaguacaauaagcacacaaaucuccaaaaguuaccaagucugggacacuauaaaaaucaauuuuucauucaaugacugcucauauccauucagcaugaauuauugccuuauuaaguaccagagacuuuuucucccuaacugcacaccccauuguaccaaaucuaguuagaugaagcagaaacaaauucauauuuccuaacacuuauucaaauuccuuggacuagaaacugcacugcugagagucuucacauuucaucaaauuauucucccaguaaguuuuuuacuaacaaggcucuccuguaucauugcuuuuuucuuuuuaugaaaaaugaaaggauccccacuaauuucacaguacaauguuucauuuauuacucaaucuuguuucuuaguuuauuaaaauuaaagaaguauaugcucuauuauaccacacuauuauauuuaauaguuagcuuaaaauguuaaaaauaaaauuaaaacuacuuuaaaguaccuuuaauagauauuucuaaaacccaacugcuuuaucuuuacuaacuggcuagcuacuuauuucuuagauuucuaaaguccugcuagaaacauaauaaggguagauaggcauuagcauuauuaucuaccauauacauacauauuuuuaggaucuucccagugagaauuauaagcaucacaucagcaaauagaaugugauuuuuuaaauacaauaagaaaaauagcaccaagaaaacccaaacuucaccaugaaaagaacaucccuuuuuaccacuacaauuguuauauuagacuuucaaauuaauuucaguaaaaagaaaauagugacggaaaaccaauacugguuaaacuaacuacaagaaggaauuuuacuuggaauguaagagccucauugcuccaaaucuuacuugcugugaacuagggauaaucaauaaacucuuaauaacaguucgaguuuacauuuaacacaagagauggcugcgaucuaaaaaucauuguacauuaguucgguuuccuuucuuuguuguuauuguuguuuuuugacacaaggucucacucugucagucacccaagccggaguacaguggugugaccaugguucauugcagccuugacuucccagguugaagugauccucuugcaucagccucccaacuagcugggacuacagcccugccccacuaugcucagguaauuuuuuaauuuuuuguagagacagggucccacuauguugcccagguuggucucgaacuccuggacucaugugaucuccuacaccuuggcuucccaaagacugacauuacaggcaugagcuaccacauccagaucauuaguuauuauuaaaauucugcuggggaggagagauauauucaaagacguauggguaauaauuuugccuucuucccuaggaucaagaugaauauggcuuuucuguuucugaauuuguuguaagaaacagaagaaccuaaaguuuccaaaacuuccuuaaguggaaugcagauaucauugcaguagugugugucguuacuuuggggcugguaaugcaagccuugagaauaccagagcagcaacaaagcuggauaauaacauucaacucuggcugccucugcuucuggggagaaugucacuggcaacugcuuauccacuaggaaagagagaaacgaagaaauauucacucuaaauauacuauuuagaucuucucuggguaggcauuuuccuucuuggaauaaauaaauuggaacauuagaauaggugaacuaagcucucuucuaaccaaucucuaagccauuugaaaugccaauguggucaauaaaaauuuuuucacuagaaagccuugcauuuauauuccucugucucucugucuguguauauauauaauugcacauaaauuuccaugaaaauggaaacuugugugcauugucauggaaauuuauaugcaauuauauauauauauauacacacacacagacagucauguuuucuacugaacaaaaauaauauauacuuuuaaaaacuuuucauuguugcauaacauagauauuguaaaguguaaaaauuuuaggcauagcuucgauguauuuucaugaaaugaacucauuuauguccaccauuccaggaagcuucccuuacaccccaucccagugauuuugccucuuuaaaaguaacaaaaauuuuaaacucugccauuuuaacuuugccugucuuggaacucauagagaugaaaauauauaauacauacuauuuuguguuugacuuauuugcuccagauuauaccugugagauuuauccauguucuuuguguugucauaguuugugccuuuucauugcucuauagaauuuaauuuuauaucuacaagauuuuuauuauuucuauucuugacagacauuuccauuguucacaguugauuuaaaauaauacuguuguagacacucuuguauagauuuuuugguauaauuacacacauuuuuugguuuggacuguauuuaggauuagaauaggugggucauaggagaugcuuaaguucagcuuuagacuaggcugucaacaguuuuucagagugguuauaccaacuuacauugccaucagcaccuuaaaaguucuaguugcuccacaucuucccuuuccaauacuuaguauuuuaaguuacuuuacuuucuaaauauuaaauuuuaauauucaggcauuuuguuaucugcuaauguuaguccuccaacuuuauucuucuuuuucaagacugaccugguuacucuugggcguuugcauuucucccacaaaauccuguugaauauuuaauugggauuacauuaaaucuauacucaguuugcuaagucgacauugacacaauucauaaacacaugauauaucuuuccauuuauuuagguuucuuuuagcuuugaaaugugugcacagguuuuacaaaacuuuuauucuuccuuagguauuugaugacuuugaugcuaauauuaaugucgucuuuuaaaauuuucauuuucuaagucuuucaagcuagcacagagaaauacaacugacuuugugugcagaccuuguaucuaguauuuccuacaugcuuggaacaccagacuggugaagucuucuaggccugagauuuuuuuucugugaggagguuuuuauuuauagaguuuauuuucuuaauagauaugacuauucaaauuuucuacuacuccaugugucagugaugagaagacgugauuuucaagaagucugucaaguucacuuaaaagguguucaauaucacugaucaacagagaaaugcaaaucaaaaccacaaugagauaacaucacacucuaguucaaauggcuuucauauaaaacauaaggcauuaacaaaugcuaguaaggauguggagaaaacagaaucccugugcacuguuggugggaauguaaauuaguaccgccacuacagcgaacaguuuggaggcuccucauaaaacuaaaaauagaacuaccauaugauccaguacucccacugcuggguauauagccacaggaaggaaaucaauacaccaaagagauaucuguauucccauguuuguugcagcauuauucacaauagccaagauuuggaagcaaccuaaguguccaucaauugaugaaugaauaaagaaaaugugguaccuauacacaguggaguacucuucagccauaaaaaauaauaagaucuugucauuugcaaccacauggaugguucuggaggucauuauguuaagugaaauaaacuaggcacgaaaagacaaacuucacauguucuuacuuauuugugagaacuaaaaaaacaaugcaacucauagagguagagaguagaaugaugguuaccagaggcuaggaagcauauuggagaaggaguggggaugguugguuaauggacacaaaaauaugguuugauagaaugaauaagauuuaguauuugaugauaguacaacacugugucuacagucaacaauaauuuauuguacauuuaaaaacuaaaagaguguaauuggagcauuuguaacacagaaagaauaaaugcuugagguaaucgauaucccauuuacccugaugugauuauuacacauuguauacccauaucaaacuaucucaugugcccccuaaauauauauaccuacuauaaagcacaauuuaaaaaauaaaauaaaauaauaaauauuaaaagagaaaaccauaauuaaacagugaacacauuuucuggauauuauuggugauuacacgacauuaacuuacuguaguugucugcacaagcagcacaaaucuggccccgaugacaucauuaaaauauauuacuauuagcacuacauuucugucagaauuuuuauuacaguuuccuagcuugugagcuagaaacucucaucccauacucuauauacaaaaauaauacuuuauuauauuuuuauuauuccagaagcaaaaacacauuuuguuaaaaacucagaaaaauguaaaauaagauuacaguauuguuuacaugucaaagaaaauauauuccaauauuuucaacucuucaaaguacucugauuauagguagauauagguagauagauauagauacacauauagagagaaucaucaaagacuguugcauaccaaauaaacucaacacuaaugacaguaaaaacauaauucauaagggugagauuuuuaaauuguauaauauaauccauuauagcacuugcaacuaaacacuguucacuacauacagaaaguagugacaauuaugccuugagguaaugaugugcucuuacaauugcuaagaguaauuucuaaacgaaaaacuguuauaagaugcaaauuuaacuuucauccaaaacucuaguuuuucgaaucacgguuuucaguucuuuuaggacauucccauacucaugggugcuauacaacugucuaugauacuguuucuaaacagguuaagaaguuauauugcauauacguuuuuucaaagauccacaaauacauauuguguugaauaauguagauaacaaaugggguuauuuauuccaguuuucuugaauuaucaaacugaagaacaaauaauuuguucugugaguaauaucuaaguuuccauuccaaacuauucagcccaagcuuaauauaaaaucuaacuggaaaucaaggacuagucuaaccuuucuccaauagaugcuuuaugauuagaguaucgaugaaauaaacauaaccaaaauuaaauggagagucuucucuucuuuuauaagcauaugcuuaauauccacauacuuauuccaccaaaugucauaauguaccuuuagaaguucuaaacuaggucacauaaaauuauaaguguuuugaaauuuaaaauguuucuggcagcauucuacuaagaaaggguauuuucgguucaaguugaugcugaugauuuuauuuauuuauuuagagacggagucucgcucuguuacccagguuggagugcaguagcaugaugucgacucacugcaaccuccgccucccagauucaagugauucuccugccucaggcucccaaguagcugggacuacaggcaucugccaccacgcccagcuaauuuuuguauuuuuaguagagaugggguuucaccauguuggucaggcugauuucgaacuccugaccucaugauccacccaccucggccucccaaagugcugggauuacaagugugagcucccacgccuguccucaggucgaugcugaugauguuuauacuuuaaaacauuuaucugguugauguguuuugcuugaaaaaacaauaaccuuuucuguaauauuuuuaacuucuccaaauuaagaaaacacucagccagcaaaaauaaauucacuaaacaaaaggaaggaaacaaaauaaauuaauuuugaaauaagcuaacugccuuaaauggggaauagaaggccuguguuuuguuucuaaauuuuuuaccaauuugucaugaaggcuuacaugaagaaaugaacucuuagacaagcacuguccaacagaaacaucaggugagucauauauguaauauuaaguuuucuaacagacacauuuaaaaaggaaaaaaagugaacuuuugauaauauauuuuacuuaauauaccucaaauauuauuacuuaaacauguaaucaacauaaaaaguauuaaugggguaucuuacauucuuuuuuuuauuacuaugucuucaaaauacaauuuguauucuauccuagggcacaucucaauucagacuagcugcauuucaagugcuccaaagcuaaugguaucaacuugcacagugcagcuucacacuuuugguucuucacuuacuaaaucauaugauucuuaaggguauuuuaguacuaguuuuguaaaauucuaaucgugguuaaaacugaucagugaugagagaugcuaaauucuucuucaucccauaaauaugagcaaacacaauaaaucaguauuaaauauauccaaaaaaaugcaauagcaaaauacaggcaaauuucauuuauguaauuuaugaaaguaugccauaaguauguuuguauuauuauaaauaaguuauccaaaaauauuauaacgcuauaauaaaaugcuucagagaacugcuauacauaggaaaaaggauaaaucccacuaacaaaccuuugagcaguguuuuugcuuagguuuauacauauuagaguagucuacugcaauuucuauagaucacauaugcaguuuacaagaagccuguauggacacuaaaauuuaaaucauacauguuuuaaggcugguauggugaguaagucauuuugcauauaagugaguaaauuaauuaacaucuaugacucaacuggcucuuuacucuuuaucacauauauguugaguacucucuguuaaaaguuuaaugacuuaaauuuuuauuaagauagaaggcuauaaauucaugagcuaaguaugucauuuaggaaguuagacaaugagaaauaaaguaaaaauaaagguaauugaaaauaauaacaaagauaugaauaaaaauuaaagaaauauaaaguaaaaguaaaauuaaaaaauauaaaauaaauauaaaaaugaagaaauauaaaauauaagauaagauuaaacaggaaucacaaaacaaaaaguuaauucuuugaaaaaacaaagaauucagauaaacuucugacgaguuugaaaaauuaauaagagagccaaauaaauauuagaaauugaaaagguaacauaaucagagauuuaacagaauuaaaagauauaaaagaauucugugaauaauuaucugccaauaaguugaaaaaaugucauuaaauagaaauaucuuuauaaaauauagucgaucucaacaaagaauaaaaauacaaauaaauauacaacuuuuaaauaaauggaauuauuuccuuaaaaucuuuccauaaauacaacagacuccgagauuuuuaaaugcaaguuuuaucagacuuucaauauccaaagcauuucaaucuuauacuuuucuagagaaugagggagaagggcauggaagggaggagugauuuauuucccaacucuaugaagucaauauagcuuugacgacaaaacagaaaaugacaauagaacaaaaaauaauaugcccucuuacucauguauguauauguaaauaucccgaacaaaaugcuauaaaaauaaaauccagugauacauaaaaacauuucuacuguuugacuaagcuaacuuuuaggacuacaaggggauuauaauuaaaggaacuauaaaugucauuuacuauaucaacauucuauaagaaaaaauuauaauuaucucaauagauauagaaaaaaguaucugauaaaacugauuacucaguuaugguuaaaaaaauagcaaaucaggaaacgaaaaagauacccaaaauaaccuucaguaaugaugaauguuuuagguauccuaucaugguauauucaaauuucacaaaugcuucagagcacauuccucaaaauucaaggaugugaauaauaaguaugcuaaacaaguguauuguauggaguaacaguauuaaauaccaauuugcucaaaauaguagcgaacagacuucaggacauucauuaucuacaagguuuuugauccuaaugaaugaaaugucuacugcaaagaagcaauuuauucauuucauuauaaauaauuuuauugacaggacaauuuuuaagacaaccugacaaacuaaaaugucuccacuucaaauaaaguauccaacauuuaaaaaaaauuauauuacgauaugcuuuaaauagaauucugaugcugaacuccguaauaugugaguaugugugaguuaccacuuguguuuaauaacuguuagauggcuaauguuaguccaaaugacggucugcucugguuaacacacuaaaauuguuuauaucaaaaucagaaaaucaaugauugcaaaccaaaccaaaaguaaggucauaccaguaguuuuuauauuuauugauaaauaaauuauugaucgcuaauauguuguuaaaaauuaugucuuuuacaucucccuaaaugcauuacauguauguauuuccaaugaguuuuuaaaauguccaagacaugaaauuuaaaagaaucuugaagaaauuuauuaaacacugaaauuugauuauaauuuuacgaauuuauuccugaacucaucucaaggagcaaugaccucagguaaacacgcgcucuuagagucauaugggauaaagaagucuggcaagauuaaaaagggaaaaugugacuuuuuaaaugacaauaaguauaacacaaauauacuaaaguucauaaaaauauauacuacagucaucaaauguagucaccuacucaguucagggagggcauauccuccacagggauucauccauucuccauuuuaaaauugauuuuaacuuuacagaaggcauguuugugaaucaaggaggauuccagauuuugagcgaguaguuuuuuuuuuuuugccccauuguguuugccaagccccauuguuagauaaaauuuccagcuagaagguaugcucuugccaaugacuuucuccugaccaaacucuugucagaauccucugaucuccgcuugacuaagccucaaacuugguggauaaaaacugcaaccucuucccacaaaugauuuugucuagacacccccgcccucaccaacauaaacacuaagagacuugaacaaacacuaacauaguuucuaacugcucaaggccacagcccuaggaugaccccaucccaccuuagagcgccugccugaaaaaagcucaacacugccaggagaacuugcuguuuguuucagccccaaaccagauaggccccugaacccugcucuuauagagcaguugcuuuagaaagcuugcaauuauaaaugcuuuuuugcccuuugggacaaucugcuaccccaaacuguuuccucaaggaccugagcgcucuaugagaugcaaacauucugggagacaacugucacucucacucccagacccugugggaguuaaggcccaacuucgagugggcaccuugcucuaauaccauugccuccugucauaaagauagauugcuucuccucuggagaggcgucaauuaacaaacccacguggcuucaucacauagaccaaccccuuaacaccccucagugccagucccuggccucuaaaaagucuccagcuuuuuguuuuggugaaguugaguucaauucaugcuggacucacuucccuacugcaacuauuuauuaccgaaucaaaucucuccucagugcuuuaacuagugucuagcuuuguuuauccuugacacucugaaaaaaaguugauaauccccuaacugucaauauucuggaaguuagucucaauucugucaucuguaugucucugccuugucauagaacauuaaauuaaacccuaaguggcuuguguggauugguaucaguuggaaacuuagcugguggaguuucaugagcuuuagaugaggguaggaagggauaaggggcuugauagauuuucuauagguuuugugugcagcgcagccagcuagacuugagaugcaguggaugaugccccaacccagggacucuccaagggaagguuuuuuagggaauucggucuauaauccaauagucugauaucucuuauugagaaugucuuuguucuaaaguaacucagcuuugcuauaucucaggggagacuaggcuguuguuaccuuaacuacagauguaaagacuagaauagauggggaggagaccaagaaggagcuuuuccuacuauacuggaacaagcuauagcacaaaagaucugaaauagcuguaagaagaaaguacuaugcaguaagcagaacauaacauuuagaggauuaaaaacagaacacugguaaaggcauaguaugacaauaguuauaaaaagggaaggaaaguaggagagggggagggagaaggggagggaggggagggaggagagggagagaggaaggaaggaaggaaggaaggcaggaaggcagaaaggcaggaaggcaggcaggcaggcaggcaagaagacaggccaauuggccaacuucagacauaguauuaggucggcgcaauuacuuuugcaccaaccuauugcagggagugcugacaacaagguagagcucugggaaaucaaaaagugacagaaagccagcuagaaagacaaguaagcagcagagggaguccugucacuaaguggaugggacccauucacaggacauguugugaggaagcacugggucacuaggacccauucacaggacauguugugaggaagcacugggucacuagggaagucaccauaagcucagagauugacaccagauggauuuaccaggaaugggaugaaagaguggagugaucccacagcaagacauaaagagcccaguuaucaagaacaggguagugauacaacaguacacagugaccuaauaacgcugaggcccagaaaacuggauccaguuuaaaucuaugaacuuuacuaucagaugagucagaaaagcaaaggaagggcauaauuaauuauaggaaucaggccaggcucacaaacauagcaucugucaaguuuugaagucacuuaauucaaacaaagaucuuggaagggacaugccauuuugucauuuuguugugagcugauuaaaaaaaauuuuuuuugcuagguuauuuauuguuuugggugugguuuuuguagcuuucuuuuuuucuaauuauuuuuuacuguagagaaauacacauagcauaauauuuacuaucuuaauuauauuuaaguguagcauucagugguaucaaguacauucacauuguucuguuaccaucaccaccauucauauccagaacuuuuuucaucauauaaaacagaaacucuguacccauuaaacaguaauuccacauuccacacuccccacauccggggccccuggcaaccuccauucuuucugucuuuaagguuuugacuauucuagguaccucauacaaguaaaaucauacuguaucucucuuucugugacuggcucauuucacuuggcauaauggccugaggguccaucuauacaguagcauauguccgaacuuucuucuuuuuuaaagcugaaugacagucaauuguacauauacaccacacuuugcuuauuaauucaucugucaauggauauuuggguugcuucugcauuuuggcgauucugaauaacaugcuauaaaugugaguauauaaauauaucuucaagacccugcuuucaauucuuuuggauaaauuaccagaaguggaauugcuggaucacaggguaauuuuauguuuaacuuuuugaggaaaugccauacuauuuuccacaguggcuauuuauuuuuuaaugcauuuaagcuauuuuacuauuuuaacugauuucauuaguguuuugcuuauuuuuaucuacuuauuuuauuuaaaaguucaguuuuaaaaaucgugauuuacuuguuucaagugauaacaaggaacaaucaggauaaggauaauagacuugugauaagcccuugacugaagcugggguuaacucuacaaacaccuucacagcaccaaaacaaaucucccauacucauucugggucaucucuuggcuccuaggaaaaagacugacagcaucuugagaucaaauugcagcucugccuucuaccauuugaaggccaagcccccggcaaguuaucaggauuauagugcauucucaauuaauauagguuuugauuaauauuaaugauugcucucagccaaucagcagagacuaagacugaaauuucucucauaagugagugauauauucauccucaaagagagcucaauaaccuaacuaggauugugucauaucauuucgaagaauauuuaguccuuaauuauaaucuuaaaaugacaagaaaaaaguagcaauucauauuuuaaaauuauuucauuuaaaccccaugagugagguuaauaauaauggaaggauuauuaucuccauuucauagauuaagaaauugaugcuuagauggguaucuugccuaguuaauuagugacaaaaccugacucuaacccaggaacuucaauaaaugaaaucuauagucucuacauagauuuaaauucuagacaaucaaaaucuaguccuuaaacugucuaugaaguucuuauccagaaguauaauuauuucacuaagaaacuaggauuccucccacccuggccugcuugaaaguaaacuuuauuauuuauuauauuauacucucuccuauccuuuuaaauaaugucuuaaguuacauaaaaagagaagcaaauauacuuuaacaaucaaggagcaccugggauuucagagcuuccuucccacaaguggccuccauuacccuaagguagugccaacugcagaacauuagaguugguuaauucgugccccacacauacuguauuaguuuccuagggcugcgaaaacaaagcacuacaaacugggcggcuuccaagagaaauuuacucucucacaguuauggaggccaaaggucugaaaucaaggugucaucgggcuacauuuccuccaaagucucuggggaagaauucuuccuuauuuugucuaauuucuggugguuccagucauuccaugguuugaggcugcaucacuucaaccuuugccuuuauuuugccuauccacugcuuucaccucuucucugugugucucuucugugucuccuucauaaagauaccugucauuugauuuagagcccaccuggauaauccaggauaaucucaucuugagguccuuuaaauugcaucugcaaagauuccuuuuccaaguaggaugaaauucacagguucugagaaauggacacaucauucggagggggggcaggucaccauucaacccacuacaccacagaaaaacccaacacuaucacaagcccaugugaagcuguuaugaugcauaucacuuggcaauguucuaccauuuagucugaucucuuauuuaccacuuuacaauuuucccaugugaggggacuugaucugaccacgucaugaaccacaccugcucucaucaaagccugucuuuagaucuuuccucugauuauguccaggaauauacaauuucagcuacuuuugacuggacccuaacuaacugauuaucaccaugcucuguucuggacuguuuuuauggguucccugcugacuccacucaucaaccacaaauccaaaacauuucuuuuucaccauaaagaagcagucugcucugcgaaaaaugaccauacaucccauuuugcacaaaaccuugcugguuuaccugauuuuucagcauacuucaagcucaagauuauaugcacauccuaacucaggugccccucagcuucaaaccaaauaauaucagaagguuaccaacugaaaucauauuaccccaaacuccacaaaacaaauggauuguugcaguuucccuuaccuuuaguguauugacgaacaugcuucccaaugacuaaauuaucuucaccgggauauaauauaagggagaaucaaguauuaggcuuacucucuaauauccuucuaaggauuuaacaucaugugccucaaaaauagcugguccuaagaacacaacaagagccuguuguguuuacucggaauccucaguaaaauaauguugaaagaaagaauggcuguagugauuuaaguuaacaucuaagauuuggcuucugagcuauuggguauaugcaauaugaauucuuucaugaaccggaauaauaccuuuuccauuaacuacucugcuuauuuuuuuuauuuugcagaucucugccuaccaaccuagguguuguuuuguuguugguguuguuuuuacacuugaaagaaacuuagagauuucuacuuacuuuauucaaacaguaaaauuuuugcauaggaaguuuucagucuuaauaaauuucauuaaggucuauagaacacuggaaguauguagcuuuguggcaaaauucgaaacuugauuuucugcuggauauguugucuguaaaaauggacuuaauuuugaguguuaaaaucacuuauaaauaugaauuuaacaauuugaaaaaaugauuugcaaaaauaauccaauuauuugugauuguuuuuuacuugugggcuuuaaguucuguuuuuuuuuucuacagaccugaaccuuugcuuuuauuugagcauucuaaacucauuuagcuggaaaaccaaauuccccguggucccauuauguacguugcuaagcaaaccaucuagcagcaucuauaaacaggagguuuggaugugagccagucuuauaaguugagaguaggucagugcauuuuaaaccagcacaucauuaaugaagaaaggugucuugcugcuaaaccaguuuauauuuuuugggggcaaauauacacauuuauugaccuaugcuaaauugauuuugcuuuuuuaccccugccuuugaagcaccuuccauauugcuauauagauuuuacuuaacaaggacuucccuaauuugaaaaacagaucuaaagauaaucuuaaagcucuacuuguauacuuuucaagcaaagcuguauaauauacucuaucccuucccuacauucuuucuguaggaaauaauuugucaugaguaaauaaucuggccuuuaaaacugacacuaaauggaaagaugcuauggcuuuugaaaugcauauuagaucaucuguuaccaaauuaaauugguaucaguuugcaaggaguaccauaagaaaguacuacaaaccgggugccuuaaacaacaaaaauuuuugucucagucuggaggcccaaaaacaaggugucuucauguaauagugaaacagcaaaagaguuaugaauauuauaacuaacuccauuuuuguuaaggggcccuuacccgauuccuacacauaggcaaggauaauuuuagaacagugagguaauuugcaaaaacagcaaucauguaguuuuuaaaaguaacgcugagauuaaaggagaaguauguauacaacuauauauuuuguuaaagauuuauaggagcauugugaccugaccaaagaaaaagacauucccaaccuccuuggacccucccuggagcccagaugccugcagugcagucauuaguuaccucuugaucccaauucccaacucuuucuccuucccuucacuuaaaaauagccugaaauuuguacugacuuaagaugguacuucaggacguuaauccaaaauuuucucaguuggcugauucugaaaaaccugcuucucuucccaccaaaucucaucucucacauuugguuuuugagcagugaacaaccaaacuugaguuuggguuacauucaggguugguuucuucugaaacuagguuugguuacauucagcguucugagggagaacaugucccacgccucucucuugcuggugguuuccugacaaugacaaucuuugguguuccuuggcuugcaguaucguaacuccaaucuucccauagcauuugcccugugacucucucucuguguccagaguacccugcuuuauaagaacacagucauacuaaauuagagccaaccuuaaugaccucaucuucauuuggucaucugcaaagaccuuuccaauaaugucacauucacagguacugacaauuaggacuucauguuuuggggagacacaauucaacacauaacaaaauucauucaugaagaaaugucacagacuacacuggcacaccaguauuucuacauuucuaucagauccagugguucucuucuuuuauugucuccuuuuguuuguuguucauggugguauuugguuauuuaacuuccuauauuagauuuuaaaagcacccacguuaauccgguuucacaaaagauauguagauauaaaaaugauuuguaauagcacaucuauauugcugaugaaauacauucauaagcuguuuugucuauacauaugcauacauucaaguaacaguugaaacugcugaaacuaugucaguauauuuuggcacauauuaugaauugccauuuggaagaaaaaaacccaauauuaaaaaucuuuucuuauaaaagaauauaaggucucucucucguuagucuuguuaguauuauuuuuucuccccuaaggaaauccaacaauuauguugggaaaucaaggcaaccuucaaaccagggaaucuagauguacaggaaacaacagguagauuggcaaaaagauaaaggccaauuuaagagcagaauuaauuucuucugcagugacccuagaucaccacagaaggggcaaaaguccagaacaacuggcaguaacauaaaauccaaaaacacaguuguuugaaagauggcuguagccagaauaggagcccacaauacaauaguuuaggccaauacccuuaagaaauaaagccuguggcagucauuuccagaagaaauugauagcacuggaaguggacuuagagagguagagaaugugaccaaaagguuagcccuagaaaagauaauccuacaaaucgacacaucuccuagaaugucaaaauaaugaggucugaggguuccuaucaucucccuagcucccaguuuaccuaagguauacaucaucuguauguuuuccccauacuugaaaagauucuuuuuuaaauuuuuuaauuuuuauagauuuaggaggaucaucggcaguuuuguuauaagaauacugcauaguaguaaagccuaggcuuuuaguguacccauuaccccaacagugaacaacaguaccuaaaagguaauuuucaaccuuauucuccuugugcuuagaaagauucuuaaaacagaaauaugaggcuugagguaugugaucauaguauauaagaacacaguguuugugucuuauaaucagguuauaugaauaguucuaauugcucagaaggcaagagaaaacucugauuguguguuugauuguauuucauagguuuacuuuuaccucugagaaaucaguauaaaaauccaaaaucuguauaaguauaaagugaugaaggcaaucagcuuuucuucaugagcauucuuagagcccuuuucuaaaagaaaaaguaugcaugcaagauacacacacacacaaagacauacacagagaaagaggauauguggugcacaccauguggcauacauuuacauuuuaaauuaucaugaauuaaauuuucccaugaggccucaauauuguacuacauugaaauuauuagaaacucacuaggguagcauaaaaucaauguuuugaaucauugaccacaagggaaauaauauuugagccuccuaguuuuauuaauaucacaauaacuauuuaaauauuuacucuaaaagcccaaagagagagaaagaagcauuagggaacaaccuguauaauauaaaucauuuaaagcuuucucaccuccaugaucaaauuucuuuugccucaaaagaaaacauggcaaaaagaacauuuaugaaaaauguauuacauaaaguuggauacuuaaagauuauagucauaauguauacaguaaaagaauccggagggaaaaaagauuaauauccugaagaaaauuuaccaacauucuaaucagaccaggauuugcuuagaacacaucugagggugcuccuuagacaagaaggaaugugaagaauguuucuuuuaaauuauuacucugcugcuuaaaaaaaugcagguagcuuacacuaaaagcagauagaacuguaacuaucuacauauauguaauauaaguagauguauaauagguaaaaaaagauaaaauaaagaauuaaaaaugcaggggcuaaguaauaagaugugguuaggggugaagaaaggaauaacuugaaaaaagaaugaguggaauauuauggguuugaugaaauauagggcacaggcauuugguaauuuauucucugauuuaacagaaaacagcauuaaucucaaucaaaaaaguaguauaugcccagaagaauuucuucaauauugugaaucuauguauagucaagacuacauugugaagauaaauaaaucacauuugucaguugcuaaaccuguuugcuaaaugguauaaaauauaagggacuuucauaauauaaauaugcaguacagugcugguuccuaagcagacugcacucaacauugagugcuuucgagacauaagaaaggaaacuuaggagcuuuauuuauuacugauauuauauucauuauuaaauuuaaagacuggaacacucuaugauuucuucuuugcuuuuauuauuauuuuaauugauacauaauaauuauauacauucauggaguacaauguuacauuuucauacauguauacaacguguaaugaucaaacaggguauucagcuaucuaucaccucaaacauuuaccauuucuuuguguugagaacauucaaaaucugcuuuucuagcuauuuuaaaauauauaauacauugcugcuaauuauagucacccuaucgugcuagggaacacuagaacuuauuccuccuaucuagcuguacauuuaaauccauuaaccagccuuuggcuaucuccuucuuccccuuuccuuccccuccucaaguaaccacuauucuacucucuauuucuaugagaucaacuuuuaagcuuucccauaugagugagaacaggcaguguuuauccuucugugccugguuuaugucauuuaaccuaauguguugcaagcucauguggaguuuuauaugucauauuauaaaagcauuauuaaaaggcaaccuaccauuaaauuaauuaaaaucaacuugaaauuggcaaaauggcagagaacucaugguauaaugguggaaaaaccacugugccgauaaucuauguaauagaacuacuauuuucuguauggcaaagagagaacuguaaccugcugagggacugcuauugcaccacaugcuauagacaaaugaacaauacaugaagucaguaagaauuccagcaaagaauaacugagaguuuaggucauaaaaagccccaggagauucuaauuuccuagaaguagggcuuuuucucaaacauuaauauuacuacugaaguguugcagucauuggaagauuuuuaauaacuugaauuuucuuuuucaaaauuuaacauuauuagaugaugacaucuaaaaccucagacucucuuuagaugaaauaaaauuauuauucuauuuuucugauaaauuaauuuccuaaaaagugauuucuuuaaaaaaucauugcuaaaacaacuuucuaccugaaaaaaauuaauuaacaauacacaauuuuaaucaccugaaucacugaaucacuugugcacacuuggccucucacacccguucugugagcuacuuaguaaacuuucuaaagaugcugagaacguuaaguuagugucuacccaauaaaggagaaacacuguuaugagaguguaugaauuuuauacauugccugaaucuacugguuacaaccacagugguuuggaggcuauacacucguucuuuuucucaaguuugguaaacaguuaacuauaauuuguauguccagacucaaagaacaacagugaaugcauuucuggaguaacagugucauuuccaaucccuaguaaaacagcagauauaaucuuccuccugggguguuucuuauauuaucagaaaaacacacuagggcuaauaacaguccuguaaaugaaaacuaaucagucacaggacauauccagaaaauguagauaaaauaugaggaaagaagcuuaccaucauuguaacauuuaagaaaaucacaagcaaauaucugucguucacuguucuguucuaaaauuucaaacuguuguucuaaaaguaucuacagugaaguuaaauauauuaacaaugcuuacugaguuucucuuucaaaggauugucaacaucaacccuucucauaaaugugagccuccucaugggcaucuauuuguauggaauagcauacuucaauuuucacuaccugccccauaucauaaagaaaaauuauacacauacacauacucauauaagaauauuuuuuaaaaccgugggacccuggucucaguuucacuagaauaauacuacaaucaucagugaacuggcuauaaccacagagacuuuuacuauuucacaacugaacaacucuaaaaguuucaguccuuuaacauaguuaaucucaaugcauacuuacaaaugagacaggcaaggcagguaauacaaaucagaaagcugaggcagauagagguuuaauaacuuccuacagcuggcgagugucaaaaccuagucuucugacuccuaauucaaugcauauuaccauacauacacacaggcauauuuacacgccuucugccuagagccacagucuauauuuuuauuguauguuuuauauuuucagcuccuaccucacucaaugcaaaaaaaauauuaccgaauuucaagguucagagugguuacgggaaauauacagccuaaaucuucuggcccuuguuugcuuauucuuaaauuucaugauuacauucucccugcuucaaaaaauucuauuaccguaugaaaaacuauucaccagccuucuauugacucuaguaaaacaauuauugaaaaaaggaacagagucccauaaagcaugugcauggaaacaaauauaaucccuucuuggcacagaugcacaaacucaaauugcugagaaagaaucugaaagauauucugaaaucaauacuugugcaguaaauggucgaagaaaaacaugcaaggcagaagagauauacauauaacacucagcauuaaaagaauuccuuuaagugggcuagauuuuccaauaaagaauauaaagccaauaaaucaaacauaaauaagucccugauggaauacuaggcuuacaauaugcacuuaauaauuucuuaguaccauuaaaaaccuuuacauuuuaugaaagcacauacugaacucuauuaaacugaaaaugauuucuuuugaaauauaucagaaauuaaguggaaaaucagaaaaaacugcuguuuucagaguccucguugcauuauguauuccggcuuuaugcaagaagauuaggauuaauuacacagcauccuaauuacugucuuucuuccauuucugacucauuuagaaugugggcaagcagauggccaaggaaaaggucuuacaauaacaggcagcguuuuccccaucuuagcuuagccacauucaagaagaaaacacaaguaccuccaucauuccuaacuauaaacuauaagcucacugaaguucaaugagacugucuauucuuuuaauuucuaaguaauacaauauguacacuuuuuaguaauaauguaauaugggggguaggagagauauaaauacaguccauuguagguuuguuaugaagagaaaucuauguuuaugcaaaaauacauauuccauuagaaauaacaggauucacaagaucagaaauuauuucaagaaauauaaauuuuaucuacaauguggagguuuuuuuuuaaauaguagaagaaggaaaccaggccccuauuucucaccauguacaaaaaucaaaucaaaauggauuaaagacuuaaaucuaagaccucaaucuaugaaauuauuccaagaaaacauuggggaaacucuccaggacauaggaaugggcaaagauuucuagaguaauacccuacaauggcagaaaacccaugcaaaaauggacaaauggggucacaucaaguuagaagguuccugcacagcaaagaaaacaaucaacaaagugaacagacaucccacaggaugggagaaaauauuugcuaaguguccaccugagaagggauuaauaauaagaauauauaaggugaucaaaaauaggaaaaaauccaauaaucugauuaaaaaugggcaaaagaucugaauagauauuucucaaaagaagacauacaaauggcauacagguagaugaaaaggugcucaacaucacugaucaacagagaaaugcaaagcgaaacuacaaugagauaacaucucacuccaguucaaaugacuuuaucugaaagacagacaauaaugcuggcaaagaugugaagaaaaggaaacccuugugcacugcuggugggaauguaaauuaguaaugccacuauguagaacaguuugaaggcccaucauaaaacuaaaaauagaacuaccauaugauccagcacucccacacaagguauacacccaaaagaaauaaaaucaguauucaaagagguaucuaucugcacacccauguuuacugcaacauuauucacaauaaucaacauuuggaagcaaccuagauuucuaucaacagaagaaugaauaaagaaaaugugguacauauacacaauggaguacuauucgacuauaaagaugaauuagauccugucauuugcaaccacauggaugaaccuggaggucacuauguuaagugaaauaagccaggcaccaaaagacaaaucucauguuuucacuuauuuguggaagcuaaaaaaauuaaaacaaaugaacucauggagauagagagaagaaugaugguuaucagagacugggaaggguaauggaagcugugagugugaggaugguuaauggauacaaaaauauaguuuaauagaaugaauaaaaucuaguauuugauagcacaaaaggguaacuaccaucaacaauaauuaauuguacauuucaaaauaacuaaaagaguaaaaaucauuuaaacccauucgaaccauaaacaaaaaauaaauggugcacaguguggacucucuuauuaccuauagcuucucaaugaucuuccagguaugaaaugccauuuacuuaaucuaguuuauuuucuacauguaguauaagaaagaaaggaaaaucugugucccuuaauaccuuucuuucugcauaauucuuuucuuccugaauauacacuucauuggaugaauaccaguccucaaguuuaccaguaaauguugaugaaaaaaaagauagggaaaaugugaaaucuugaaaaaguacugcacaaaaauauucuuaacaaaauggucaaaaaaaguuuaaaaucagcacaacaaacacuugaguagauuagugaguuucacaaugcccugcuuuuauuuuuucauuuuuguuuuuauuuuugaagacugggucuugcucugucaucgaggcuagagugcaguggugcuaucgcaguucacugcaggcuugaccucccaggcucaagugauccuccuaccucauccuccuggguagcugagaccagagaugcauacuacaugccagcuaauuuuuuaaauuuuuucuguagagauggggucuugcuauguugcucaggauugucuggaacugcuggccucaaacaauccuucugccucaggcuccaaaaguguuaugauuacaggcauuagccauugugcccgggcuuccccacuuuugaaaaaucgauucccuuuccuuugaccuucucucuuauaaugauuaaacuuuguccuuuaaacaucuccaaauuuaaaaacuguaucaacuggaauaauagaauauaaaaucaaagaauagucagcuuugauauuuaccuacauguauagaucuuuuaguccaugaagcaacuagaaccauuguuauuaaggcccuagaagauaacacacaaguuuaauuuaccaagacaagccuuugcccuaaaauguucccuuagaguuggguacaugugacauuucuuuuauucacauauagaaacaucagauaugacaggaagaugggguuggcagcuuuaugucacaaagagugggaacagcuuacaagguacuuguugucagagggcaggaaguuaaauccuggcuuccacauucccugugugccuuuuccuggguauucauuuuuuguuuuauuauaaaaaugagauuaacuugauauuugaaaaaagaaaauaucaaauaccaugugcucaaauaugcuaauuacuuuucacauuacuauuucuuacuagcuaggggacauauacauacuuuuaagaaccagcaagcauuuuucuacugaaucacagaaccaaauacaggcguaccuuggagauauuacagauuuuguuauagaucaccacaauaaaauuaauacagcaauaaagcaagucauauaaauuuuuuguuuucccaguccuuauaaaaguuauguuuacacuauacuguacuuuauuaaauguguaauagcauuaugucuaacaaaguauauagcuuaauuuaaaaauacucuguugcuaaaaaaaugcuaacaaucaucugagcguucggccaguuguaauccuuuagcuacuagggggucuugccucuauguugauggcugcugacuaaucacggugauggaugcugaagguugggguagcuguaacaauuuucuuaagaaaaccauaaagucugcccuauuaauuaacucuuccuuucaugaaagauuuuuuugcagcacaugaugcuguuugauagcauuuuacccacaguagaacuuuugaaauugaagucaauccucucaaacccugucacugcuuuaucagcaaaguuuauuaaauauucuaaguccuuuguugucacuucagcaguguucacagcaacuucacuagaagauucuaucucaagaaaccacuuucuuugcuuauccauaaaaagcaacuccucgucuguuaaguuuuaucaugagauuguagcaauucaguuccaucuucaaguuucacuucuaauucuaguucucuugcuauuucuaccacaccuguaguuacucucuccacuuaugucuugaaccccucaaagucauccaugagcauuggaaucaaguucuuccaaauuccuguucauguugauauuuugaucuguucucaugcaucacaaauguucuuaauggcaucuagaauggugacucccuuccagguuuucaauuuacuuuucccagagccaucggcagaaucauuauuuaugauagcuagagccuuacaaaauguacuucuuaaauaauaagacuugaaagucaaaauuccucuuugauucauggucugcaaaauaaauguuguguuagcaggcaugaaaauaacauuaaucucuuuauacaucuccuucagagcucuuagaugaccaugugcauuuucaaugagcaguaauauuuugaaaaaaaaaauuuuaucugagaaguaggucucaacaauggguuuaaaauauuuaguaaaccaugcuauaaaccaagcuuguucaaccugcagcccacaggcugcaugcagcccaggacagcuuugaauauggccaacacaaauucauaaacuuucuuaaaacauuaugagauuuuuuugcaauuuuuuuuuuagccuaucagcuguugguaguguucguguuuguuauguguggcccaagaccauucuucuuuauccaguguggccuagggaaaccaaaagauuggacacuucugcuaugaagagaagugcugucauccagacucuguuguucccuuuacagagaacaaguagaacagauuuagcaucauucuuaagggcccuaggauuuuuggaaugggcaacgagcauuggcuucaacuuaaagucaucagcuacauucgcuccuaacaagagagugagccuguccuuugaugcuuugaagccagcauugacuucucucuagcuaucaaaguccuacacggcaucuucuuccaaaacaaggcuguuucaucuaucuugaaaaucaguuguuuagugaagccaccuucaucaauuauuuuagcuaaaucuucuggauaaauugcuguaacuucuaugucaauacuugcugcuuuaccuuacacuuuuauguuacgaaaacagcuuauuuccugaagcugucaggaaugaacuaacuuuugcuagcuuccaacuuuucuucugaaacuuccucaccucuuucgggcuucacagaauugaagagaguuagggcuuugcuguggauuaggauuuggcuuaagagaauguuggggcugguuugaucuauccagaacucccaaacuuucuccauaucagcaauaagacugcuuuaguuuguuagcauuuguguguucaccagaguagcacuuuuaauuuccuucaagaacuuauccuuugaauuuacaacuucacuaacugguacaagaggccuagcuuaugaacuaucucaauuuuuuacaugcuuuccucacuaaaauuaaucauuucuagauuuucacuuaaagugagagacucauaacucguucuuucucuuggacacuuagaggccauuguagggucauuaguuggccuaauuucaauauuguugugucucagcaaauaaggaggccugaggagaggaaaagagauccggaaccugccagucaguggaguagucagaaccacacauuugucaauucaacuugccaucuuacaugggugagguuuguggugcccugaaacaguuacaacaguaacagcaaagauuacuaaucacagaucacuacaacauauguaacaaaaaggaaaguuugaaacacugcaagaauuaccaaaaugugacacaaaaacaugaagugggcacaugcuguuggaaaacuggugaugacagacuuacucaaugcaggguugcuacaaaccuaaugcauaauacagugaagcacaauaaaaugacauaagccuacaauaaaauugugcugaaaugacuguacuuucuaauuacuuuucaugcauucacacguauauauugacaaagccuauuuuuaaaauucauuuuggcuguuuauggaauauguguuucauuuuauaaauugagaaaaaauuugacagacuguauauuagguuucuaugcuguuuccuggauacaaaaauaugauuccuuaaaguaaaucuagcaauauuaaaauaacauacauuacaguguuuacuugauucuauuggaacaaggaaaaugauauuaauuuuuauaaccaccgaauauuauaccauauuucuauacuuuuacuauaccauuauuacuauguuauuuuaccauuauuacauuauuaucacaauacauaggccuauuuaaauauaauuaggagucuacauuaccugauguucuuauuacuauauuguuuuuguugccacuaggcaacuugcacauauguuuaggagccacuuaauaugaaagauuuaacaucacugagccuaauuuccucugcugugugguuggcuggagaauaaauauagcaauaucuucaugugacuuucuaaaauaagaauggauaauauuuccccaaacacauaacaugaaacacgcuucuaaugaauaauccuauaucugcauuuuacuuaucacuauucugcuauuuucuuauuuguuuguuuaauagaauguaaguaauguccaugaauagggaucuucccugucuuguucauuauuaccauguucuaaauaaugucagaugaaucauaauuuaacaaauggguaaauccuguauuugagcacccagcuugauggagaagcucuggccccacauauauagcuacuaguuggaagcacagcaaugaauauaaacucaaaugaccaauaagaggaauaaaugaagguucucuugcccuaaaauacaaaaacuugaacuuuccaauuuuggaagcagauacuaagauaaaugugcagguuuuauauaaaccuaaacaaaugaccagcaucauuuaaucuaguuuuaugccacaaacaauaacaaaaaguugaccguaacuauuuucaacggcaugauaaaagcuaacacaauaauaaaguauacuaaggguuucuuaccauuguuuccacauuucugcuuacuucuuacggcuaaaauaaauagcuauaaauuuuguagcuagcucaucugucaguuuagauaugcucaaaccuugcuuacauauagaacaaguguugaauaaaauuauugggcuucaaaaguuuuaagaauaaacauuucaauauaugcagccauuucuuacuuuaauaaaaagaauuaagcauaaaaagaaauaaaaaacauaaaaagagguuuuaaaaugaucuuuccuaagugucagaagagggaauaaguccauggaauugauacauaaaaugaagacucuuacucuuuuucuuccuagugccauucuuaguauaaucaaaucuaucuaacuguccaucacuuuaacaucaucaggacucaauggcucaguaugcucaguggaacucuggaacaggauucccacuuacccggcuaauaauaaugcuaaugaaacuaaauccauagcuuguuuucuaguuucuauuaccuucagguauuuaccacuucuuugguccuaugaaaacuaagaagagcagaagcugucccaaggucucaaaagaauuugguuguagaggagccagguugccucagagcccaguccccgaaaacuccaugaugcauuccacucaaaagaauccucagaccuuggaaaucucaagaaagcacucagcuuggggucaagauagaguuucucaguuuauuuaucaacugaaaaugacaaaaaggaagacaauaagauugaaaaaugagaauuagaaaagagaguacaaaguacccaccgaaauuuuuuucaagugguauuaaaaaaauaaagaaagucaaucacguuucucagagaaaauaccucugagguggagguaagaaugugaugugaaaucuaagggagucaugauuucaagaaugaauuuaguugcaaauaagaaaaaaaucugauccuacagauauauggcacaauguaagcagagacacgcaaaagaaaacaagagaacucaggcuaguuucuaaauaguuuggguucucucaagugcuuauguaaauugaaauuuggaagacagcgauucacuaaucaaaucaacccuuaauuuguacuaucauuggaaugcuaaaucuuacagacauagacuggcaguuuucucuuaaauuggugccuugcuagauugcauaagcuuuuauauucaugaucauuuuuaaaguuuaaguauuauuuauauaaagugguuaagacauauuaacuauuuacaaauguaucuuaaauguuuauuuugugauugugucuaaaccaaaaaaugaagaaaggccauuauguucugcuuaaccccaugaugccugcaaacugaagaugugauauuucaaauaaguaaguaauaaugcauaaacauuguguuuuuaugaaaugcauguuaaaauuaugucgauaaaauaucucuaugcugaaacggaaguaaaccauuuugauguaugcuaauguaagccuuuauaagggauauuagucauauauucaacuguaguucugauuacaaaacaaaaauaugcuggaaauuccauaaagaucaaacuaauuaagguacuuaauugccucugacuaauuauggaaauuggcaagcucaguaaggaaacaagcuuuuuaaaagaguuuauauuuuaggccauagcuuucuuggcuucauuuuacugggagccacuuguaucauuucagaucuuacacugcaagcucuguccacagagaguuauaaagggaaaugacugcauauguauccagagcuuaacugggacaaggagaagcuacacucucagacuuacagucagaaguuggguuggcauuuuccuagaucacacauuguuucucauuagcagugugacuucucucauuuuguuguuguuguuguuaagucuuccacaaggcauauuuguaguucaucgagacccuuuaacucaaaggggcaaaaugccucaaucaagaaacuaugaaucccugugaaauaucugacauaaaacaaaagacaaauauuucaggcauaaaagaaagaacauacacucuggaauuuaacugauaacggcuuuuuaaaacccaguugugccaguuguuagguacauuuguaagaacuugggaaguuauuuaauuucucuuggucucauuuucugcauuuauaaaauggaaauaauaacaccuaguuugcacugucgucacaauaauagggacaauauaaguuauccagcucauuuauggaaauagaaaguauccauaaguaguaguuauuauauuuuauauucaaugaaauauaauuuuuucauacuaugguuuacuacuuuauuagagauauaugagcagcuaugaagaaucaaagaauacuccagggugcucuagagaaaaauuauaauuauaucauaagaaucaaagagaaauaggggggaaaauaauggaaaugagucaauaagcaaauguuauucuauauucuuuaaucuucaccuuaaaauauuuaaggugccaauuuccaucuaaaaugacacccugaaagguaucaucauuuacaaaaauuauguuguacagaaugaauuguguguaguauuccaaaguacauauauauugauaauuugaagucagugacaauuauauucaauuucuccauauucuauuaaacaaggaugcaauccauuuucucucucaagcauugaaaggaacuucccuugccuuuuucuucucuagagcuucuggucucacuacuacuuagagaucauuagaagcaguuguagcaaccaguacuacaaaagcaguucuucccaccccaccucaaaguuggucaaaaaacacuguggaaaggaaguuugcuauaaaugucacaagugcaacagaaaccugacuucuguuguuaccuacagcagaccccagacacugccacucagagguaaugccaccauucagaacuacccauagauguuuaaaaagugugugugugugugcauuuguguguucagaaggcauaaaaucugaauuuaggaguauucaaugcauagaaaccacuacgucacccaacccacccucaaauuacugcacaacaguauuuguaugaauuuuauguaauaaguuaguaaguauaaaaaaguuuugaauccaauaaauauccugcuaauaaagaugcucuccuucagucccuaucaaaagcaagaaaucucuuucgagauaguuacuguuuuguuuuguuauuaaaguaccuuuguugcugaucuguacaugaaugucaucacugaauggaagcaguccaagagacucauaucauucccacuagaaggagaagcuuugauaaaucucuaaagcuauggcagugguccagucccuaugccauauggcauuccaccugucccaagaaguuuuguuaauguccucuaaagcuccaaacaaaaauacugagacauaaacaaucaaaucuacucugugguuggauuuuucagcucuacgugguagcugcaaaaauuccucaugcuguguguguuaaugagacccuccauggacaccauuaauacauaaaagcaaucacccguaacucauaggccuuuuccuucuuacuaugucugaauauguucauugcauuuagaaacuggaaauaaaauauacccggagaaauuccagaugucaggaggcaugaggacugaaggucugaaaguguuggcaaaauaagcaaaucuacagguugugagcauauuaccucaaaggauaaaaagaaccuaacaauuaaccacaaaaauauauuauguaaacaaaaauuacugaagcugaaaacucacuuuaaccuacaaguauucuuguagauuagaacaguaacagaaaacuaaaauuuuuguaaccuaaugaaaagaauagcaaggagauuagagcaaacuaucugccagauccuuuugaauuacuguccaaccacuuuguucacuuaaaucuuuaucucaauggauauaagcauuuuagaugaaauaacaugagaaguauaaacagauaugaguaauuagcuugcuuagcuucuggacauguagggaaauaugcuuuauuuuaaauucuaugacuuggucaccaacagaaaucugauuuauuuucauaucacauucccauuguuuuacauaucuugaaauauuuuuuaccuucaacacuacacuacuuugaaacuaugauuguuuauaggcccaguguuauuagaucaucuuaauacauuuaaauauauuaugaagaaacaaauauauaauaacaucacaaauuuuaaaguauuuugcuaaaugaguucaguaaaacugguuuccucuuaaauaacauauauuuuauuuuaugcaucuaaaaauguauucugagaagaguuguauaggguauagcagauucccaccaaagguguccaugaugcaaagaaaggcuguaauuaaccuuuucuaaaggaaagacugcacagacagacagugacaccaauguauaugcugcgggcaugugauugucacaaauacaguuauagccaugggacuauucauguccuuaugucuacuuuggccuucauuguuccucuuuucugccuaauauaugccuaucauuccacucaauuuuuuuaagcaucuagaaccauaucuuucaauuuuuuuuuuuuagaaggaguuucacucuuguugcccaagcuggagugcaauggcacgaucucagcucacugcagccuccaccuccuggguucaaggguuccagcgauucuccugcuucagccuccugaguagcugggauuacaggcacgugccaccaagccuggcuaauuuuuuuguauuuuuaguagaaacgggguuucaccuuguuagccaggcuggucucaaacuccugaccucaggugauccgcccaccucagccucccagaguguugggauuacaggcaugagccaccgugcccagccucuuuccacuuuaaucaggcaugcugaugagguaaucaauuucaguauaaaaucuaagaaugagucuuacggccuaguucuuuaagaaccucuggaauucauguauaaaggacaggaugagacaaaggcaacaccaggaagaggccacauuuacuuuugaaaacuguuucccuacaauuuucuguaacuucccccucguccuugcuuuuuuuaaaaaaaaaaaguuuuaauaccuuuuugucuccccaguacaguauaaauuagucuacuuaguucugggaauagaauuaguaguaggcacuuuuucuccauaaaugaauacaccuuuacacagaggaaaagacugcaaacguauaaauaaaaucaaaguaaguauuaauguugucaaggacaacugcaaacauacaguguguguugcaaagcaguguaagagaaugggaguaagguggugguguucuaauagucugugggcagcaagaaaauuaggcccuucccuuucuggccaagcaggucuuaacccuuccaucagugggucucaaggaagcagagcaacugcauagacaagacauaaguucugccacccaaggagagggccaccaggcucucccuuuuaggaccaacuaaauauaaugcuggcacuuugaaagaguacccagauauucagggcaauaccacccaagcccaaguuacauaucuaaccuuuuaaaauauauagcuaaaagccaauugcacucuuauauuucaaacauaguauuguaacgagaauucaaaccacuauauuauaguuagugucuggccuuacucauaguauggagccuguuggaaaugagacagaauacuaugcuuagcacaaaguauguucuuauuaaauauuuauugaaggaaugaacguugucauuagaauuacauuucaaguaauaauaaucauuaugauggcaaacacugaaaaggagcuuaucagguggcagguauuguuuuaagugcuuuacaaauaccaacucaacuaauucucuagacaaagugcacacagguuauuuacagaggaaacugaagcacagagaccuugaaucaccugcccaaaucacuuauguauuaauuguagauuugggaaucaaauccaggcaaccuggcucuggaaucugaggccuuaaguacgucaaaauacugccaaguuagaguaagauuuacauccauauugaugcuauugcuuccaaaagggaaaauggauuuuuuguuuuuuaaaggagggcauggggauagagaaguccaaguugauuugggauaugucagagaaggagaagcuuuaguaggaaggguugggaacuuccuggcagagccccucuggagaggaaaaguagaugucagugcuuauagcuugccagucuaccgcuccugcucccuccacggcuugugacagucucugucacaguguggcuuaaguucucucuugcuuuuucaauaacagcuuaaauaaaggcuguaucccacauguuucaagucaauucauggugcuccugucuuaguacaggcugcgauuaacaaagugccauaaauuggguggcuuaugaacaacaggaauuuacuucucacaguuuuggaaggcugagaucagaaugucagcuuggucaaguucuggugagggcucucuuccaguuugcagacugaccucuucucauuguuucuucauauggcagaaagggggcaacagacuguucuggagucccuuuuauaagggcacuaaucucauauacgagggcuccauccuugugaccuaguuaccucccaaaggcuccaccuccuaauaccaucauauuuggaguuaagauuucaacauaugaauuuggggaguagacauucaguccauaagagcuuauuagacggcucugcucaucguaguuggaucuggcaguuuaaggaaguaauuuguuuuguccugggaggaguuaauuucuuguacuugcuagugaguggguagcuaguacagguaaacuguuaauuggcacuugcacacaauggaaggggacccagagaguggccacuugaaaaacuugguauuacugacacucuccaaaguagugucauuacucauauuagcuuauuauuuagcuauuaguccuacagaauaacaucuuuuucaauaggaagauuuccuaccuaauaugaucuuuuuaagccaagggaauuauuauaacuagcuaacuuccuggaagaucagaacuacagauauggcuaauaaaaaaguuccuccuguucaagcaccauuccaauagcaucagccagcuccauuacugcaccuacuaguaccguugagaaaaaucugcccucaagugcaaacuggaguaagugguagagaauggucuagaggcaccacagccaaacagugccacucagaagaaauaagauaauucauguauacuuuuuauuguggcuauucucuaaccagggcccuacagaauuccauucuuuaaaaccaguguuuucaauuaaaauaacaaaaucaauuagaggagacaaaagaggcagaaagaugugucucaaaagcagaaacuuugccuuuguggugucagaagccugagaggccuguguaucaaugauaacuauuaaaagacaucagugcuuucaugucacccaccuuuuuuaaugaaaaaaaaaaaaaaauacuacaagggccugccagaaaagaaauuagcuugacauuaaugaccagaagaacagcacuaauacuuaauaaauagggcaguuauuuucucuacagcuuuuucuuuaguguguuuacacucuacucauagauuauacucuaacuuuccuaucacagauaaccuaaguccugaaaaaaaaaauaaauaaauauugguccacauucuccuaaacucuacaaauacugaagaaacuauggcauucuucagcaaagaacuagggcaaagauaaggguaagagaauaaggaggauauuuuuaauacagaaaagcuucagaggauugucauucuucauagcuuuuaugaucuugaacugacuuagcuuaaggugcuuucucuaccuccaacccaccccaggcaugggaaauagagggcuuaggaguagaaagagaagacuuacuauaucuuuaagaggaaagauuccuuuccuagacuaaaugcuuauucagacaaacugcucucauaaauuagccuuaacauuucaaacucugugugacuauaauaagguuuuguuuauaagacaacucugaguguauuuggagaaagucccugaaauacagguugauaugauaauuucaguuguauuaucaguggaaauuaacauggccaguugacaguauauaaaaauaaauaaugaaacaaaaauugucugcagauauacauuuuacagcaucaucucauaccauuuuuuacacuaaauuaaaugucucaccaauagcuaaaaucacugaucacugagcuaguagguauaugcuuuaucauuuccuuuuauuucuagggcagcaugacgguuauuauuuuuaacuccucuaagcuuucuaacuacuugcucuauuuuucauucucaagguaaacaaugacaccuaagcaaaaacaagguuuucucugauucuacuaguccuucaggcuuuaguuaaaaaauaaaucuagcauuaccaacaugcuaaauguauauuacagagcuucuuccucuauuaucaaauauacuuuuagauuuguccgaagggaaaacuauuuuuauuuugcauaaaauauauguauauauaaaacacaaaaaauacaaaauuaagagaaauauuucacuccguuaugcaccaauagaacaauaggaacguaagguagagaaaagugguuaaaaauacuugcaagagugaaaguuggugucugccacacuuaggucgaaauccauuuacuacaauaugucacuaacaauaugugaccuugggcaggugacagucucuggagccuuaguuucuucaagcagucuggcauaaaaagccacacuuuucacugacauuacaugaguauauugcuuaucuauauaaaacaggauuaucaauauguauguacgaagguagguugguaagcagguauuuguguauaacaucaugugauauaaacaaauucuacaacaucuuaacuaggcaauuugaauagacaaaguuugcagcuggggaaggagagcuggugccacaaauuuaacagucaucuaaaugacaguauaugucaaacacccaauaaaaagccugacccauagcaaacaucaauaauacuucuuccuuuugcuuugagcgggcaaacggaauaggaaagaacugaccacugcaguggcagauaagaaggcaucaaagagauaguaagggugagaagcaacaaaagcauacugccugacucacaacuauuuccaaggccagccuggcuuacaagucuucauucuaauguaguuauaugaccuuuauuaauaucauuugcaguauauuauuuuguauuuugaaugauauucuuuuuuaaaaaaauauucuuugaacauuccucccccaaaaugcagguaagaaaacccaggcaaaagucuagauuaacuauuucauuuagccucacagagcaauuuaaauuccauuaaagcauguaaaaucuguuuguuacauuacagucacauucacuauaacagaauacuuccagaaagauaguuaaaaucuguaacaagguaaaaugcugcugcucaaauacacacacacacacacacacacacacacacacacacacacacaaaacuuauaugcuuuuacaucuaaacaaauugccuugacugggaaugacuuuuaauguacucuuccaggcaaauucccuaaaggcaaauacugauauauuccuuccuccugacauggaaguauuccuccugacaggucaguaguagcacaaacuggcuucuaagguaagaagauucuagcauuuuuuacucuuaaacaugucuugagaccaguuacugucuuuaggaaauaaagucaggccaaacagaaguugaucuacucugagcugaacaagaaaacauuuuuuuaaagggcacuucaaguuucacauucuuucuauacacaucccuccacccuaccuucccauccuaaucauccauugcugguuaaggauaaguccauuuauucuacaaaagaaagcuacuugguuccauuucuacagccaggaacuauguaguagacgcaggugagagagcuuguugacaagcaggagcaggaguaggagggagccacauggaaaucugugguuaucaggcagaaucuggcgaaagguaaugagagcaaacagaagucgcacuggcacagagcaaccuuaugguugacaccuuuacucaucagguaucacuuagaguuugggugaucaacuauguacccaaguggaagagagaauuuucucucagacucacccagaagccaucaaagacagaauauaacaauauauuuuuauaacccucaucagccuugaucagauuauuuuaugcccugaaaagauuaugagauuaugagagcucauauucccauauauuauuuaaugucaaggccaaauauuuaaaauaaaaauacuacaccaugauauaaguauaaggaacuccaauaaagucauuuguuuccuuugacuuuuaaaaauaucaugugucaauuaguuucaaaaaauuuuauuuuuauuuccugcuauucuaaagccccaaauuuguauuuagucugaaaacugagcaauccaaacggccagcaaucauaacuccuuuucuuuucgcuucuuccaacaaaacuuaguguguaaaauacuuaaucuuaauaaaauuaagugaauuuguuuauuuugaaagauagcaaucucaauuauaguugacaacagauacaaaucaguaagacauuuggaacacaccaauuaugaagugccuuguccauccagauggagccaagagaacagagcucaggagaaacccaaacaagagcucuggauuugggcaucacauggcagguuaaucaaagaaaggggaugauugcccaagagagugcaaaguacacaaagagaagaucaaaugcagaacuaaaacaaauagccacaauuuuaagcaggauaaaggcagaagacacaacuaagacuaaaaacaaauuacagaggcaagaagagagugguagcugaugagguaagggaggaguuuagaaaaaugauggcuaaucacauagauuguacagugaucaagccccugaggagaguuugaguugggcaauugggaaguccuuggcaaccugagacagcucuggaugaucccagcagaagccagacuucaguggacagagaauuacuaagagaugcauaaauggagauauugaguaaaagcaacuguucaaacaugggagaacagagagaaaggaaaagauugaggagagauuaaugugagggauuuccucuuuuguuuauuucucuuuugugaaguauguggagauguagccucuuugaggacuaaugggaagaaauuaaaauacaaaagaaagucgaugggugucugugcaagcucuugcaggaagcagggaauaacagaacaagggcguggcagaagguaugcucuugacaguggguuaagaugcuucuucuucccacucugagaaucagugaaguaagaauggauaaauagauaaacaaucuuaaaggcgcaauaaaaauaaaauugaggugauuuuugucugacggugauaaagugugguaaugauuuaaaaagaaagacccagaaacaauccuuaaaacagagucaaacauugagcauccaucuccaacgacuuuuaaagaaaauauaguucuuauuuucacucagguuuuauaacucccaagagugauuauuugggauuaaggagaaaagggaugcuaaauauaguccuccgaaugggaaauccucaauauccagagaugcugaccagagagaacagaggccaaucagaaagagccucuucauuuaagugggaaaaacuaaaagaucaauaggagaucuuccaguacauauuuuaauugauauaccuaauuaagauauuuuagcuggguuagcuaauaguauuuuuagcgauauaauuuauauuccuuuaauauuacuuauuuuaccuauuauuuacacauauuuugaccaggcuaugggucaacuucccauuauuuaaucuguguccuacucaucaauugaccuuacaucucaagacuauaucacauaugcauuuguaaaauauuacugauuucuuaaaauuucucugcucuuuuagaccaguccacuuuuaacucaguauuccagaggccaaacuacuuauaaagucacagcugucucuucgggauuuggcagugauaccauggccuggucauauggcacaaaguuucuacagcaccuuuacucaacuucugccuuggggcacagcccucugggaacacacaucugucuccuguaggacugugagccccugaagagcaagaaccagaucuuuucaggguucuaguucuucuguagcuaguaaaggaacuugucuauugugacuuuucaauaaacauuugaugaacugaguauucauccuacauuuaguacucuuuuaauaguggaguagauguuuacuuaauauucaaucuaccuaugacagucuaccauuuagucaugucaacacucauuuaucuugccuaaggagcagccucugagaaagauuccugagaucccagcagaauccaccccuccuuuguaccauuacaccuguuuauaacauuuguaauuuuguaccauaauuauuugcuucaaugcuuccucuccuucaauaacuaugagcuucaacaguguuaagaaccucaucuuauuuaucacaaaagccacuaccugccacaauccccaguccacaacaaguacucaauagauguugugaaugaauaguacauaugucuucacagucaaauauauauggagcugauaaaaacaauaaucaauauuuguuucuaaauaaaagauuaacaccuaaaacaguauugcuuuauaaaauuuccuuuauaaauuauuuucaccaagucugugagguaggcauuauaucuaaccuuauauuagaaaucacaaaauuacuuaccaagaccauaucuacuuagcucuacccaguaucaacuucuauaaucauaucuaacauguagacacuaaauuuccaguuuuuuugcaauguauauacuuaugcaaaaauauuacaaaacaauuuuacuuaucguuuucauagaugauuuuccauaagcagaaauguguuucagugaauuguuuuuaaaaaccaaacuauugaaaaauaacaauuaaaacugucaccauuuaguauauuuauuuaauauguuaggucuuaaugaaauaacaugcacuacauaaaacuuacauuguaaaguauaugaaagaggcaggaaguaauagauuuuuggcuuccauuuauauuuacauaaaauuacaaagauuuuaaguuuauuggauuauuaacauaauuucaauuuaaacuaauuuaaauuuaaaguaguaaggacaguagaaaccuaaaucccauuaauauuuuuggaagauuagaugagaggcuagaaacaaauuuuuuucaaaacuuaucuauucuguuucaacugauaccaauuucuaugaucucaauacaaacuggacggacauuaucagcugcuucuaaagacuaaguugaaaauauaaacuugcaaggaauaaaaaagagauagacuggaagaauauaggagguaacacuacuagaagucaaaguaaagugcaaaauuucaaucaugucucuuuaucaauugccacauuaucuuuuuauuguguagaaacuuuauuauaaaggauuuuuuauuuuuaaaagcaaauauguacauauauuuucauugaaagucuaauuacggacugagucugucuucaggaugcuuuauauaugugagcucauuuauuuccauugacuacccuaugaguuccuuuuuaugagugucgacgauucuaaaauccauguguuuuccagagcaugauaaauuuaacuuuuagaaauuaucagaaaaauaugaauagaaugcuagacuguguaaucaaauuuaauuuuuauuguuuauuuuauuuuauuucauuucauuucauuucauuucauuucauuuuugcucuaucauuucauuucauuuuauuuuauuuuugcucuaucaccaaggcgggacuucaccaacacaaucacggcucacugcacccucgaacuccugggcucaagugauucucccaccuuagccuccaagcagcuaguaccacaggugggguaugccaccacauccaccguuuuguuuuguuuuguuuuugauagagacaguaucucucuguguugcccagacuggucuugaacuacuuggaucaugcaauccucccacauuagccucccaaagugcugggauuauaggcauaaggggccacacccauaaauuuaauuuuuaaacuaagauuauuugggaccuuaggaaaaaucaugaaaaauaaucucuuggaauaaugugaaagauuauauuguucccuaaaaggaacaaaaugcuuuacggugcuagccuuuuauaccaugcuggccaugccagcuaaaguucagaucgggucaucauuuccagaaucaaacgauaaaaaucaaacuagaaaaaaaaauuauucaaugaagugacccauucaucacuaggaguguuaaacuagaacaaugugguauuuucucuaaagcaucuuacaaucauuguaaauuaggagauuaugaagucucauucaaaaagauuauggaggacacuaagagucuccuauacacuauuuucuaaauaaaagggacuuuuuaaaaaacuauuuaguuaauaaaagcaauacaugcucauugugagugugggagaaacaggaagaaacaaaauaaagcacuuucacgaaauaggaaaugaaaauaugagaauuuaaaugauuuaaauuuaaauaaucauuuuuccuagcuucuuuccccauaaauaaucauuguuaaugguuccuucaaaauuuuucacugcacguuuguuguuuauauauccauauagcuuuaaagaucuuuacguaaacgcucucauacuauuugcaguuuuacauuuuuguaacguaaaaauauaucuuaggcacgacucuuuaacagggcauacaaaauugacucacugguucucagagcugugcaguauuucgcugaauagguauaucaauuuauuuugcccuuacugaggcugacuugagcuacuuccaguuuuucguuuaugaaguuucccuaaacuuccacgaacucucuugaauccucuuauauucacaaagccaucaugaauuaaugcuauguuauuuuacaaaaucggaggcccagaaaauacugaaaagguugaggaaguaccaacucuuacaacgaucacauaagccaacaaauuccuuuaaaaaugaacaaaguauuggcugggcucgguggcucacgccuguaaucccagcacuuuggaaggccaaggugggcggaucacgaggucaggagauggauaccauccuggcuaacacaggugaaaccccgucucuacuaaaaauacaaaaaauuagccgggcgugguggcgggcgccuguagucccagcuacucgggaggcugaggcaggagaacggcgugaacccaggaggcggagcuugcagugagcugagaucacgccacggugcuccagccugggcaacagagcgagacuccaucucaaaacaaacagaagagaacaaaacaaaaaugaaccaaguauuuauaguaaaauaauucucaagguaauauagcuaauuauuugaugaagauaucuccauacgucuuuaaaaaggcaaucaaagauaaaauaaucauagaauugggcuucaacaaaccaaaguaccaucugucaucaguuaaggaaguaucagcuggaaggaugggaaaaacaacuauauuuuaaaacucagcagaacuacuauacaaugcgauagcuuucaguguguucacucaauacuauuacauucuaucaaaugacaaauccaucuaauucuaaagacuaaaauugcaguuuaaaauguuuaaaauaauuuugcuccuuugaaaauuacucuugaugcuaggcaauuacuuucaaauuaaaaguuccuucagacuuuagaauugucacacauuaguagggauuuaaagcaaagauauaccuuacaguaagcaacaauaacaaagaaggaggaaaaaacauugacuaaauauaauuuagaaaucaguagacagauaauauugcacagaagaaugaagaguacauagauaaucuaaaucuagggacaucuggguuuuaauuacacuuuuucaccaaggauuccaaagauggcauuuugaagccauguauucuuuuccuguccuccaggacacaagaaugcaauuacuaaugggaaaauaaagacagacuuucuuuuacucauuuugaaaaaagaaaaaaaugcucucucuagucugcauaaacuggcugaaguuuugaucugaugugacaauuccucuaaauauggcuccagaucugcccuuagaaucauauaauacugugaguaacaacacaggucagaacggcucucggucauauuccuggcucaacuacucaauagcagagugacuuuaagcaaguucugagucuuauuuuccuaacccguacaagcaguuauuauuacccuaugggcugcuguguggaucaacuuacauaaugaacucaaaguuccuacaacauggguguaccaggucacucugguuaaccacagcuccuugugaagcagugauucauacuuuccagcauguaucacaugcugcaaucaaacuggaauccauaacuauucccuaaacacgcccugauaauuucugcuuugauucaugcuacuucuacaaaugaugccuuuuuccaccauaacugccuaccaaaaucuuauccuucuuucaauacuuuugcaaaugcuacuuccuuuaugaagcauuuuucccaauucuccucuguuauuaggacucguucauucuggaacucuguucuuccaucauacuuauaucuggccuuagaguuauaaugcccuugucauaucuuucucuuucuuuagauucuaaguucccaaaaauaauguaaacuucuucaauauuuaccaaaaacuaccaauugaauugaauguuugaguggagaauauaugcauuuucagagauauauacaaacagguagagaucuggaaaacuguuucagcucccaauguccucccucaauauggacuaaauuccacugaacuugauagcuaugucagucacuacauuuucgaacugcauuuccuaguggggcuguuauaauuuguguccauuuuuuuuucauuaauuuacauguauuugugaaguagguuucaagaaagggauugaaauaaacacauuuuuauucugccaccauuuuacaaaaaaaccugccucauuuccgaauaaauaaauacagccuacauauaauguauauuaacucaaauauuucaauucucucauuuaaguaugcgaguauuucuauuuaaaguucuuugauucuaaaacuaagaguaacuggacaaccugucaguucccuguaauuuccuuuugcaccuucacacacugucagcaauacaaccacaguuaauuaaaauauguacguggaacauguaaaauagcaucaaauaugaaauauguaaaaguugaaaacacuaaaagaagccaaaacuaaaaaugauucuccuuaacacauuaaaaacaguacuaugucugaauagaaaaagaaaagccaaugguaaucacuaaaguuauucuccuguaacaauguuaaccuauauaauuugauuugaguaagaaguuuacagaauguuagucugauauaacaaaccaauuagaagaagcauaagcuuuaucuuucacuaucauucuguuuuuuggugaaggagcuuugagcaguaaauaauuuacuaucaaaagcagcaaacucugcuaaaguuaaaauuacaaucuuaugagugcaugugcauuagggaucauguuaaaaccaucaaccucauuucaguagaugucuuaucucacauaaaguaugcugcuagacauaaagcaucagugguuuaccucuaaaugauccagucccuccaggaaacuggguguaguuuuaauaaaauugaacucauaaguuuuuauuacauuuauaaugaaugcuuuucaguuuuauaggcucuuugaaggagcaauuuaguuucucuauuaaaacaugacuuuauauccuucacaacucucagguuucaauuuuauguugcuaccacucucaauauaaaugaagauauugaaguuuuaauaaagguauagaguuauuuuuauuguacauaugaaaugugaguuuacaaaauuacagggaaaaguacagcauauuaaaauuucuuucuauucuuacuuuucuguauccuuucugccacacaaaacuaaccaaaggugauauaacauauuuagguauuaauaaagcaggauucaugauauugucuuuucuuagaauaaagcauaaucuaaucuuucaaaaaugucuuauuagcacagucgaaaguguaauacuguuuaauuuaacuuguuggaucuuuaaucaaucucuuuauuacaucuaguggaacuauauaaaauuuucaaacauauuggcuuuauuuacaccaucaaaguuugcccaacaguagggauuauuacaaaugaacaacagaacauuuuguuuguauuuuguuugucuacuuucccaacuaaagaaccugguauauacuggguucuauuuuggaagcuuacauuuaaaaauugaggaagguauuauuucugcccgugaagaacucacuaucugcuggaaaaaaaagaaacagacacauauaccauuauaauacacuguuauauggcuguaauaaauaauagacauaauaaauaucuauauccauaauagauaauuuagagcaauaaugggaccacugaggaaaagcaaucaacucugcccuggcagagaaacaguucauggagauuucaccuagaacuugaggaauaaaaggaauuccacaaacagauaaaagacaaaaaggcauuacaaacaauaggaagaacccauuaacauaacugccaauaguauuuaguacuccugcaagaacuaauauugucauuguugcuuauuuuauucaauaacaauuugaacaaaauuauaguacuauagugaaaaaccaaagagcuuuuccuuguggaaaauucuuuuggaaaauucuuuuagauuaagucuucuauaaagacaaaaucagauccuacucauacaauccugauucccaucuuggcuuguuuggauguuuagaaacaauucuuaucuguucuaagaaacacauaugaaaaagcuuguaucaaacacauaugcuuggagggucugaagacaucuuuuaaacacaaacaauucauuaaauggaaaugcaaagcaugccuacauccuacuacuauauaaugaaaaucgauguguuaucaccaaccaacauuuaacguaucaaauccaaaaaaaaaaaaaacugcgucaauuucaggaauguaaucuuuauacaguuuuuugagaauuauaauauaacugcuauggucugaauguugguguccacccaaaauuccuauguugaaaccuaauccccacugcaauaguauuaagagguggagccucugggcacaguggcucacaccuguagucccaacacuuugggaggcugaggggggcagacugcuugagccuaggaguucaagaucagccugggcaaucuggugaaaacucaucucuaaaaaaaauacaaaaaauuugcuaggcaugguggcauguaccuauagucccagcuacucaguaagugaggugggaagaucgcuugagccugggagacagggguugcagugagcugagauugcgccacugcacuccagccuuggcaacagagcaagacccugucucaaaaaaaaaaaaaggaaaaaaaaagagagaugagguuucuaagagcugauuagguugugagggcuccgcccucaugaaugagauuagugcccuuauaaaagaggcuaaagagcuuguuugccccuuccaucaugugggaacacagcaagaaaacacuggcuauguggaauaagcccaaaccagaaacugaauauacuggcaucuugaucuuggacuucccagucuccagaacugugagaaauaaaguucuguuguuuuuaagcuacccagugcuuguuaaagcagcccaaauagauauuaaccaagccacaugcaaaacuagacauuaauuucaaagcccaucuuuugaaaaguagcuucuccauuugacuaaacagguuccuaguguuguaauaaauaacaucauuugacccaucauucaaagcguaauugucacuugagagacaauuaaaaguuaaaugaagaauuucuguuuccuuugauaucagguuauaaauuuccaugacacccacucuuggcagaaaaagucaguguaauuaaaauccauuaauggaacuuaaauuugucuggaaaaggaagcuguuaacuggagugcuggccccuaaguccaccaugcuaacaauucucugauaacaaguuucaagaaucaaaaauaacuguacucacgcacucauagcuuccugucauguagaauucauuguuauggaagugucuucuuucucccauggaggccuaucauuuaaacugaucuacuccaaauaaacccaacggggcaaagaugaguguccucacaguuaguuucacucgugaacccagccagcaauucaagugccuccacuuuguucuagguugcugcacucuaaugaucgacaguacagaggauauguagaauugacucuucacagagacuggcuaaaacagugcuaaaauauaacaucaaaggaaaauauuauccaagcaaaaaaggaguuuggggaaaugaacuacuucucuuuagaaaugagauaaagaaauaauaagcaacuuuacacuaugaacucuaucuaguugacccaauaaugauugauuaguagaguagaaacagagaugagugugaaggggauguuaggaauuuguagagaccuagccucuugaaauccauuuuggaaaaugauggacagaaacaaucaagcaaauaaagaaauccauaggugaccaccauauugagagaccaaguuuaauauagauggcuugaguauugaucucuugcccuaaacuauaaacauuaaugguuauggggaaguaaucuacccucuguaaauaggccauuggccauccaaaaaugagaagugacuauuacaaccucccaaacuaguacuaucuauucagacacagaugcaaguaaaaagaagaagggugauauucaaagggaugauaguucauuugagaugaauuaauucuugaaacaaaugcuaacauaaaaagaagucagucaccuuaauaggcaagacgguuuuuuuucuuuuaccauauucauucaauaaacauuuauugagggcauccuauauaccaggugcugaucuuggcacugggauacagcaaaaaacaaaacagauaccagucccuguucucauggaguuuuuauucuaaugaaggaaacaaacagaaaaaaaaaucaagaaaaauauauaguaugucagauggcaacaagcguuuugaagaaaaugaaggcaagauagauacagauuauuggggaagguguuacuuuaaauaaggcagucagaaaauauaaggcauagguuuuuaaaacaauaaaaaagaaauaauguuugggaaagaguagccuaggguaauauuacauuauuauacugguucuuuuuuuuuuuuuuuuucaauuaaaacugaaggaccaaagaaacccaaggaauuagauucaugaugcuacuuguucugcuucuaucaccaucaaacauuagguaaaauaauucuucuuugccuucaccuuguccauuuucuggaggaagggacauagguuugauacaacaaaucaaaaaaacaaaaaagauccucgggguauuuaugcaguauaauaaagagcaaagcaauguaauuccaaaaagauagcucucaaauauuugaaaaaaaaucacuaaauccuaaaacuucucuuggaaacaauuuccaugucucaagaccauuacauugguuacccuuguaagaauuuucuuaggaauaguuuaaaaugguuacuuugauaauacaaaagaucucacacuauagaacugcugaauggacucacaaaucacuuauacuuuuaaagucuaaccaucccaauguacacucagaaaggaaauaaaucugacauucaaaaaauauucuuuuaccuuuuauaguaucuacauuuuaaaauauuauucuaaaauaauaucauuccucuaguggaugugaaauuaucuuguucuguccaacaauguuucaacgacugagacaaauccugcugugauuaguuuugaaaauacuuucacaagcccacaucgcucacugaugcaaaugucucaugagaggcaucuaccuuuaaaaugcaauuugggaucugcuucuguuaaaaguaaauuacaauaugaacuacaagggcauaaaacaacaacaaaaaaaucucauuuuaguuuauaauaaaaccuagagcauaucaucaccucugcaagacaacauauaugaaaaaauaucugauuaaaauuuaauaugcuguacaguuuuccaagcauacuaaguauuaaauaaugccaguugaucuauauuauguguauuagcacauaagcauaaaguagcuauauaugauauuauaaugaucuaccagcucucuuuucccauaaaaauucuguacuauacuuugugauuuugaauaaaaauaaauuuuuaaaaaaauaaaacuucuuggcuaccaccuauauacuugagguacuuucacauuuaaauaacauguugaguacuuucauauaagaaaugauuuaaucuuuacaagagcuuauguuuugcuaucccccauuuaaagauaaagaagcuaagccuuagagaaguuaacugaccuacugaagaucacagaguaagugucuacaauucaaacugcuuuuauugauguagucauuacuuaaacauuguugggaguauauugggauguaaagugugacaauauaguaaucagaaugaauucuuuuucaucaauauaucaaacuucauacacuaucuuaguccauuccuccugcuauaacaaaauaucagacuggguaauuuauaaggaacagaaauuuacuucuuacaguucuggaggcugagaaguccaagaccaaggugccagcauucagugucuggugagggccuucuugcuguauccucacauugcaggaggggcaaaaaguacacaagggacaacacugugucuucacauggcagagguggaaagccaaaaacaaaacaaaacaggccuaagacccuccuuuccaccucuuuuauaaggucacuaaucccauucaugagagcucuagccuuaugacuuaaucacuuccuaaaggcuccaccucuuaauacuaucacauuggugauuaaguuucaacauaugaauucugggggacauauucagcccaucacauacaucaauaagugaagcccuucacaguguuuuuacuugguuuguuguguauuucuuucaaggaaauuaucacugcuacaguuguccaaagaacuucucuauggagauugucacagagccaauuuccuaacuccucaggaaaaucaguuccauugaacgucacaggaccuuauacagauuaaaggucucuugcuaaccaaauauauauuuuucucccuccuuccaacuuuaccucuuugaauuuuugaauucaagaauuaaauuuguaaacuauccauaucaguaaaaaaaaacauuaaauaaaaauuaauaauaacaaaaaauauaggagauuuacacacuuaaaaaaaagauuaaauuaugaacuauaggccaugccaucuugcucccauucugcucucucccaguugcugcucuagagcugagucuaauccuauacugaguuccacagaggagcccaugggaacaagcugaggcuguugaugaggggggccuuauuugauucauaucaggagucagacuagcuggggcgaguucauuugugaccugcuugcauuaagugccaauacauaauaacauagaagaaacuggcuggaagccuuuaugcaucaucuacaaguacaaucacuuuaaguagaggaccgccugcacagcuccaaacccaagugcacacaauuaaaacgugcuacaaaacacaguguuaaaucucuaaagacaucccaaugauaccaaaucuguuuuucuaauggcacacaagacugcuuuaaaacaccucaaacccuaucuuauucuuacacagcugugauuuuaaagaaucuauaaccuccuucagaucucacuauuaguaaagaccagagguuuuucauuacgucucccuuagaacacuagauagugcuugcuuuaacuuaagcuuauuuccucuccauccacccagaggaaacaaacaaaaacauguuucuuuuaauaucccuuuauaccaguaaguccccuuuagcuuuccagcacuaagauacauuaaguccagaauugcuaagcaauuuucaagccuuucaauuaguucccccaaaucagcaucucgaacuacauuucaagucuacauuuauaugcauuuugguguauagcgaccgaguaagugacugugcucuucagauuuuuuuuuaauucuuaguuuuuguggguacauaguagcuguacacauuuaugggguacaugagauauuuugauaaagacauacaauauacaauguaucaaaauaauaacauaaggauaaauggaauuaccucaagcauuuaucauuuauguuauaaacaauccaauuauacucuuucaguuauuuuaaauguacaguugaauuauuauuaacuacagucacucuauugugcuaucaacaaguagaucuuauucauucuuucuuaagauuuuuaaagugagaauauauacuuagaagcuuauuuucaucucccaagcaagagaacaauaaaaccaaacagaacaaaacuaauaacaaacaauaagccucaucaggggagaugauuuuccuuagguguuacucuuaggcuccagaugagcacacccagcauacauuucaaauaaguggauaaaaaaaagaccagaaauugccauuuaucacgcuucaacucuuucugaauaaaaaauaaguuuuacaaaaaacauuuuuaagauuuuuaaggaaauuuauucaaugauuuaaccuuggaagugucucuccuuuuggaauauauuguacaauagaaaauuuuccagagucuccauuuuaaaaucagcauuaagauacugcccugguuagaaauguacuuaaagcaucauuaucaauagaauauaccuuggaaaggauacagagugauagccaagcacuugacuuuuggaaauaggcugucuugguuaaguagcucagccacuaauaaucuuugugccucaguuuccucauagaaacuaaccuauuucauggggucaugagaagauuugagauuauagccauaaagcacuuacugcaauuccuagaauaauguaagagcucaauuaauguuagucauuauuaugcugacuucuaagaaacugcuuacucuuucauucccagacuucaaauacaucuuuaaaaauguaaaaaccaccaauuaauuccuagcaaagauagaggcuugcuuucuuucuuucuuuuucguuuuauuuuugguuuuuuuuuuuuuuuuuuuuuuugagacagaaucuugcucugucaucaggcuggagugcaguggcacaaucccucacugcaaccucagccuuccggguucaagcgauucuacugccucagccuccugaguagcugggacuacaggugcgcgccgccauguccagcuaauuuucauauuuuuaguagagacaagguuucaccauguuggccaggauagucucaaucuccugaucucgugaucugcccuccucagccucccaaagugcugggauuacaggcaugagccaccacacccagcucaaagauagagguuuucuauucuaaaauauuaauuuuacucuaccagccuuuuuguuugucuacaaaauuagcuuuucuuucuuuguuacaagagcuaccaauaguuaauccauccucgcuguacccuaucauuauauugcccaucauuucacacauuugucuuccuccuacugcucucaguucaaaagacccccuaccaaacaaacuauuauuagcuuccaggauuccacuuuuacuguuuuuucagucuucagucaggaccuaauggacucaaacagagucuacuauaccguuuauauauugcuuguauuacucagguuugguuuuaaaggcucauagcaaaauguucauuuugaccauauccaauauguugcuauuuuaacaacauucucucaggugcauaaucauucaaaaaagaacaacaaagugaaaauuucauugauacaauuauuuuauuuacuauuuguaauaggccaagaaaagggaacggugaaagcaagaagauuuuuacccauaacauacagagcuuacuguugauuagaauuccaaaaucaaagcaagcccuuaauuaauagacccuuuaaauuauuuuauuuuguggcugaauuaccacacugauacuuacucauuuaauuaugcccuggcccagagaacugacauuuuuacuggcagguuaugaaauguuuguuaaagcuaugaagucuaauuauaaaagccuucuuucagagguucacaaaggauggagaagaacuagaaaauuaucucccugguaccaaaggaagaguuauaaaacaaaugaaaacaaauagagugaaaucacaugaaugauacauguguagguaguuuagaguacacacggaugggaggcugggcauagaauacacagcagaaaaugcaaggauuggucuggugcaauccuuugggucuuuauagaaaaugcuaugauuuacuuuuuuuucuucaaugggguuggcugugacugaaguuucaugauugcuaauauguuaucauuacucaaauaauuagacuugggagcaauagauuuuuaaaauuagcuaucucaaagaaagugucauuauaaucaucuaauuauccuuugagguaacuuauguacacaugcuguaaacguucaauaucuuacucccaugggugcugccuccauguuuauaguuuaaaacugauagcauuauaagaaucugugaugacaacuuagagagcacaauuuguuuauuucuucagaaaucugaaaguaauguucagaaaguaagaacucacagccgagcacgguggcucacgccuguaaucccagcacuuugggaggcugaggcggguggaucacgaucacgaggucagcagaucaagaucauucuggcuaacacagugaaacucccucucuaauaaaaauauaaaaaauuagccacgcaugguggcacgcaccuguaguuucagcuacuugcgaggcugaggcaggagaaucgcuugaacccaggagacggagguugcagugagcugagaucaugccacugcacuccagccucggcgacagagcgagacuccuucucaaaaaaaaaaaaaaaaaaaaguaaaaacucacuaauuacggauuaaacucaaaaauuaauauguaguuucagcuaaggugguaaaacucauauuuacauuuaauuuauucacauaucaauacaguauuucucuagccuaaaugccaccaaacauuuagcuauauucaaucaacaagauugcuuagccagauaaauaauuaccaccuuuaucagaauaagaugcccuccuauaauaaucagccuguaggagcaaaugacuuuuucaaaaacauaauuguguuaaauaagucucuaaagagacugaucacucuagcaacaacacagaacaguauuugaacuauaaaauaacucuucuuuguuacucuuuauuacauauacaaguauaucaucaagaaacugcccagaaagaggugggcaggacacuuacaggugggccugaagguucgggucaguaaaagaaaaaugacucagauauucuugaucucuaggccucaucuugcccacuucuaggccuaccuaugcuauaugccuauuagcccuguuccaguucaugggagggaaguacaguacucuuccuguccccucagaguccaagcaagguguucuuugccgagagugaauaaucaaucucuucuccguguccucuccuuuuagcugagccuuugcuucagaguagcuccuuguaucuccuuuugguugaguaacuccuuuccaaauagcuccauuugguaggagacuuuguuuuuugcuuucuugacucucugcuucaccuuaauuaaaauuaccccagccucagcaauucccuaggaagagaccccugauaggaagauuaguagagaauuaauugauuaguuggcauauuugucuuaauaauuagaaaguucaucuuuuuuaaagaagaucacacauccaacauaauuauguggcuaucuuuauucaucagcuuaaaguuuucaagcuggguuuauuucacguguaaacuuacaauugcaaaaacuaacaaaauuccucaaaacuacucuugcuauuucuagguagaagucuuuucaacuaggcagauaggugccucauuauucuuagaaaacucuaaggacuaccugcacuuauuuuauaacccaauuaauguaucuucucacuaccauuggaaagaaauauuucucuuuucuuaugcuugauauauuuuuaaguaugauacauuuugaaguguguuuccuuuucuaguuuuacuaccugguuaauagaaaaaaaaauacuacaucugccuacacuuauauucuuaaucauaagacugcccugaagggaagguauucaaaaaaaacaaaaacugcucuuaauaccaugauauuaguauauugaaauaagaaccaugauuaagaaauauuaauauacaaagaguaaucuuuuucugagagugagaacuggaacaaaaugagaacaaaauuacucaaaaugagaaauaauacuugaacuugaaauucuuguguugugucccccagcaguguagauaaggauaaggccuuuggcuuuaccuggaccuacccuggauaaaaggggaaagagaaauaaaauaagaaauuuaauuuaagcaaaaauguucuucuucuuccuaaaaaauaauauauucagucaguugcucuaucuaccaagucauuuaauaaauauguauugagucaguauauaaaacuuugugaaaucccauaaaguacaagaagaaauacaagaaaacuauaaauacuucaaggaaauacuacagagaguacuacaagaguucagaagaaggaaaccacauaugauuagccugcauagaugugaaugccuuucagauaggccccaaaacauaaauuggauuuucaccaaaggaguuaacguggagggcauccugaauagcugggaggaaaugacucuaugcggaacuacaaaagcaaaguguggaaagaagaaagcaauggcuuauucagagaaagagagacgaaaaugaagaaaaaaaaggaaagacauaagaaagacacuuugaguuuaaagcaugccgcaauucaaugggaggaguaggaaauaggcuggaauccgaauugaaccaggucaaaacauuguugaauaucaaacccaaucuauuuaaucuguaagaaacaaggacccugagaaagauucugaccaaggguaugugaucggaaacuugacagauaaauguaguauacuuguaaagccauacugugaaaaacuuggggauuauuugaacacaaauuaucaccuggaaaaagacagaaaacaaggcagaagacugugcaaagagguuggaauauucaaaacuucagauuagaagacggaaauccuggccgggagcaguggcucacgccuguaaucccaacacuuugggaggccgaggcaggcagaucgagaccauccuggcuaacacggugaaaccccgucucuacuaaaaaaauaccaaaaaaauuagccgggcaucguggcaggcgccuguagucccagcuacuccggaggcugaggcaggagaauggcaugaacccaggaggcggagcuugcagugagccaaaaucgggccacugcacuccagccugggagacagagcaagacuccgucucaaaaacaaaaaaaagaagauugaaauccuguuuaauguugcucuucucuuucuauacuauaaacgaaacuaagguaaucauuaaaucauccuaagcauuuguauugccauuuugacagucuucaucuugaucuauuaaaccagaucucucugucucucucucugucucuaucucuaucucucucucucucucuuucucaacuuucugggggaauuauaaggaagagucagggaacccuaaucuggaagauuuauuuuauaaaauaauaguucauagauuuuccuuuaaagagcaaacaacuuuuuccuucaaagagcaaacaauaauuacggccggaugcagugccucacgccuguaauccaagcaguuuggaaagcagaggcagguggauugcuagaguccaggaguucaugaccagccuaggcaauguggcaaaagccugucucuacaaaaaacacacaaaaaauagccaggugugguggugcacaccuguggucccagauguucaggaggaugaagugacagaaucacuuaggccagggaggcggaggcugcagugagcugagaucacaccacugcacuccagccuaggcaacagagugggacccuguccacuaccacccaaaaaaaaggggggguggcaaacaauaauuauugccaccaucauaaaaauauaaauguuuucauauacauaauggaugaauaaaaugauguuaaaaacucaauuuaaaaaauaauuguuacacacaguggggucugguugaaaaagaagagcaauucuaaagguaaaggauaauaacauguuagauuuguggauuccauggggcuucugcuauuuaugucugcccacugcauuucccaucuccugcucuguccuuguguggacuaccggucucauuccaugugcucugguagaguucucaauccucaugacggcagcccaucuagagcagaggcugccaugacaccagcuucaguggaggauguguuuccaggacugcgcucuccacagagcuggcaggagcuggaagcagccagaagccccgcccuuccaggcacagcugcagccacccaaguggcggcuccaaacccaggcauuucuacacucuuggaggccaggaaaggcccccugucucugcaggcucagaggugccugcugucacugccucgccucuccuugcucccugcacuugcuccgaucuuggaguggaguugaggccuagcccgggugcugucacaaucaggcugagugugcacacaauaagggcagcacugacauaccagcacccugcugccucagcccccuccaggcuuugggugccaaugagcaugggagggaggcugaguggggccugaaggcagcuuggugcuggccugcaggcaccccacagcacaaacagccugggugccaugaacuguggcaggaggcagacgcgcuccugaguggaagggggugggucccuagcaaggccccaccuucaagcuggggagggccugaagcccuccaggggccaggcugcuggucgugcaaaccagaaugggaacuugugguaccuuccagcccugccuauggccacccuuggacaaacuggugcacacuuccuccccucugaggcccacaagaaccccagacucacccagacucaagaaaucgauggaaccacuagcuguagggaggaguuacccauuccaggcucuccucucugcugagagcuaaagagaugacaguaugaccaguuguggagaggagcuacccacaccagagucuccuaucuaaugagcgcugaacauuugaaggaaugaccugccugcggagagcuauccaacgugggucuccucggagcuguucuguugcucaauaaaguuccucuuugccuuguucaugugacaguccuacaaauguacccccuguaucuaagauaaaaggugauuuaaaaaaauaagacccaagucacaugaauagugaagagcuauaaguauucauacauuucuaauguaaaauauaugaugguuaacuuugguaaacuugaggguagaaauauauuuuuaauacacaauaaaucaauuaaauaggcagguaaugauuuuaucuugaaaaaaauuauaaaacuucaucaucuguucccuuuuacuauccagucccuuccaaggguaucuucucuugcuuauuuagaaaaucugugugaaacacucaaaacaaauuucauguuuauaucuuacuaaaauuagagaaauaaaaucaaucacuuugaguccuucuaugcuuuaauuaaauguauccucuuagcaaauuuguuuuuaauccagugaaugaaugacaaaguaauuuuucuucuuuuuuuuuuuuuuuuuuuuuuuuuuugagacagggucucucacucugucacccaggcuggagugcaguggcaugaucucugcucacuacaaccuccgccuccuggguucaagugauucuccugccucggccucccuaguagcuggaauuacaggcaccugccaccaaaucuguuuuuuuuuuuuuuuuuuuuuuuaauguaguagagacaggguuucaacacguuggccaggcuggucucaaacuucugaccucaggugauccaccugccucagccucccaaagugcagggauuacaggugugagccaccaugccuggccaauuuuuuuucaaauuuauguuaaaucucaccuaaauaaaauauaugauauuaagaauguucagcaucuuguucaacauuuaaacaaacucuaguacauacuguguagauuauccagagcuccauaaccauguaaaaaaaaaaaagagagagagauagagauuaaaguagaacauucaaaauacagccacaggccagaucuggcucaaagacuuguuuuguuugacacauaccagcgcagcaaaauuguuuucugaugaaaugcuuacauguauaaaugaaaaacuucacagaaaaacuccaaacuuaagucuccuccuuagaaagaaaaacaaaaaucaaaaaccaguucuugcaaaacuaugcccucauucccacauaucaccgcaaucuacauacuuuaaacugugaauucagauaccaguuugccauaguacccaucacuccuuauauuuaccauugguuaaaagugucaaugguugcaaccacacagagacauuauauauguacaagaaaaaaacaaaaacaaaaauagaaguacucuuuccuaagcacuguaaguacuuuccagaucaucuacaugagccauucuauucauuggugagccucccaugcauacuuaugaucauacccuucugccugaagaagugucuuacucagaaucaaaaaguugcuaaguaacaguauuacacucgaaucugaaucugacccaaaauccaauguuuuuccagcuucugcacaguuaauacagcuagcaaauaaguaacaauuauuuuucccaaacaagaaucaugaagauauucuagccuauuugaauauagcuacuuuuauauuacaagaucaaauuuacuacacauaacaggcaaaacauggaaggcacccauuuagucuaauuucaaaaaagauauacauucucuccuuccugaauuuugucuuauuucuuucaauaauaaaagaaagguuagauacaaaaaguaucagaucacccacaaauaggcacuuaaaaaagaaaaguaugucaaucauuggguaagcuuuagaaggaaacuguggcaaaacauuaauuuucuccucuuucagaaacuucuuugcucaaauucuacuuucauucuuucuaauauaaaccugaggcuggcucuuacacaaaacuguugaagucauucuuuuguuccuucuucauuucucaucuguaaaugugcucaucaacuugucaaccaggcuguuagaauuuguauuuaaucuucacauucccucucagcuaaaauuuucucccauucuuuaaucauuuccuaucuugauuacuauaauuucucuuuuauuguccucuugaaauucauacuuguuaagucauguauggccagaauauauacuaaaauaacauuuccuuccaacugucuuucucuucacaaauacaucuucauucucucuuggaaaauuccaauuugccuuuggaucauuccagauaccucaccguaauuaucuucucugucacuagaguauggagucacauacaucaccaauuuugucaucucacuuuccuuugaggaggucccaaguagauauucauugagauagucucuucucaagagcacuguuuuaaaauguucccugucaagcuggauagcaagaaacagaugaaggauuaacuauaucaguauuuuauuucuuuccuagaaaaagagggaauaguucaagauacauuccacaucuuaaacuugcuuugaauuuuaguuuuggaauauauuuuuaucacaaauugucaauuuaugacugcauaaauuuauggcguacaaagugauguuaugauuuaugaauacaauguagaauaauaaagucaagcuuguuaacacauccaucaccucaaauauuuccauuguuuuguggagagaacaucugaaauuuauucucuuagcaauuuuaaaauguacaguacucuauuauuaauuauauucaccacacugugcaauagaacuaaaaagaaauaccauauuccuccugucuaccugaauuuuguacccuuaaaguggaauuuucaaauaaaugguuucucagauucuaacauuuuuggcaaaagaugagacauccaauuauaucauaugaggcacuaacaaaugcaaauagacuacccauauaaucaaaagaauaacauuuaaggcaauaagcccuucaacuucagaaggcuuggcuuuaugacuauauucagucaaucacauaaccauuuugaagucuugcaguggauaaaauaacaccuuugaagggugggggaaaagaaaaagagacauuuuaucaaaugcaugcaagugauuuugcccauauaaauacuugaaauaaaacccuaaauggcacauuuuaauuuucccuuuggaauuuucuggaaaaaaaauugccaguguaaauucuuaucaaagacauuccucaucuucugaucucucucucucucccuccgucucucucucucucucucucucucucucucacacacacacacacacacacacacacacacacaauaugcaguggaguuaaaauguuccugguuaggaauauuuuucucuguucugcaaucuguaguaauucuuuaucuuaaagcuagcucuccuuuugguguuagaaugguggccaggagccuagcagaauagaaggagaaucaauucaagaaacucucccagugagaauaaaggaagaccuguccagggaggcaccagcacuacuccuaauaucaguccgcuuaaguggguaccugacccuuuucacaugaaacaagaagugguaagaaagaugguguucaccuuagacuaauaaagcccacucauggagcuuggauuagggucagcuucuccugaagcauuuagccuacagcagagcagaguagcuacaugaagaaacuaggauauacuguaagcaaaggaauaaagggauaucaaugcugaguacagcuaauaacguccguugagucagaaagagaauugugacagaauuauccaaucuccuuuacuuuaucuuuuauaaacaauaacaaaacuaguauauuuuauauucugauuagaagcaaauuacaauaguuucagguaauccuuuaccucaaaauuaugauacuaaacaauaaucaauaugaaugaaauucuaauacaaggaagaaaaacugccugacaugaaauaacuaucaaucaucuucccuauauauucuagaaaucuuauuuuuaauauaaaaauuaaguuuaguauuuuuggcaagauuagaucucuacuaugaauugaaagucuucgguaucucucuggagguggguguuagaaucaacaggagcaguauuuucauguucuucacuuuucuuuucaaaauaaugagcuacggaaaaugcuauugccuuuuugugcuuucauaagaaguaaaaaucaaaggauucuaugauggacagaaaauuugaauccuaaggaaaauaauaaaaucuucucucuuuauucacucuuucccuauauaugaauuguuuagcuuagcauuuauggucuuaguaaacaaauagcaaaauauaaacaagugucccaaguaucugcucuguucugaaguuuucuuaugcaagacaucaccagaccugguaaaccaagguuuuacaagucuuaccaauuucugugcacuuccuuuuaaacuuuucaauucuuauaaaugucauauuucuuaugaaaauuaaugucuuccuccugaaagagcugcaaauaaagaaugcauguaccuaugcuauuauguuguaucgccuacauuuaauaaaacacaaguggaaacuuucaccauauuuucaaaaguuuuaucaguuuuuuuuuucccauuacaauguuaaagagaaaugcaccaauaaaccccaggcaacguaaauaaaacguuccccauaugaucuuaaaagaaaucacagaaauauccaaggcuauacacucagcuagaucuaaaauauuuucguuaaccuaaagacaguugugaaagucucgagaugggagaacuccaauuaaccuaguucauuaccaauaaggcuuuaauucagucagguacuaaaauaguuguuuuuucugauuaauuauuucaggcugaccaguuauaggccagggcuacguacaucaaugucacucacuugguuagaaaugacaucaguggaaauuacuuuccccaugaacaguucugauaucugagccccugacuacagccaguuauuacaaaaguauaauaaaucuugaaaaucaagggccugccucuucuaauacaaaauaauaaauacuuuucuuaaaaucccagaguucugcuuaaaauaugaaauaacaaauacauccacaacuuagaauaucuauacaagaucaaaauucaucuauguugagccacuaaaacuugugaaggagugaaaacagggcaugaaauagagguauuaagcuagaaagaaaaagacuacguggcuaacaaaaucaacuauugauguauguuauacuauuuggguuuagcuguuuagcuguuaaccaucacaaguuauuuuuacauggaaauuucuaacuuacucuacuuugaaaugccaaauuacuaaaaaauuuuaaaagccucuuuuugaaaucuagaauaaugacccaaauacaguaaagucauaacuuuuuuucuuuguuugaggcacuauuucuaaaaguguaauccuaagaccaccugugaugaucaauaugcugauguucagacuguucccaagaccuaauaaaccagaaucucuggaaauaaggccuaggacccuaaauuuuaaacaaauaaugcagguauuaauauuucugcauugguuugagcuauuguauuugccaguggauaaauuuuaaguaaacagggcuagcuaaacauaaaaauuagcucuaaugauaucauaaaauuaauucacauauuauucaaauuaagugagucucuauuuuugcuuacauauuuuauuaugauuucuuaggaugcauuaucuuaugaaauaaugaaaucacaucuaauuuaauauggcugucuuuuugccuuagcugucaguauucuaugaucucaaaucacuguuugguugaaucaaauucaacugcaauaauuaaacaguaccacuaauuuuuuuggucuauaaaacaagaaauuaaucauguuuuuuuaccuuuguuaaccuguuucuauuguguuuaaucugaaaagcuuuuucaauaaauuaauggaaguaaaugagguauccauaagcaagaaagugaucuuagaguagugauagaaugauucaagcaaugggaauauuauuuuaacuucuuuuaucagaagccaauaaguagcuaguggaaaaagaaauuucacaaaauaaauuuggaaccuaauucucagacuacgaauuuaugcucacacuauuucuccaagcuccacuauagaauuaugucacuuaucuacuagguuagugcaaaaguaauugcaauguuugccauuugaaaccuaauauuacauuuuuccagguacuguuaaagaacaaaccacuuaccacacccuauucccaccauauuaaaacagcauaggcucacaaaggaaaaaaaugaaaucaguuucaaagucagagcugagcuucuacuuauaauuccuuuacauguauuauaaaguaaaauauuuuauagguauuauacgauauaaaagaugaagaauaaaacauuguuugguuaccagacaaaaaaauaaauccuauaaagcaaguucagauuuuaaaacaaaucagaugguguuucugaauauguaaaauaaauuucuuuaaaagauuuggaggcauaaaagcuagauuuaauugcagauuuaaaagaugguuuaauaucagaaaauuuauuauauuaaaugcaagaaaaauaauuguuaaauuaaauauucauuugagauaaaaaguuuucuguauuacucaggcuucuccagagaaacaugauggauggauggauggauggauggauggauggauggauggauggauacagagggagagagagagaagacagacagagacugauagauauacacacacauauauuuacuguaagguauaggcucaagugaucauggaaguaaagucccauaauuuuccaacugaaagcuggagccucaggaaagacagugauguagucugaagaccugagaaccagagagccaaugguauagauuccaguaugagucugaaggccugagaaccaggggaaccgagggcaagagaugagugcuacaguucaacgguuaggcagagaaugaacucagcuuuccuccaucuuuuuguucuauucaggcccucaauagauuggaugauguccacccacauuggaaagggccauuugcuuacugaguucaccauuuuaaacgcuaaucucuucgagaaacaccuucacagaaacaaccuaaaauaauguuuaaccagauaucugagcauccuguugccuagucaaguugacacauaaaauuaaccaccacaccuucacaaacaaggaguaaaggaagcaucucuacccaaauacagaguaauguagaguaucucuuaagagcuuacagcauauaucacaaacuaaaauuuuagucacauuaccauuaacauaaaaacaaaaagauauauaucuauuccgcugcuucucucauacugcucuagagauaauagucaauaucacaagacuacuugaaaaauuuuaaaaauauguauuagaaagcauuacccauaucuguacguuaugacugccaaaauagaaaauuuuaauggauucuguagcaaauuauuagaagauuucaaaaguagcuuguuuuaagacuagcaaacaaaaacuacagacuuccuauagacaaguaacaagcauuucaauacugaaacagagagagagagagcaagagagagagagauaacgugagccuauacacacuagcaacaauaaaaacauacgguacacaggggaaaauguguauaaucacauuacggggaaaauuauaaaaccuuagcucuauguaaugaaaaguaauuccauguucacaugugggaaaaaaauauaaauacagcaaauuuguggcaauuaauagaucaauuugaagucauuccauagaguuuuucauagaaguugauaguguaaucuugaaauucauauauaaggccaaagagccaagaauaacaaugauaacuaugaaaagauaguacaagguagaaaaacgucuccugccagauacugaaacuaucauuauuagaauagcauagcauuaggccaaagacacgcagcuagacuaaaacgacagaacaaagagcagagaaacagauccaugccagcauggacaugaaauaucaaagagauggcaucacagucagcagggggaugaugggggaaaaguaaaucccuacccaagacuaauuacaaaguaaauggggauuuacuuuuuucuugucuucccccaccgauguauaaugccaccacuaauuccugauuauaaugccaccucaauuucugacagguaagaccuaacugugaaaagcaagauguguagauauauuagagguauaaugccgccucuaauuccugaucuguaauccuaccucaauuccugauugauuagaccuaaugugaaaaguaaaauauagaaaaauauaucuuuauaacacaagaguaagaaaauuccuaaacaagaaaaauaccuaugccuaacaaaacaaaaaaacucugccacauagaaauuaaaauuuuuguacaaaaaaaacacaugagcaaaauuaagauaagccacagacgagauauuuucaagacuuaugacaaacagaugauuauuauccagaauauaaaaggacaccuacacaucaacaguauuuuuuuuuuaaagcuuaaugaccaaaaagaaaaaugaguaggauagaaacaaacauuucacagagggaaaauagucaauaugcauaugaaaagauguucagccucaguaguaaucagggagaugugcaauaaaacuucaaggagaugauauuuggauauauuaaaauuuacaaucgaacaauaccaaguuuuaugaggugagcugaaaaugaaacauucuuauauaagaacgucagugaguaaggaauguauaaguguauaaaauagcaaaacuacuuuugaaaauaagcugacaauauuuaguaaauuaaagaaauguauaccaaagaccuggcaauuccacuucuaguuauaugcccuaaaaaaucuguuguccauguggauagggaaguauacauaacaauguccugauaucgguacauauagcaagaauugaaaagaaccuacacagccaucaauaguacaacagauacaugaauuauggcauacucacuaaaaaauacuacacauuguauaccuacaucagaguuacauauauaaauaugaaugaucucaaaagcaacauugaagaaaaaaacuguugcaaaaugacauagaaugauaccaaauuuuauacacuauuaaaacaugaaaaacacuauauauauuuaucaauacaaauauauguaucaaaauauaaaaauaugcauuauggaaaaaugaucaguaaauucagaaugauaauuaacucuugguagugauggacacagccucacgacaagguauacaguaaguuuuaauuauuuuuguaauauuuuuucuuuaagaaaggcagagcuagaaaaauguuaaaauacgauaaaacuggaugcugcaaacauggauauauguuauuauucucuaucauuugcaguguuuuaaaaauauuuucuaacaaauuaagaaaaauuauuuuuuaaagucuaauuaagcacaaugaacucuaggaaguguucaauccucuuggccagaaaggaauaccacaaagaaauaaaauaauguuuaauuaauuguuauaauaugcaaccaucuuugcuauuguaaacucuucaaaacccuuuuucauuaauucacaccacguaugucagccuuuuguauuacuaauccuagcauaugauuauagauuagucagucuacuuuguaacaugcuuaauuacccagcaaaucuccauucucuguauuguuuugccuuauauuggcuauaggguauauuuaacuguuuccugcaguucuucuugcagcugaaaauuucauaccuggguuggcugauauuuauuaaguuuaaaagaaaguaaccuucaugguuacaacagaauugugagcaguaucaggccuucgcugagaccauagcuccuauguguagcuuccauuucuucaguuacacaauauuuuuaucuaagucaacagccugugcaggcaucuuaugauaugaaaugauaagagaaaccagcuacauagacuagggaaaaaauauggaaugccuuuuaaauuguuacaagaaaagaaagaacacuauacacaagaggaaacugaauauagaaaacagagcaucucaauucuguucugccacucacuguguggccuuagaccuuaggcaacccacuucccccucucucaaccuggguuuacucguggagauaaugacacugcccugcaaaucucacaggacuggugugauggccaaaagagaugaugcaugaggaagugcuuugugaacugaaaugcauuucagaaccacaagugagaaugucauuauucugacccuuucagaacuaaagaguauacugguaaaaugaauauacuaaaauucuuugaaacaaauagauuaaggaaaauuaacuuaauggccucagcaaaugaugguuuguacaugugugagucuaucugucacaggaaaauuuccaugaaaauauaaacaccugcuaaugacauuuuagagaggaacccuguuaaaaguagaaguaucuaaggaaguugaagaaagguguuuuaaauaccaucuuccaaaauuacucaaguaguaaacuaaaugaugauugcaauuugugugcaaagacuaagguagauacuuggugacagagggugacaagaugcagaauacuguguguugcuguuuucuuuaaagcaguggcucuuaaagugaacucaauggacuccugagauccaugagaaccuuucaggaguucaugagggcaaaauuauuuucauaaugauauuaaaauguuauuuacccuuuuugauauguuaauauuuucacagaugauaugaaagcacuggugggagaacugcuagcagcuuagcauaaaucaaagccuuggcaccaaacuuuacugagucauuguacucuucacugccaugcacugucauuaaagcaagcaaagucuguuuuauuuaagaaugucuucgaugaaggaguaaaaaucuuaguuccauuauaucucaaauuaaauguguuuuauuauucuguguggugaaauggcaaauacacauaaagcacucacugcaacuagaguacaaugguuguuuaaggaacagcacuccugguuguuuccguugcaagcugaacuagccacuuuuuuccaccaaacacuuuuuacuuaaagggacaacugacagauaagcuauuauuauuuagacuuggauuuuuggcagacauuuucacaaaaauggacaaaguuaaucugucacuucaaggaaaacaacugacaguauucauuaccaaugauaacauuaaagcuuucaagcaaaaaguagaaguuugaaaaacuuacaucugucacugugacaguuauaagaaagccuuauauugccacuguaagagcuuacuaauaucaugacuuuucugaugcagcaguaguaauauuaauaaaugggauuuguuuaugcuguauaauaaaaugcauaaacauuuggaagauauauaacccaaugaaucuauauuuuccaaaugaccaauacaugcauggguaaaagauuuauucaaggugcaagauaaaccaauggauuuuggagugagaaaauacaaaaaguucauugauauggcaucagauuccacacuguaaauagucuauaggaaaguacuacuuauugaguuuugguauaauaucaauauaauaucaaagaagaaugucacaauuauccaucaaaagugcuauaaaauacucaucccuuuuccagucaaaauggugagauagagccaaaaaaaaaaaaaaaaaagaaugggugguuaaguggagugauggagugcaaaguaaauuauccaauuccaucacaugguuccuuaagaagacuugugcacauuacaauacauauucugacuugcauguuguuucagugugauuuugcuuccaaaagauaagacuuguuaaguguucuuaugcccucaggcuacuauagucacuuuauauaucccccuaacuggggauaagcaucuccccuccuguaccccuuuaucauccuuaggcaguggcugguagggauggaaguaugaacaucuaccucauuuaauuuggguuugaacagacaaauaauucauacuccagagcucucaugaagguuuagacuaaagcuauccuugaaaagacuuugccuaaaaucauaccucuucuuccccauucccuuuuuuucccauucugucacucccuaauugauuacuccuuuuuuuguuuuguuuuguuuucugagacagggucuugcucuguuaccgaggcugaaguauggcacaaucacggcucacugcagucucgaccucccagauucaaccaauccuccuuucucagccuccucgguagcuuggacuacagccaugugccaccaugcccagcuacauuuuauuuuacuauuuuauuuuuuuauuuuacagacaaggucucacuauguugcccacgcuggucuugaacuucuggcucaagcgauccuccugccucagccucccaaaguaccaggauuacagaugugagccaccaugccuggcuguuucucacuuucuuaauaaauuacuugcaaacaaauccucaucucaaugucugcuucuggggaauuaaaccucugagagcuagcaacaggucauucuacugcuugaucauugcgcucuuugauuuucugcuaaaugaugaucaauucaacuaccacaguaaugggggagacaauguaaaauuucucuuuauagcaacauaauuauagcuaauugugaagugaaauaagaaauaaauuuuaacucuggcaacaauaacaacaaaaacaaaguguugauuaugaucuuugauucauuuccccaaaaagggcauuaucagguacaguaucuuugagucuacaauaauuguaacaugcuuuuugguaaacugacuagaaggaaauggaaguaauauagcaauaauacgaagggacagaauggagagagcuacauagaaaauacaugagcaaauuuauuguucaagauaauaaucaguggagaagacaagacuggaaaugccaguaaaaaggggaagugauugguggauucauaucccugaugaaauaggaggaaacaagauaaagaaagaaggcaauggauaagagaaagaaugaaaacaaauaaauugcucaggugaauaagaagggguggguugaagcugcguaaggggcuuucaaugguuccagauaucauucucuggcauugguagcacagaaugcugcacuugccacacaccaccaccugguuucaccuugcaaacagccauacagugcuccauuuacacccacacacauuucucacacuauucugcauucuuccauuaccacuacuuuuuuaucuccuucuccauuuucuauauuucauuugcuacccgaaguauuacuuuaagagauucccaaacuucuucuuccaaucaauacauguucccagaaaucaauaaggaaagauggaaguagaauauauuauaggauaucucccuguuuucuuuuaagcuucgacuauaaggauuaguuauuuuuacagcacccaagagaaaacacuagucacaggaagcaguuccauaugaaaccagaucuaucuaaaacugccuuugccagucccaaaggacaauguugaaaaggaaucccaagaaauaaaugugucuacaaaauucagagccuauaaagacaaaaacugaggagaaacacuuaauaaagcuacucccauacucugcauaagccagaaauaaaccacuccuaauauggcaaccacacaauaaacaucuaaugcucagaauguuugucaaaaguauguuggucaaauguacuaucuuucaacauuuaacauuuuaucaauaaagaauuccuagaaacagaauucuggcaucuacaaaaaauauauauaucacauaguaacccauuuuaaaguuaauccagagugguauuuauaacauuuugaguaaaucaauaccuuggaaugauauuucaaaaaccacuucuacuauuaaucuguugucucauuaguuguauuuguuacagaaccuaauaugacaaguuuugauuucgacagcauguagugauuucagaaccgauuccauugaaaccuagccauaggccacagaaaucuaucagaaauaaugucaggauugacuucagaugggccaaccaagaauucccucauuaagagauuaucugcuguugaaauacguuuauguucauguuuaaaacaaacauuucugaaacacaaaauaauucuacuccucuauauucaagaaaagguacuaaccacaagacaauagcauauaaauaaaagccacaaaccugaaaggcugucaagguggggacaggagcacuuggaacacaggcuggaauacaacaugugucuggcucaaguacuuaacuugauaaagucaagucuauuucuaucaauuuguauuaggagaugaauagguucucauuaaaaaaaaaugagacucaaaaagaaaaacuuuuauuaaaaaaaaucaaaggugucaaaucuggaaauaccucccaaaagccaggaaacacugaguucuaagcacaagaaccaagacagcuuccugaugguccuugagaccagauggccaagaccaguacagacccacaggucccaucucucaaguguguguuagaagugcaagaagacuggggaacuagucugcagaaguauccauuccgagaaacugaccauacauaaaguuuggugaguuuuguaugaaauuuccucuauugggcaauggcagcauuuaugccucugaaacuuugucaaaaaugcauaaauauucuauaguuauuugcagaagaacuacauuuaaauauagcauauccuauggcuauccaucuucuuggaguuaacaaaggguccccaccaucuuaggugaaagguauuuuacaauguuauaaaaaaaaauuaauggauauauguaaaaacaaagguaaaauaauuuauaccuuucaaaaaugaccaagaaguaacaguuaaacauggugcaaagagguaauucaauaaacacuagcaaugcguguguguguguguguguguguguguguguguguguguguaucagcccgaaaccucagaauugcuaguuuuuuuaaccacuuacuauuaaugucauacucaacccggauuuuacauaccaacaauuuaccaacacacuaacaguuuacaaaacauccaguucuacgcgguugccuuuauuacaaaguaacuucuuuccacacugaugacagauauaaucaaauagaaacacaaauuaauucuuaauauuuuuauaauacuuuuuuaaaacuacugauuuaauaacccucaauuucccuuugaaaggaaauaccgagaguauuuaauguauccugaccaugaaacagaaacuuaggauaguaagugauacguauguauccauugauacaaucuguaucaugauacaugauaaaaguaugugaaaugauuuuaucaguuucagguaugcaaaucacaaucaggugaucaagguaauugcuuuuccuuaggguugaaauuaucccugguuucugauaggaaaaguacuguggaaugugcuaaagugguuccaaagguugccacaccaacucacccuacucacauucccaccgucuccuuccaucuuucuaggguugauugugugguuuaagugauugugugguuuaagugcuuaacuuaccauugggagaaaccucaacaauggauaaaauuagauuuagugaagaauuuccaggacauuugacuaaaagagaaaaggaauuaucguauauauuaaaauaauucauaucauuaguacacaccacacuuuuccauuucagaggcaaauguuugauaaaguucaauuagaaucauuuuuucacuuaguuggaaaaugauucuaaacucugcccaaauaugugggaauguuacauuggagaaaugcucagaaaaaagcccaaguguaaagaacggaagauuauguaagcuuugguaaaaaucucuguguuacauuuucucagcucuuaaauguaauuccaaaaaagacccuggacagugugguaugggcuagcauaugguuuauuuucagcuuuauggaacaacagggauuugcaagcuuugauaaauucccaacuauaaccacagaagaucucuucggauuucaccaaauagaaaacaaacaauaaugaguugcuggggugacagggucuuuauuuguuaugauggcauagaaaaagaaaugcgugccuagggcauuuguuuuaaucaugaaaauggggaaguuagugcucagcauucuucauugcugggucauucuuacagccaauuuaauuaaugugaagaacagcuucuugucuuguaaauaauucauuucuucacuucacaaguauuuacugaggucugauaccaauucaaacacuagcaaggucuuccauacuuuagaucacacaggaauuugaggaauaaagagauucaaaagggaagaaaugcagaaagaagugcaacaagaugaaauacuuaguuuacuccuaauuuuaagacaguuacuauguucauaaaaguguuuuauguguaauuucaaaaaaacuuuaaauaaucaaaucccauaguuuauccugaaagaaaauaaacaugggaaaaugucagcuuugucugauagaaaacuuuaggcuuagguggugguauacauuuauuuauucauuccaccaaauauuuuuccaccaaauauuuauugacuaccauacagguggcaggcucagugccaagcuaugcagauuuuaaacugaaagcugcucucauggagcuuucaguuuacugagaguguaugagagcaagaaacaguaaucaaacacuaaugagugugcaauuacaaacugagauaugaucuaaagaaaggaagcacagauaugggaauauuuguaacaaagguacaugucuuaggcuuaggguuacugaggaagguggaugaugaaaaacuucuuugaagaagaaaugcuggaauugauaacuaaugaaugggugcaaauuaaugggaagggagugacaucugacaaaggcaacaaaauguacagaagcccuaugauguagguaaauaaguaguggcuguguguguguguguguguguguguguguguacauauaaacaaaaagaaagcuuuuauaauacugaaaccaauaaauuuucagauguccuaucagcaaucagauuacuuaaucuaucugccuuugcaaguacuuaacaacugacaagaaagugaaacauggaucugucuccauuucucaaaugcaggagguaaauuauuaugauauuuuacaccaucaucuauuugcugcuacuacaauuaaugcauuagugcuuaacaaacuuaauacuuuuuaugaaaugaaaaucauaauaucaaaaccccaucuugcacaacuguagccuucacucuuaacagccacaggucuucuuugauuuucccaaaaaggcaagcucuauccccacuaaagguauuuaccuagacuuucucccaaaucuuaacaagaaaaaauaauuccuaaucacgcaccggaucucagcuuaauguuacuucuccaaugagguccucccugcuugcucauucuaaaguagguugcugccugguuuuuuuuccccucucauaccaguugucaacuuaguguguuuauuuguuuacucugucuuucacaauguaaaucccaugagauaaaauauucaugacuauuuuaucuaccaagagcaacacauauguuaggggcuuaguaaauauuuuuugacugaaagugaaugaauaaaugaugacugaguacugaaguaacauaaagucagagaacuaugaauaaauauguauuauaaucuucauaaaaaacucuauaaguguaggcaauucgaauauaacugaaacacucuucugagauuuucucagggaauaucauaugauacaacugucaaguauaauaauuuuuuucuauaaaaaucaccgccaaauuucagugcacuaucuaggaagucaaucugaaucuuaagacaauucaaacuggaaaacaggaaaggaguucucaaguauaaaagcccuauuaaacaaaauuacuuucauacauagagacuuaguaucacucauaauuuaaaagaaauguuuaauaaauguguacuagauuaauaaauauuuaguauuucuguauuuucuccacaauuuuaaguguagaaaagucacaugaauuuacauaugauucuucaacacaauuauuguuuuuaugaacuuuaaagaaaagucaggauauagaauuuuucccaaaaaauuuauaauauucucccagaagcagcuuagacucauguauagaaugaagaauauucaauuaggagaauaaagaauucacaaacaccaauaaaaauagcccacaaaucacacagacauuaauaauuaguucacuauauugauucauuuuggaggguuuuuuuuuuuuuuuuaagaaaaacauuuagguaugugugaacucaggagucauaaccugcaaugaacccaacucuguaacacaacacagauaccacagauggacugcaaaggccaguccugagguuagcuagaucugacauggaaauuuucaauuuucugaaccaauaaauucuuuuguuaacuucuuuuuuguuagcccaaguuacauuagauuuuugaccccugaaaucaaaagagaauuaaccaauaacaaauacuaagaacucuucacucuucacacucugagucaucacuuccuucuccauuccaucgcauaggauguuuucagaaugacaguauuaaaaugaaaaugugauuagaucauucacucuacaguuucuccuuguuuacaagauaaauauuaacccuauagcuuaucucugcuaccuuuaccuccccaccuaccauucuaauucauacacacuguaagccaacaauucugaacauuuacccauucucugugucugcaauccccuucucagagucagcuccucuggaaaggaguuaccuuccuccucaggcagcauuaauacugguacgauguacucccaaugcaucuugcuucgaucucacuguauugcaauuucugcuuugccaggcuaccaccuaccccuacuagacuauaaacugcuucaggucagaauuccuccauauucccagugaaaacacugaaccuaacucaucuuagaugcucaauaaaugucugcuagaugaauguacacuuuauccaaugaacguagauuacauucaaugcaugcacauaaguuagccacuuuuuaaaaugaguaaucccuuuacagcaugauuaauaaauacaaucucuaaaauaauaguuuauuaguaaaaauggccuuauauaauugaugguuaaauacuuuuuguauauaaauaaaugugaucucauuuuuaaaaugucacauuucacucccugaaauaaagaccucaaauugcuuuuuguaauaauguaagguucaaaauacucucuaacauuuaaaaggaaaucagaauuugaggaaauagucauauaaaaucagugguaauugacaaacugacuauauaauaauuucacugagaugauuucugguauuaaaugaaugaaaaagauaaucguaacacagaaagguuauucaaaaacuugacuaagaaaaaaagucaccaauaauuauuuuauucagggaguaaauguuauuaauugccaaaauacgaauuuuaaauuugagaaguacagauuuguaaguauauauuuguuugaauaguaucagauuggccuuuuauuggcuuauugguauuuagugccagcacuuacaaugugaacucagcaacagaagauaauucuuaugaaaucaacauucaacuuacaugaaauaacuuaaaaacuuaccaacaauagucuaaugauuauauaccuuuaccaaacaaugucuaaugaaaguccaaauguaaaaauuuaaaaauuaaaauuauagaauauaauuuuuacacaucaauuguuuuguagcaccaucucgcaaaguaaauaucauguuuauucuguagcuaaaauuucuccccacaagcagaaauuguuuggaauauacaaaaagacaacccauuaacaaguaacuuuaaguaauguaguuggauggucauuauaauacaaauggugcuauaaauuucccuuuaaguauuguuuuagcuacaucccacaaaucuugauguguuuucauuuucauucaguucaguucaguauuuccuuaauucuucuuuuauuucuuucuuaaccuauggguuauuuagaggagagucauuuaauugacaaauauguggagauuuucuacaagucuuucuguuauagauaccuaauuuaauuucauuaaacucagauaauauucuuuguaugauacagaugccaguuacaccagauucauaggguuguucaggucuucuaugucuguaucuauuucugucuacucuguccaucaauuacuaagaaggaauauuuaaaucuccaacaaaaacuggauuugugucuugcuccuugaaguucuuucagauuuugcuucaaguauuuugaugcuguuauuagguacauaaaugcuggguuuuaugccuucuuaaugaacuaacccuucuaucauuaugagauaaucucuuuuuucccuggauauauacaaucaugauuggauuugaaucuacccuuuugcuacuuguuuucuacugcuuuuaucugcccucagccucuuuucucucuuuuucugccucccuuggauuaacugcauauuuuauauuauuccacuuuaucugcuuucuugacuuauuagcuauaauucuuuuaacuguuguuuuagugguugguucacaguuuauaccuuuaauuuaucaugaacugucuucagguaauauuauaccacaucauauauaguauaagaaauuuacaucaguauucuuacauuucccccucucccagccuuugcacuacuacuauuauaauuuuacuucuauauaugucacgaaguccacaauauauuuuuauuauuuuuuacuuaaacagucaaauaacuuuaaaagagucuguaaggggagaaaauuaccauuuucaguguucuuuauuccuuuauauaguccagguuucuaacugauaacauuuuucuucugucugaagaacuuuuuuuagcauaucuuucaguacaggucugccagugacuaauuuuuucaucuuuacuucaucuaaacaaguuuuuauuucaucuuuauuuuugaaagauauuuucacuagguauaaaauuccacauugauggccuuggacaguggcucacgccuguaauaccagcacuuugggaggcugaggcaggcagaucaccugaggucaggaguucaaggccagccugaccaacauggagaaacccagucucuacuaaaaauacuaaauuagccgagcgugguggugggcaccuguaauccccgcuacucgggaggcugagacaggagaaucgcuugaacuugggaaguggaggucgcggugagcugagaucaugccauugcauuccagccuggguaacaagagcgaaacuccgucuaaaaaaaaaaaaaaauuccacauugauaauuucucucuuucuauaguuuaaaaauguuauucuacugccucuguguugcacuguuuccaaagcaaagacucuuaaccaucuuuguuacucuguaccugauacgucucuuuuuuuuggccuucuuuuaagauuuucucauuaucacugguauuaguuugauuauaauaugccucuguaucaucuucuugugcuugggguuuuuuuaguuucuucugaguuuauaguuuuuaucaauuuucuuucccaccauuuuuucaaauauuucagucuaaaacucucccacuuuccuccucuucagcaacuugaauaacaugaauacugaggcacuugaaauuguccuacaguucacugauugucucuuuuuuaaauuagccauuauucucucugugguucauuuuggguaguuucuauuguuaugaugucaccucauuaauuucuuucuuuguagacuaaacugucacagauccauccagcaaauuuuuuucaucuuagguccuguaacauucaucucuagaauauagauuuaagucuuuuucacaucuuccauuucugugcuuaaugucuucaaucuuuccucuccuuuuuugaacaaauuaaaugugacaauaacuauuuuaaugcuuugucuacuauuucucucauuuguguuuuuuuuuaacugauugauguucuccucauuuugugucaugguuuccugugucuuugcauuaaaaguaauauuuuuacuagcuuccaaacaugauuuucaccuuuuggggugcuacauauucuuguguccugaggaacauccuugagcuuuguuugagaaaacaguuaaguuacuugggaacagcaaauccuauagaaguuggcuuuuaaacuuuguuaggcaaaacuggcacagccuuuaaucuaggggugaauaugcuccacuacuaggcaauauucuucugguuauucuaucugaugcuucgugaauuaugagguuuuccacucuggcugauaugggaacaugaauaauucccagcccuguauaaauucugaaaacuauucccuguguucuuuugaggugauuauuucuccagcuuuuuguagguuccccacauacugauggguccucagcugagggcuguacgaggaccuucugcauaucuauauaguuuucucucugugcaucuucucuccagucaguacucuguccugcaaacucuagccaccuggacuuccccagacucccaacucugucucgucaacccuagacuaccaacauucaccuggguucuccucccugugcugggcccuggaaaaaccucucaaggcaaucagcugguacaaucaaagggcuuaccucauuuguugccauucuuaaaggaucacuguccugaacugucugauauuuaaugucugaagacucccuuucauacgguguaucuggucuuuuuuguuuguuucugguaggaaggcaaaucauguuccuguaaccccaucuaggcugaaacauucuaauacaauuaaauggccauucucugggaauagaaaguaagaacuuacaacagugacguuuccauaacacggaauauauaauaauuuucaaauggacaaaaaagaacaaauaauacccaaaagaagaaacuuaaauauccuaguugauggaauaaauauuuccacacccagauauaaugucucacacauagaaggcucaaaauaaauacuaaauucauaauuccuugcuuugaagcuaauuaaaauuagaaaagauaauucaguaaaaggaagaagaaaacaaugcuauccugugccuuagauacugaguaauuaauucaauuugauguccuauaagaauaauucauaaaauuguguauuguguccuguuuugauuuacuggaagauuacaaacuagcaugccauauucacauguauuuuaccuucaucugaaauaaguuaaauaagaaugauuuuauaauuuguuucuuucaaaaaguuauuuuuuggcaauauuuaacauaguauaacuaagauaaacuauauauuaccuuguuaauauuaaugguuaauauuaauuuuaauaaccauauauuuaggcaagauuuaaaaacuacaaaauagaagaaauuaagcaaaaauaauuuaaaauaaagcauuacuaugacuauaauauuuaccuauaaucauagaaauuacaccuuauaaauguauauaaucuguuucuuuaaaaaaaaaaacuuuaggacaauuucuaccaucauucggaggguucaauuaguccaaucugcuguuuaagaucuagaggcuuuauucagagaauaaugcaaggucagucaccuuagcucaugagcucuaaaguaaaauagccuucaagauaaauaacaccucuauaaauuacuuaugcucccuaagcuuuacuuuccugaucuguaaaauggugauaaugguaucuauccaauaaaguagcuguaauaauaaaagaaugcacaaagagcaccuaacauaguauuuggcacuaagcuggcuauuauuuuauuaaguuuaauguuaugcugccuagaaguaaagcccuuaugugaagaagauggacuccaaagcugcauugucuuauauccuauucucaaacauuaaggucagucuucugguaugucaagcuguaauuucugaggcugccauuaguauugcuuauggaaacauaagaccaaguaaggacacauaaaguuggaguaaucagaaaacaauccuguaccauaaggaagaagacaggcuggaagucuggaaauagaugauguauuacaggguagagaaggugaaaagccaaggauucacccuauggaaccuguaagguuuuaaaucucggcuccaccaguuuauuuauguuugacuuugggcaaguuacuugacccuaucuguaaagugaagacaauaguaauaauuacuacauauauuguuaaguuucacugacaauacgauguaucacucacucacuaacuguuaauauuauaaaagccaggaagauuggagaguuacaaaagcaucaaauacaagguuauagagauggauuuuuuauuaagggaaggagcagauuccagggucaauuuaauauaauucugucucucuuuuaagacccaaucacaaauaaugaaaaagaaagguuuuagagugauaaaagaccccucaaaagguaaaauauccaugcaugaggauagcuguuaugacauaagcugaagugaaagcugaucuaacacacacuuguuacauagaaaaauaguucuaauauuuuuugauaauuuggaauaggguguggaaaaguaaaaguuuugcagucagacagaccuagcuugaguagcuugaguucaauuuugccacuuaguaguuguuugaccuugaauaaguucauuauauccucugaacccuaauuuucacaacuguaagacaggcauaacaacaacugccuuucagaaugauacugaaaauuaaaugauaaaguauguaauguucuugccauaauugcaauaauaguagcuuucacuuucacuauuucaccaauagugaaaaccauucccaaagaaacaggaaccuuuccaauaucucugccccacucugaauaggacauuguuuuuguuguaacagaccaucuuucucauauguaaaucugaacuaauuccaggucucugucaauuugaauaaugaguucaaauccacauccuguucaacauuaguuaauuuguuauccaaacuaucgcuaugaguaacuacuacuuuacuuucccugaaaucaccucuuucucuuauuuuccuuacacauaugucacauauaauauucuuuaugaucaagccucaaaagccagcauuccaucuccuaggcccuaauuucaacaaagucuauucaaacgaauuaacaacaaaccauuguuaauuuucacaaacuuucgauaaaauuugaauuuaaugcucucauacuuaaugacaagacaaagauaaaaugugcacgaauuauaaacaccuccuugguucaaucuaucauauuuaccaaaauuuggaaaacaaaaauaacacucucuaaaggcaaggguucuuaauuuaggucuaguugauuaugauagaaaacagacaaccacaugaugcagaauaucaaccugauaagaccaauucuuuguaaucucuuuaucucugaugauccuuuaugcaauccagaaaacuuaaucuucucccacauuuucaacugccuguguuuuacugccaacucugaucaauuuggcaaaaagaugagagcagcaaucacuggaaaaaauguagggggaaaaaugagccaaaucaacugauuuuguuucaauagacuauuuaaucugcccaaugagcaagccuaaguguucuugcuaaagguaauuaagugguauuuuguaauuccuguuguucuuuuuaaaaggucuuguuuuaaaaguguuuuaaagguguucuauaaugaaacacuuuuuguccuuaaggaaacaccuuuugucccuaaggaauaagguagaaauagaugcuaaaguaauaauuuggcauuaccaccuuauugucacaauaauggauguuuugacauugacaauagauuuccucauuuguacaaucaaaauucaauuugaauagaguuuuaguagcagcucuuaaggaaacaaaggguaucaauaauauagaauguuuccuuaaggauguauagcuacugcuauguuuccauuucuucuagucaaaaaucaaugucacacuaggcuauaaugaauggcugcuugccagcugcacuuaaacugacagaaacucaucauuccuuuaaaaacuguucuucuaaaaagaguaauuuaauaacuugacuuauuuaaguuugauucagacauacaaucuaaccauggcuuagaaggcauuuuacacauaagaaaaaauaggcugucuuuauuaguguuagagauguuuacaacacagucaauuuuuaaaggaagaacagaaacugcagucaauuauuagauacauauucacaccuguugucugucauguuucaaaccccuucggugugagauguagucaaggcaaauaaaacgaagaagaaccagcugcaaaaacugauuuuguucucauaugguaauuaaaaggaaaaaguguaccauguguuguaucuacgacagucccauuacuucauguuagggacagucccauuuucuuuuaacagauuuuuguugcggucaaguauguuauaaaggcuagcacuuguaggucuaggcuauugaccuaauuuauauugguagucugcccaauuaccuuugcuaaauuucucccugaagcauacuagucuggugucagaaaaauuaaacauuuucauuuucauucccacucuaacccccauacuuaagucacacuuaaugugauuuuuuuaacaucacacuagacaucagaccuagucaggccaugucuuagaaagacaggugcuauaaacaccaaaugcuuuuaaaaugcaaaccacagagcaucuaaaacuacaggugguacaguuauaauaaaugaacacucagaacacauguaaaugcuacacugucauggccguauccuucucggaaaaccuuuaagauaacaguaacuuaguuacuguucgaaugguaaauauuguauuauguuucaauugugcuuaauuuacguuuaaaucuuacuuucaaaaaacuauuaauuuaaaaugcuucugaauauuaucaauaagauuacauauauuuaaagcaucugaaaauacacuccaagucacuauggaugugacucguuugaggaauauauaauauaaaauaauuugaaguuaaaauagaucuuuacccaaaaaaggucacuuuaaaaacacauucaccacugucuucuauguauugaacauaaaguaugauuugcuuuguaaaaauuuuauucuuguacaacaacaagaaauacgcaaagaugaaaauacauaugcucuggaacuagacagagacagaugcaaauucuggcucuagagcuuacaaaaacaagaccaaauaaaaugcuuaacaaaauuaaugccaaccuaaccuacuuggcaaggacaacccuacacaugaaaugauucuuacugauacaauguaacugccacacagaauuguuugacucaagaaaacaaaaugcaacuuguuauggcauuuguaguuaaguaccaagggucuagccaaauguauauugugcuguaacuuuuauacauaaguauaaauuguauauauauauuauauaaguauaaaguguguauauauauuuuauauauacacuuuuccaccaaggaagaaauuaccagauuuucucugucucuggaugauuuauagaacugaguaacuugaaacaaaaugaaguaaauacauuacagugggaaaaaaaaguuuuuacagucaaugaaaagagauauuugcagguauugcuacgguauuugcagccuguagcaaaacauguuguuaaaguuuaaaauguccuaacauuauacgugaaaaauaugauucaccugacccaaccauggaaaaugccuuuaaccaauaugugaaauagguuuucuuucuagauuaugaagaauuauucacugaguuuugcaucauagaagugauuuuuuuaaugaagguuaaaaugaaaacaauaauucagaaaauagaauauuaguuucccuuaccauaaacuuuuccugaauaugcuuuaggaaaauagagauagcaaaaacaaagcagaacaaggacagguguguguugcucagugaucagucaguucagucauaaaucagucccuuuuagacgccgauuuuaauguaaagcagaaguauaucagcuaggagaaaauccaaucucuuccaacguuauuuaugacaaagcacuccuaacugaaguccaauuuguuuguggaauugcagucauuuugauucaacuaaacaauaaaugaaucugccuuucauagcuccaacuccagagcacaaaagagaacuacaucacaacacuucacgauccaggggcgcaguuaaaggaacagugggaaagcaguuuuuggaguggggaaaaaaauccaaugagcuacaaaauacaauucauucaccugaaccacccacguacuuuuugcaucggcuguauuucaccuagugagcuauucauagcacacaaacgagcuugcugggagcuuuauuacaauccuucuucauucugaaggccucgugcaucacugaaugcuggacaucucagaugaccacucuaaauacuccuccaauucaaccaaagccuauggcacaacuagaucaugauaaugauuaaaaaagagaaauucugggaggcuaaaaacacaaacaacagagaauuugucuauaaauuuauaaauauuccucaacuaauuaagauuuuggacuccgacauacuauuuucuuucauaaugacucuauuuagaaacaauuauuguccaauuguucucuaacucacugguauuucuuaauuuguuacauuuacuaaguuguauuuuaccagggaagaaaaaggagaucuuaaaauauuuuuuucugucauaucacaaaucucuuuuugugcacuuuucuugugaaccacaugucugaaggugaaaaauauuguuacuaaaacaaaauucuuauuauuuuuaugccaacuaaagaguaguuguuuugagaagaaacaacaggaauuuuuaaauguauggcaugacguugccuugcucaccagccauucaaucauucccaagauacauauucugaaugugaaguauuuauuauauauugaauuauaaaauauuuauuaugcuaaaagaguucucaauaaauacuaauucucuaucuaaaacucuuguagaauuaaaaacuaugacauaacugaggcauguugacaggaauguacacaguacuaguaaauucccaagcuguugaaauuuuauauucuugcauggacuaguaauuuccacaauagguuuuccaguccuucauguuuuacauauauaauuuuaaaaguuauaugcuuauagaaguaaaguguucaacucuauauuucuuguugcuuuauuuuuuuuuuuuuuauuauacucuaaguuuuaggguacaugugcacauugugcagguuaguuacauauguauacaugugccaugcuggugcgcugcacccacuaaugugucaucuagcauuagguauaucucccaaugcuaucccuccccccucccccgaccccaccacaguccccagagugugauauuccccuuccuguguccaugugaucucauuguucaauucccaccuaugagugagaauaugcgguguuugguuuuuuguucuugcgauaguuuacugagaaugaugguuuccaauuucauccaugucccuacaaaggauaugaacucaucauuuuuuauggcugcauaguauuccaugguguauaugugccacauuuucuuaauccagucuaucauuguuggacauuuggguugguuccaagucuuugcuauugugaauagugccgcaauaaacauacgugugcaugugucuuuauagcagcaugauuuauacucauuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagaugauaucucauagugguuuugauuugcauuucucugauggccagugaugaugagcauuucuucauguguuuuuuggcugcauaaaugucuucuuuugagaagugucuguucauguccuucgcccacuuuuugaugggguuguuuguuuuuuucuuguaaauuuguuugaguucauuguagauucuggauauuagcccuuugucagaugaguagguugcgaaaauuuucucccauguuguagguugccuguucacucugaugguaguuucuuuugcugugcagaagcucuuuaguuuaauuagaucccauuugucaauuuuggcuuuuguugccauugcuuuugguguuuuggacaugaaguccuugcccacgccuauguccugaaugguaaugccuagguuuucuucuaggguuuuuaugguuuuagguuuaacguuuaaaucuuuaauccaucuugaauugauuuuuguguaagguguaaggaaaggauccaguuucagcuuucuacauauggcuagccaguuuucccagcaccguuuauuaaauagggaauccuuuccccauugcuuguuuuucucagguuugucaaagaucagauaguuguagauaugcggcauuauuucugagggcucuguucuguuccauugaucuauaucucuguuuugguaccaguaccaugcuguuuugguuacuguagccuuguaguauaguuugaagucagguagugugaugccuccagcuuuguucuuuuggcuuaggauugacuuggcaaugcgggcucuuuuuugguuccauaugaacuuuaaaguaguuuuuuccaauucugugaagaaagucauugguagcuugauggggauggcauugaaucuguaaauuaccuugggcaguauggccauuuucacgauauugauucuuccuacccaugagcauggaauguucuuccauuuguuuguguccucuuuuauuuccuugagcagugguuuguaguucuccuugaagaggugcuucacaucccuuguaaguuggauuccuagguauuuuauucucuuugaagcaauugugaaugggaguucacccaugauuuggcucucuguuugucuguuguugguguauaagaaugcuugugauuuuuguacauugauuuuguauccugagacuuugcugaaguugcuuaucagcuuaaggagauuuugggcugagacgaugggguuuucuagauaaacaaucaugucgucugcaaacagggacaauuugacuuccucuuuuccuaauugaauacccuuuauuuccuucuccugccugauugcccuggccagaacuuccaacacuauguugaauaggaguggugagagagggcaucccugucuugugccgguuuucaaagggaaugcuuccaguuuuugcccauucaguaugauauuggcuguggguuugucauagauagcucuuauuauuuugaaauacgucccaucaauaccuaauuuauugagaguuuuuagcaugaaggguuguugaauuuugucaaaggcuuuuucugcaucuauugagauaaucaugugguuuuugucuuuggcucuguuuauaugcuggauuacauuuauugauuugcguauauugaaccagccuugcaucccagggaugaagcccacuugaucaugguggauaagcuuuuugaugugcugcuggauucgguuugccaguauuuuauugaggauuuuugcaucaauguucaucaaggauauuggucuaaaauucucuuuuuuuguugugucucugcccggcuuugguaucagaaugaugcuggccucauaaaaugagauagggaggauucccucuuuuucuauugauuggaauaguuucagaaggaaugguaccaguuccuccauguaccucugguagaauucggcugugaauccaucugguccuggacucuuuuugguugguaaacuauugauuauugccacaauuucagagccuguuauuggucuauucagagauucaacuucuucccgguuuagucuugggagaguguaugugucgaggaauguauccauuucuucuagauuuucuaguuuauuugcguagagguguuuguaguauucucugaugguaguuuguauuucugugggaucgguggugauauccccuuuaucauuuuuuauugugucuauuugauucuucucucuuuuuuucuuuauuagucuugcuagcggucuaucaauuuuguugauccuuucaaaaaaccagcuccuggauucauugauuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuuguaggcauuuagugcuauaaauuucccucuacacacugcuuugaaugcgucccagagauucugguauguggugucuuuguucucguugguuucaaagaacaucuuuauuucugccuucauuucguuauguacccaguagucauucaggagcagguuguucaguuuccauguaguugagcggcuuugagugagauucuuaauccugaguucuaguuugauugcacuguggucugagagauaguuuguuauaauuucuguucuuuuacauuugcugaggagagcuuuacuuccaacuauguggucaauuuuggaauaggugugguguggugcugaaaaaaauguauauucuguugauuugggguggagaguucuguagaugucuauuaggucugcuuggugcagagcugaguucaauuccuggguauccuuguugacuuucugucucguugaucugucuaauguugacagugggguguuaaagucucccauuauuaaugugugggagucuaagucucuuuguaggucacucaggacuugcuuuaugaaucugggugcuccuguauugggugcauaaauauuuaggauaguuagcuccucuuguugaauugaucccuuuaccauuauguaauggccuucuuugucucuuuugaucuuuguugguuuaaagucuguuuuaucagagacuaggauugcaaccccugccuuuuuuuguuuuccauuggcuugguagaucuuccuccauccuuuuauuuugagccuaugugugucucugcacgugagauggauuuccugaauacagcacacugaugggucuugacucuuuauccaacuugccagucugugucuuuuaauugcagaauuuaguccauuuauauuuaaaguuaauauuguuaugugugaauuugauccugucauuaugauguuagcuggugauuuugcucauuaguugaugcaguuucuuccuagucucgauggucuuuacauuuuggcaugauuuugcagcggcugguaccgguuguuccuuuccauguuuagcgcuuccuucaggagcucuuuuagggcaggccugguggugacaaaaucucucaacauuugcuugucuauaaaguauuuuauuucuccuucacuuaugaagcuuaguuuggcuggauaugaaauucuggguugaaaauucuuuucuuuaagaauguugaauauuggcccccacucucuucuggcuuguaggguuucugccgagagauccgcuguuagucugaugggcuuuccuuugaggguaacccgaccuuucucucuggcugcccuuaacauuuuuuccuucauuucaacuuuggugaaucugacaauuaugugucuuggaguugcucuucucgaggaguaucuuugugguguucucuguauuuccugaaucugaacguuggccugccuugcuagauuggggaaguucuccuggauaauauccugcagaguguuuuccaacuugguuccauucuccacaucacuuucagguacaccaaucagacguagauuuggucuuuucacauagucccauauuucuuggaggcuuugcucauuucuuuuuauucuuuuuucucuaaacuucccuucucgcuucauuucauucauuucaucuuccauugcugauacccuuucuuccaguugaucgcaucggcuccugaggcuucugcauucuucacguaguucucgagccuugguuuucagcuccaucagcuccuuuaagcacuucucuguauugguuauucuaguuauacauucuucuaaauuuuuuucaaaguuuucaacuucuuugccuuugguuugaauguccucccguagcucagaguaauuugaucgucugaagccuucuucucucagcucgucaaaaucauucuccauccagcuuuguucuguugcuggugaggaacugcguuccuuuggaggaggagaggcgcucugcguuuuagaguuuccaguuuuucuguucuguuuuuuccccaucuuugugguuuuaucuacuuuuggucuuugaugauggugauguacagauggguuuucgguguagauguccuuucugguuguuaguuuuccuucuaacagacaggacccucagcugcaggucuguuggaauacccugccgugugagaugucagugugccccugcuggggggugccucccaguuaggcugcucgggggucaggagucagggacccacuugaggaggcagucugcccguucucagaucuccagcugcgugcugggagaaccacugcucucuucaaagcugucagacagggacacuuaagucugcagagguuacugcugucuuuuuguuugucugugcccugcccccagagguggagccuacagaggcaggcaggccuccuugagcuguggugggcuccacccaguucgagcuucccggcugcuuuguuuaccuaagcaagccugggcaauggcgggugccccucccccagccucguugccgccuugcaguuugaucucagacugcugugcuagcaaucagcgagauuccgugggcguaggacccuccgagccaggugugggauauagucucguggugcgccguuucuuaagccggucugaaaagcgcaauauucgggugggagugacccgauuuuccaggugcauccaucaccccuuucuuugacucggaaagggaacucccugaccccuugcgcuucccaggugaggcaaugccucgcccugcuucggcucgcgcacggugcgcacacacacuggccugcgcccacugucuggcacucccuagugagaugaacccgguaccucagauggaaaugcagaaaucaccgucuucugcgucgcucacgcugggagcuguagaccggagcuguuccuauucggccaucuuggcuccucccccucuuguugcuuuaacuaaauauuuacaaacugcuuauaaggaaagaaaacuauccauuuagaagagaaagucauauuuguaauucaucacauaaacagaacuaaaggcaaaaaacacaugauuaucucaacagacccagaaaaggccuuugguaaaauucaacaucccuucauguuaaaaacucucaauaaacuagguauugaaagagcauaccucaaaauaaccagagccauauaugauaaauccacagccaauaugauacugaaugggcaaaaguuagaagcauuuccuuugaaaacaagacaaggaugaccucuuucaacauucccguucaacacaguauuggaaguucuggccagggcaaucaggcaagagaaagaaauaaaggauauucaaacaggaagagaagaagucaaauuaucuuuguuugcagaugacauaauccuguaucuagaaaaccccaccgucucagcccaaaagcuccuuaagcugauaagcaauuucagcaaagucucaggauacaaaaucaaugugcaaaaaucgcuaacguuccuauacaccaacaacagaaaagcggaguggugaauuaugaaugaacucccauucacaauuccuacaaagagaauaaaauaccuaggaauacagcuaacaagaaaagugaaggaccucuucaaggagaacuacaaaccacugcuccaagaaaucaaaggacacaaauaaauggaaaaacauuccaugcucauggauaggaagaaucaauaccaagaaaauggccauacuccccaaaguaauuuauagauucaauguuguucccacuaaacgaccauugacguuuuucacagaauuagaagaaacuauuuuaaaauucauaugaaacccaaaaggagccugaauagccacaacaauccuaagcaaaaagaacaaagcuggagguaucacacuaccugacuucaaacuauacaaggcuacacaguaaccaaaacggcaugauacugguacaaaaacagagacauagaccaauggaacagaauagggaacucacaaauaagacugcacgucuacaaccaucugauuuuuuacaaaccugacaaaaacaagcaauggggaaaggauucccuauuuaauaaauggugcugggaaaacuggcuagccauaugcagaaaauuaaaacuggaccccuuccuuauaccuuauacaaaagguaacucaagauggauuaaagacuuaaauguaaaacccaaaauuauaaaaacccuagaagaaaaucuaggcuauuaucauucaggacauaggcaaaggcaaagaguuuaugacaaaaacaccaaaagccacagcaacaaaagcauaaauugacaaaugggaucuaaucaucuacagaacuucugcauagcaaaagaaacuauuaucagacugaacagacaaccuauagaaugagagaaaauuucugcaaucuauccauccgacaaaggucuaauauucagagucuacaagaaacaaacaaauuuacaggaaacaaacaaccccauuuaaaaguuggcaaaggacaugaacagacacuucucaaaagaagacauucauagagccaguaaacauaugaaaaaagcucaacaucacucaucauuagagaaauaaaaaucaaaaucacaaugagauaccaucuuacuccagucagaauggugauuauuaaaaagucaagaaacaacaaaugauggccagauugcagagaaaacacuuuuacacuguuuauggggguguaaauuauuucaaccauugugaaaaauaguguggcaauuccucaaagaccuagaggcagaaauaccauuuguaccauuugacccagcaaucccauuacuggguauauacccaaaggauuauaaaucauucuauuauaaagauacuugcgcacauauguuccaugcagcacuauucacaacagcaaaaacauggcaucagcccaaaugcccaucaaugacagacuggauaaagaaaaugugguacauggaauacuaugcagccauaaaaaggaaaaacauaauuuccuuugcagggacauggauggagcuggaagcaguuauccuuagcaaacuaacacaggaacagaaaaccaaacaccacguguucuuauuuauaaaugggagcugaaugaugagaacacaugaacacagggaggggaauaccacgaacuggggcccauugaugaggaugggggagggagaguaucagaagaauagcuaauggaugcugggccuaauaccugggugauggguuuaucugugcagcaaaccaucauggcacacauuuaucuauguaacaaacugcacaccccccagaacuaaaaauaaaaguugagggggaaaaaaacauaaugucauugugucaccucuaucuucacgaguuuuauucccuaauauuaaacuugucuaaagguuuaccuaauaaacucucuccugaaaaaaaauucucaugucacugaaaauugacaugaacagaaaaaaagaaacagauuuugcuuuaaccaaguaaaaagaaagcauuucucugaauauuaccaaaucaucacuucucaaaauaggucauuugggagcauaaaaaaaaaaaaguccccuucuuuucaaaguucacaugcaggauaccuucccuuuugagugauuucaaaugaugcauggaguauucagcugaugguauguaugaaauguaggcaucaucaaccaacaagcggaaacaaacucaaaguguauguacguagcaugcacaugcaagcacccacacaaauguuuaaguguguauuggaguaaucuauuagaaauaugccaauggaaaaaguucugaauuaggcaguauaaaacgagaccuggaaaauggauucaacagauacaaauuauuauggcagauaaacaaguacccuaaauauugucauaaguauaauuuaaauagcugucauaugauuggagaagagaaagucuacuggacaaugugauuggaaaaaggaaaugugacaaggaauaauuuggaaugggaagcagaggagaaaaagaauaccagccucugaugaauaauacguggcuccaagacugcauuagguuugaagccaacacuaaaucgggguccuugagcauuuaaauuaaaauucuauuuuugagaacuugugaagaaucuacuuaagguuaguaacacuggcauaauaugcaaauaauuaugcaaacauaucuuuugauauuguuucagaggcaugaacuugauuuucaagacccaaacauuagaaaaugacauuuucuauugcauauucuaaaaccuuagaguuuuacucaacauuacauuuaaaaguuacaugguuccaaaacugacaaugucauuuauaagaguaauguaauuuauaagaacuaugacucuguuuguaucuauaucaaauuauuuguuuaaaaguaaaaauggcauuagaguuauaaaauguucauagauuuuaccaauauugccuacgcuucuucuaauuucuacaaguguuuccaacuuuaucauaaauauaaaauauggugagaaaugaaauauggaaaagacuuauuguaagccaauaaaauuuaacaugauaaaggucucaccuggaguauuuaagggggagaacaucuguuauuccuccauuaaaauuaaauauuucuccaaacacaaacuacuaaaacuucaguguuaucagagaauuauaucaaugaugaacacaaaaaauguccauaauggcuauuuacugggugaauacucacaggugcaguguuaaguguacagcagagcaaaagacaguagcugccaggacucaaggagcugacauuugggagggaugugcaugccucagaagagugagcauuagggagggcugucagggaagagguagaggaucuguaaaccagacaaaccagggugggaaggaauuucagguaacaugacauacaaggcucagaggugaaaggaggcugcauaugauucuauuuggcugugaagacugccagaaaauaaaagucuugagagggaggcaaggcugagcucaugaaaaguaacaccaauggucugaggaggaaauuccucuaaguguuuuaaucaggagaguauaagguguguguugcagaaagaacaugcaaacuaauugaggucaagauuugcuaccaaaucacaaaauauguaucaauauguguuaaggcucucaaagacugccacauagaacuugaucuaaagucagagaauuauuuaggccaaagucaaacgccuacaaaaagccaggcaaguaaugaaaguaacugaagagccccagaaaaccauggccaggaagaggugugaggccagcguggcaugaucuaacauuuaaacaaauccagauaucagaauucuuaggugaaacauacugauuguucaauaacgacaacuauauaaaugugcuuuuucaaagcacugaagugccaaacauaauauuuauggaaauuaucuaacuccacauagugcaaggccauuuaaaaccaauucacuaagaaauaaaauuugugcaucaaguuaccucuuauuugagcuaagcauuuuuuuccccaaaacacccucgcugaaugagauuucugagugauaaaggcuuuaaaaacucugcuuugguggcuaugaaugauagagaaaagacuuaaaauguaaaguugcuugucuguuucuugucuuuuguuuuguuuuguuuuguuuuguucuuacugauuucaaaguaaaaugaaugauccuaagcacucuggaaugauccuaaaaacucuggaaugauccuaaaagucuuugaauauaugcaaaucugcaaaggggaaaguuuacaaauaugagcaauaacaaauauggaacauuuuuguuuucaccuaucaaucucucaucuguuaaacagaaaugaacacaaaaaugcuauuucauggaugaaaacucucugaaauaggauauuucgcuaccuaauauuguacucaaagugcuguuuuaaaucuggggcagacugucagaauaucugauaccuaguuuauuggguaauugaugaacccaauguauuaacauuuuauaaguaaaaagaaaaaaaucaagucacauauaugugcuuauuuagcauguauaguugucccucuguauacaugagagauugguuccaggaccacccacauauaacuaaaucugcacaacauaagucccagagucguccugcagaacccucauauaaaaaaagucagcccucuguaacacaaguuuuguaucccucaaauccaugucuaguugaaaacaaagccacauauaacugugcaguuccaaccuguguuguucaaaggucaacuguauauuguuucugggaaaaaucuucagcucuuuaucaacauuaacuuuugcauagcaaacauauauguaacucucaaauguaauuaacauaaugcagaaaaauguuuaauuauccacgauccuauaaccaaauauaacuacuuuaaauuuuuaaucuauaaucuacaugaauacaucaagguuuucuauacugaugaaacugccaguuaaauagcaauuccaccuccaccccaaucccacuauuuuaacaacccccaccgauacauauuuuaaagcauaucuucccacagaaaucaaacugugcaccaauccuuggagacaaauaucucuucuaagaaugacugcaaauaucauaauuaaagaaaacuaacaaacuugaaguucaaauugaauguguucuuuuccaugaggauagaaugcauucucaaauacaucacaagcacaacauugacagcugcaauuugaaaauuucacaguauaaaauaugugaaacaaaagaauggugggagagguagugagagaaaggagggugaugaucauccauuuuacaaaaacaugcuccacuuaaaaugauucauuauaguauuuuuuuuuacagagaagcuccaccuaguaacaaguggaaguuuuuguuaauuauacacuauaauaagagaaugaauuagacuauaauuauuauaguuuaaaauuuuaaacuuucauaugcauguaucauuuuacccuaauaaaauccuguaaguuacacauuaugucacaaguuuacagaagaggaaaaugaaguucaggaaaggugacugggccauccaggaucugaaagauaaaagagcuagggauagaugagucaggacuugaacugaggucuacucuuuccaaaucucaugcuuuaguuaacacaagcuuucuuggaacacucagaguacaguguccuuuaauaacuauuguccaaaccaaaagcuuuauaauucuuuccaagaaaagguuaucuaucuauacaaugcuucuaaccagauaauaacucccacauaguaguuuugucuguauucuauuguucaaagcuguaauuaccaaggaauguuucuggaaacaacaaaugcuuuuuaaaaaacuuuucaaagauauuuaaugagcaguuuauuccaaacaauaaaucauaauuaucucucaaaaaauuaaaaugaagcauagagauuuauacuauacauuguauauuauuucuuugggaaguauuuuuauuuaaaacaaaagauuaguuguuugauuuagauaguauucuagcaagcccauuuuaaaaaaauguucuuuuuccuuguuuuaaagugcuaugcuaauuagguuuauucauacaaaaacauuuauuuaccaaaguuacacaguuacaaaauggcauacauaaagguuaaacuuuguuuugcuuuuaaaccaaacagauuucaaguucuagaucugcaaaugauguacauaugaacuauaacaauuuuuuauuugaaaaauaauguuuaaaucuaacauuauuuucuacauauaacacugauaacugugguucacuguguaagauaauacaugucauuuucuucuucuaauucaauuuggaaaccaacuccaaaugaauagaauaugucagugaaauaucucauugaagaaggauuaacacaguaaacuguacuccacauuuacaaauaagcaguuucauuguuaaaagaugcuugcagcuucucauucucaccacagauuuucacuauauguccauuguucauagaggaccaugcugccuagagagaaaaguucuuuuaaaucgaguaaaaggguuuuucuguaccacaggauaaucauaagauugaguaccccaaagggaaucaagguggcucuucaauaauuuaacucucugcccugaacugacacauuaaauuaucauauacugugaauucacacccucugagaaaaaacauuuucacaauaccugaauuguauugacucuaaaagacaaaaaacgcaaaggcaagaagcaguuucagguacuugacuaaauaacaucuggguagauaaucaacuccagagaucuuucuaaagaugaugaguccaucauuuuucuaaguaagcaccuuaaacuaccuacaauaaauaaaaguagaguagaccuacacaauuauauuccagccaaaugccacagcccaaguuuuucucuuucacauuuaucagguuaugaucuuaauauaaucuaaccagaagauaacaacaaguuuucucagauucuaaaagagaaaaauccaacaaaggcuuaacuugguugguaguguuucacacagaacucauaauaauuccaacugacagcugucauacuaaaagagccaucuuaauaaaaaugaauaauaugaaauaguccauauuacauauuaauagggguguuauucaauuacuguguuuuaacugaaaauuaguccaaaagccuaucauucuguaggacagacugauucaggucacccguuacuaaauuaaacauuuuccgcuuucaaugcaucucauuaaacaugcaauugcaaguuuaaauaacuccaugcuuucauuuacacaaucacccauuuuguuauuguuuauagcaaccuaauuuggcacauaauaauucaggcagcauuggauuuguauuagacugaaguauuaauuuuuaauauaauugcauucuuuaguccaacaaaagcuaguucaguagggauuuuacucaugugagucuuccauuauuauacaaggcaaauucuuccaagauuuugcaccuuucuuugcccuacugauucguuucucuauaaauuaaaaacucauuauaagcuuaaacuagcuuauuugcuuaaacaacacagugaaugauuacacugguacaaaauauacggccuauacaucuuuuaaacaccuuuuucuuuuucuuuuuuuuaauuacuauacuuuaaguucuaggguacaugugcauaaagugcagguuuguuacauagguauacaugugccaguugcuuugcugcacccagcaacucguaauuuacauuagguauuucuccuaacacuaucccucccccagccccccagcccccaacaggccucggugugugauguuccccucccugugucuauguguuuucauuguucaacuccacuuaugagugagaacacaugguuaaaacaccuuucucuaaaggauauuugauuuaauaauuaagcaaggcauguuuuccuagcacaaugauauguaauuacuaaaccccacaacuuaacacaaagguuaauaaagaaacucuugaaacaucaacaaaauaaugauaacuaagaguuguuccauuaugcuuccugcuaccacaaaucucaaugaugaagauauuuggagcaauacauuaaaagauuaguuaacaugucaccccucaugugugggugaucacagaguacaauguacauacuugagaagaaaaaaaggugaauugauugaaaacaagaagaucaaggguaaaauauaaaauauguucacaagguaguagggccuuaaucacuaauuaccauccauauuguucaugcauauuuauauaucuucuacacgauggcuaauauauauuaauaccauuuaaaauacugguuuuaugaagaaaagcauuuuuuaauuuuacuuuuuuuauuuuuuugaaaaagaaucuugcucugucgcccaggcuggaaugcaauggcaugauugcagcuccuggcacccuccaccuuccagguucaagcaauucucacaccucagccucccaaguagcuggaauuacagguaccugcaaccacaccuggcuacauuuguauuuuuaguagagaugggguugcgccauguuggccaggcuggucucaaacuccugaccucaagcgaucugcccgccuugacuuccuaaagugcugggcuuauaggugugagccaccgugccuagccagaaaaacauauuuuugaaauaaauauguuaaaacuacacuuuucaguacuuauacuuaaguacugaaugaccacuaaaugaggaaauaaaauaauuaauuauagccaugcauaacuuuggcaauuuaaucauuaugugaaguguacuuacacaaaccuagaugguauagccuaccacacauguaggcuauaagguauagccuauugcuccuaggcuacaaaccuguacaacaugugacuguacugaauacuguaagcaacugugacacaauaaguauuugcauagcuaaacauaucuaacaugucuaaacauagaaaagguaaaguaaaaaucugguauaaacgauuuaaaaugguacccuguauaaaguguauaagcuccaagaauggagcuuacaggccuggaaguugcucugggucaaucagugagugaguggugagugaaccugaaggccuaggacuuuacugcacuacuguugacuuuauaaacacuguacauuuaggcuacacaaaauuuauuuuaaauuuuuucuucaauaauaaauuaggcugggcaugguggcucaugacuguaaucccaaaacuuugggaagccaaggcaagaggaucacucgaggccaggaauuuuagaccagccuggguaacauagcuuaaguuuaauuuuaauuaaaaaauuuauuaaaauuagccgagagugguggcacaugccuguaguccuagcuacucaggaugcugaggcaggggaucucuugaggccaggaguucaaggaugcagugggcuauaaugacacuacuacacugcagccugggaggcaaagugacccugucccuaaaaaauaauuuuaaaacaauaauaauaauaauaauaaauuaagcuuaacuuaccgcauauuuuuauaacuuuuaaaaucuuaaauuuuuugacuuuuguaauaacacagcuuaaaacaagcacauuauauagcugcagagaaauacuuuucuuuaaaccuuuauaagucauuuucuauuuuaaaaaaauauuuucuuuuuuaaaaaauguuuuaaauauuuuccuuaaaaacuaagacacaaacacacaaauuagccuaggccugcacagggucaggaucaucaauaucacugucuucuaccuccacaucuugucccacuggaaggucuucaggggcaaaaacaugcauggagcugucaucuccuaucauaacaaagccuucuucuggaauaccuacugaaggaccugccuaaggcuguuuuacuauuaacuuuuguuguuguuuaaguagaagaacuacacucuaaaaugauuaaaaguauagcauaguaaauacauaagccaguaacaguuauuuguuaucaugaucaaggauuacguaauguacaaaauuguuugggcuagacuuuuauacaacuggcagcacaguagguuuguuuacaccagcaucgccacaaacacacgaguagugcauugugcuacaaugcuaugacagcuaugacuucacuaggcaauaggaauauuucagcuccauuuuaaucuuacgggaccaccaucauacaugcagcucauuguuaacugaaacaucauuauguggcucaugacuguauguaaacuguaauuugaauucuacaaaagugggauuaagguacauuguccccuuggccaguucacuacagagcagaauaugguacaagguaauucauuuuuagaccuaaucaagagagaugauguuaacuaaaacaacaaaguagauucaaaauuuugggauggcaccuauaagguaaugugaaggucucuaccuauauuuucaugacaauauucuuauacacuucagaauucuauuuugcaaaacaauuuaaucauacuggguugugguacuuuagaaaauauguaagaauaagucauuuucaugugaaauaugaggaagaaacuuucucuaaaggaguauacaaucgaaacagguauuaaaaauuacagacauaaaauuauacuauaaauacgugacaauagagaauuuuuuauugucuuaucaagcuucccauuugugaauuuaauaaaaacagaccagcuuaaauuaaaucaguagauaaaugauaauuuuaaaauggcaauucuuacuauucuugauuacagcguaaauacaugaggauaaaaaaacaugauguuugaaaugagggauauuuggaaucaggaaugaaaauuccaggaagccaagcacuaugaaucucaguaaaaaagaugcccuucucuaguuaacacguaauucucaguauaauguaacaaguucauaggucaagaaacuuccauuaacuucuuuaaauucaucuauuuaauaacaugacaagcauuuaauuauggcuaauuucuccaccgccuuuaaguauaggauaaagaugaacaagucuccugaaaguucucucaucauaguuuagcucucugagguaaaugaaccucauaauauuccccguauauucaccaacaccuccccacaacaugauuucccucccugaccagagcccacugaaauacugacuuaguuguuguucuuuguguauaguacaaaugaaauuggugaaaacuaauuaaggaauuauucuucuuugucuuguaugaccaagucagaaauauuuuuuaaaaagcuauuaccagucuaaauucccuuuacucucugauucagggcuucauucauucagcacauugugaagaucuacuaugaacuaaauuaccaaugucuugaacagaacucaggaaggcuggugucuagugaauaagacauauacuuucuagaauaaguauaacauaacauguaaaugauauagcagacagagguacugguuucuacaggagaauucuuaauccagacuaaagaaaauaaagugaaacaucaggaaaucguuuuaggcuaaaucaucaaggagcuaguuauucagaugauucagauaggccauuucaggcauaaaaauucagaaacaaaaugcauuaagaccuucgggggaaagacaaauauguauaagugagaaagggacugcauugaggucagaaagguaagcaacgacuugggugucaugcuaagaaauaugauuuuacccugaagguuauggggauagacugaagaauauaaagcuggagagagagauaugaccagauuuggcuuuuaaaaagaucauguuggaaacaauauaccaguagucuguuaggagaugacaguggaaauuuaagugagaaaugaugagguccucagccaagguagugguaguagggaugcaaaaacaagaauucaaucaauaaauacacaguagaaccuacuauggcuggguaucauucaaggcacuaagaauaaaacaguaaacaaaaaucucaucccacaggaacuuauauucuaauggcacaaacaaucuauaaacaagauaaauaaauaauauaauaguauuucagauagggauaaguauaaaagagaaaaaugcuggaaagaggaagaggauauaucagggagugggauugaaaucuuauacagaguagccagggaggguuaguaaaggccugaaugcuaguaaaggccugaaugaagugaaugagccggcuaugagaagaucuaaguccagagcauuuccauaauagagaagagcaaguacagaagcccugcagcagugcugugcuuguaugagugggagaaaagaaaugggaguggggguugaagagaaggcaguugacuaugucuacaccccuuguccucuggacuucuaaguaaauacacuaacaguauuuauccaagaggcagaaacaaucucugaaauacccguagcaagaugucccuagcuaaugauuccuauaguaaacagaacgcaagauuuaugagguauaucucccuagauaauauuuucaacagauagaacugucuagaguauuaaauggagauguuucauaauuuaaauauuccugcuaugugaaguaaucccaugaacaucauauggagacuucaucugcucugagccagagaauccuguccaauguggaaaggaccuuggaagcugcccuggauauccuggaccucucucucauuugucuaagcuguuagaaugccuguaucuuugacauuaauuaauagaguuugauacugggcaagaucucuaaugcauguuuaucagauuugacagucugauccuguauguuugcucagagaggaagagcccaguguggcugcuauauugugaaugggaggagaaucauaaaaaaaaugauuucagaggcuuaacgaguagucagauaauauaguccccuguaagacacuguaaggccuuugacuucugcucugagagaggcgggaaaauauugaaggguuuggaguagauaagugacaugguaauuguuacugguaucuucaacaaauacuauaaggugccaaggacagaaauaaggagacuaguuaggaagcuguaauaaguagguuaaagauguugguggcugggagagguaaaguuagugagaaguaccuguauucugcauauauucugaagaaagaaccaaaaggauuucccaacagauuggauauaaaauaugaaaacaacaaaagaaagaggacucaaggauaaccucaaguuuuaugcccugagcaugugcaaggauaaaacagcuauuuguugaaaugaggagaaccaugggaaacagcuuaaauaggaaugaggaggaguucuucuuuggauauacuggguuucaaaucuaaguaaauaucgaaaugcugaugagaaggggaccauuggauauaugagucuggauauauaggaaagaagucugggauagacagauaaauuugggagucaucagcauaucaaugguauuuuuaaaccacaagccuggaugaaaucacuagagagucacuguuacuagggaagagguccaugaacugauaccuagggugcucuaauuauuagagaucaguaaaaggaagaggaguaagcaaagaugacugaguagcgacuagggaaauuagugaaacacuaggagcacauggcuuuacuggaagccaggggaagaaagcauuucaaggaagaaagaaugaucaucugugccuuuuuaacaguaaagaaaaacgaggauuaaaauuuguccauuggauuuugcaacaugcagguugcuggugaccuuaauaagagauauuuaaaaggcaaaacacauccccauuuuagauaucuaaaaauaauuccuaagguucuggcuaggauaaauggguaggugauaggcugcagauggacuuagugaguacaguuauaauacuccauacucagcuucaaaguaugaggaaaaacacccaauuacauuucuaacuaaugaaguguuaacacuuaaaaugaaauuuaaacacauuaacacagaaaaucagggggaaaagucucacaucauacaguuuacuauuuuuaaccugucucuucuuaaaaugagaucaugaacaucaccugacaagggcacgggcccauuuacaaacaaaauuuucuuggauuaaagggccuccucuguuuaagaggagagauccagauuuaggucuauaagcuugcccaacagugucaaauccucuggguacagaagauauuuccaaaucagacauuucugcuggaaacagcagaugggaauuuuguuuuauuuuauacauacccuuuuggcaaauauaucucugaaaaacuugcccugcagaaacuaauugucuaagcaagauuuucuuuuuuuuuagguuuucgcccaacaggaaucaaaucugugaauagagaauuuaaggcuggauagcagcacuauuuuugacuugauuacaaagcagaaacagagaagaccaggcacugacuggcuaguugcagggaagauuagacggugagauuggcauccagggaaaaugcacggccaacugggaggcugccccacuaccuuaaugccagggauacuagauauggaaacagccaaccauuuccagacucuguugaagaagcaguuuucucauauugguaaauguggcucaggguggauaaagggcuaaaucucccagaagugaaguuuugguacccacaguuguacagcaugauaugcuguagggcaggaaccaaugggaaaggacgcugauauacugaauucccccuauuaaauuccaauccuuuguuaccuucaucuuuaccugcaucuuuguuaccugcaucuugcaaauaagcaagaguuaacuguuuaaagcaagcaagcaagcuuguuuacagaucauugaaaacaauuaucaacuugaugagcuucaaagagcugugggauaauuuaguacuaaucuaaagagauagacaacauuucuaaaauguugcuuauuuuagcagaaaacaguuuaaggcagauuccuucccacaugguucagcugacagccagcugcccacauaaauucacgugaguacauucucuccaacugucucugaacauagaauaggcuauauuacuaaaagccuuuuucuguuggaaauguauucuauuaaacacuuuuucuccuaagccucagcugcacuuucaugagcaguauauugaacccaaaucaaaaucucuacuuuguguugagaucucugauucucaauggaaucugauaaauaucaauuugauuuaacaaaccauuuuggagcagugauaauuugucaggagcuguacuaaugaaaauaugcuuuagagaccaauucuuaucaucaaggauugaaggauggggugagcaaggacaaaggaaucagaaaaaaauuucauggaagggacauuauuugagauggacugugaaacauggcuaggguuucaaaggguagaagaacauuccuaaaagaaaacacaaugugcaaagacccagaagggcagaagcacugagucugcacaggcccaagaaaggucugcuuagaaauugcucaagauuucagaguagcagagugagaugauccagguuugauuuuuugaaaauuagacuaggggcaggauaaugaaagcucuaaaaauaugagaaagaaagagaaagaaaacaagcauuuguggucaagaaaagaagggguuucuguuuuuauucagggaaauuuaaaggaaaauagauuuuuguaggcauuacaggauuaaagucuacaugacuggguuaaugacugauuacccaagucagugaggccuucccuaaccaaucuauccuaaaaucacagcagccugcucucacacaugggggcaugccucuuuuagaguugauuuuugaaauagcacuuaccacaaccuaacauacuuuaaacauguuuaaacauauauuaaagcauauuuuacuuacuuaguuuauugucugucuuccuugaauauaauguaauauuuaugagaacagugacugcuguaucucuacaaacauaaguaauaacuaauucacuaaaugcauaaacacaugaaugaauauaaaaaugacugaaaucuaacacugucauuaaaagaaaccagggagccaggcacgguggcucacaccuguaaucccagcacuuugagaggcugagguggguggaucacuugaggucaggaguugaagaccagccuggccaacauggugaaacccugucccuauuaaaaauacaguaauuagccaggcaugguggcauaugccuguaaucccagcuacugggguggcugagacaggagaaucgcuugaacccaggagacagagguugcagcgagccaagaucgcacuauugcacuccagccuuggcaacagagcaagacuaugucucccaaaaaaaaaaaaaaaaaagggaucuagguucuaucuccagcucuggcacuaagaacaucaguuuaggcaaguuacuuuucuuccauaaagugcauuucccucaucuauaaaauugaggccuaacugaacuuacauacacccacuguaaaauuagacuaaguccccaguuaaauagcuaagacuacggcauuuuccugccagacaugugaaauugccacauuuuugucaugccacugcccucuuauacacauaguuaaaaucacuuagccagaaagaacuuaugaugcaauagacaugcuuccauuuaaaggaauguuuacaaacagcagcucuccuauuucuugaaucaagcucagcaugagcaaggucacagccucauucagaugaagaaagcaaagucaaggcccgggugucuuugaucaauuucucuacccuagcuuucccaugauccagaaaguuuguuuccccaaaggccgcccuuaacugauucaauaccauguuuucuggaugauuuugaucauaaguuuggucugaggaucacaacuacaaauucaauucuuccauauguccaaaauucccuuuagugcuaacgugcuauauuuccauaaauuuuuauagaaacuuaccaagcugugggguugauaaucuuucuuucuucuuaauacaaaugcaucaucagaauacgcauggucucaaacauaccuuuucugaggcauuaaaaaaacauagugauuuaggggaauuuuagguaauuugaauggguaauaaaaaacaauuguaaaguccuuugaaaauguaaaauuacuaagauuuauucaaugucauuauuuaaacauacccuaauuuguuauuauuuaacauuuguuucccaguuggucaguuauggcugaugagcugcagggugaugggaacuucaugccaucuguuucauugcuaggagcgcuagucuccccaggucacuuacugugauuauaaacauggccucaaaggaaacagugacuccaugcccuaagaggccagaagcucagauuuucuucucccaauucucucaccgauuuacugggcaacuucuaaggaggacauucuuaaccuugaauuaucuuuugacccaaucuuuaauagacuuaauagggguaauauuuuuuuucuuuuuugagcuuucagauuauauuaacuuuuuuucuauauacuauucuccagggguaauauuacuucucauccauaaagguguuugcuggauuaauuaaaauauuauuccaggauagaccacaaauugaaauguggaacaaugaucauuccuucaugucuaugaguucaugagucauuguauaaaaauagugucgguucauucucuguaucauuacagaguaucuuuuucaaagaagaaguaguaaauucuggcccauucaugccuguaugcuaucuauuuaaguaugguaauucaagacauuuuuuaauuggcacuaauuauaaauaauaaccccagcuucacaaaacaaacagaggaagcagucacugauacauuuacuuuagaauuagacaaaagucucuguccccaauuuucucacucaucaacacagcaccaccaugauguuuuaaauucuaccauuagagauuuaucucucuauguguuauauauuauuccccccaagacauucucuuuuaaaaagcugauaucccuaaaaggaguaggauauuaggaugcaaccaaucaauaacauugugugaagucucacaggguggaaggaacucaagaguauuagauguuuuguggauagcagagauagaaaagggaggcaggaguugucuuaagacaaacuucaccuagcucaugguuuugcccaggaacaggcuucagcuaugugguggcagcaauaggaaaacaaugccaaagagguaaacuugcuggguuucaaaaauuuuguuuuugucguuuaucuaauaaaaaaaaaaaaaaaaaaaaaggagccagaagcgaaaacuacauucccaggguagagauaugaguuaaacuucacauuucucuuuuuuuuuuuuuuuuuuuuuuuuuuuuuuuuuuuuuuuuugagaccaagucuugcucuguugcccagacuggaaugcaguggcaugaacggggcucacuaaagccucaaccuccugugcucaaacaauccuccucccaccagccuuuccaauagcugggaccacaggcgagcaccaccaugccuggcuaauuuuaauuuuucuauuuuauguagaaaugcaaccucacccuguugcccuagcuggucuaaaaccccugggcucaagcaauccuccuaucucagccuuccaauaccugggauuacagguaugagccacugcaccuggccaaacuucagauuucuauacaaacuauuaucuuuucugguccuugguaaauuggaggcaucugcaaauauuguccauuuuuuauuacuucuaaaguagguggagcaagguccaguuacugcauagggcacaaaaguaaggacaauacagggagagagggcucaggcucugccuaugcuacuucugccuacaacugccagugucugagauccauaccuagucaugaguugacagggcacuggcagggcagaguuuguggcgauaagaggcuucacuguaaaauuuuuuaucaaaagcagcaucugcucauuuaagaaacacuuuuaucugauucauuuccuugucccaacaaauaccagucuuuuucauauuauuauauugucucaucaugcuaagacacuauauaaauaagcauuaauaaaugcaauccauauagaaagacauuauucauauggaaagacugaacaaaugauagaauuuuuaagccaaaucaaguauauaucaucuugaaagacaugcaaguaugcaaauaaauguaaaauaaaguggcaaguacaaaaauuauauguguuugcuauauacuauggacucuccagaaacagugccacuuuuuucaucuuauaauuaaaaaauaaaaagacauauucacugacaaguauuauuaaacacacuaugaauacaguauuuucuucuguauguauaugauguuaaaugcaaguuuuaauuaaugguaguauguauuacaguuuuuuuuaaaaaaaaacaauguucacaucaugaaagaagauguaacaaauuaugaaauuauguuaucaaaauauggaauuauguguuuaaauccaguuaagccccaguauccuaucuaaaagaagaccuaucaaaugcaaacucaccacacagaaaugcuauccuaaaguauaucaucaaaauccacucagaaauuuuccuggaguugcaccauuuuuggcuaccuauaccugcucuaaggagaagcucuuaucauguucugauuugagaauaccucuuucaauauuggcuaacucuucuugucuuucaagauucagggcaggcaucacucuuugguacugcauguuauuauauuaaccuauacaaacccuauuccuauuguaccaucuuugugugugugcaugcaugugugucuguguguguguguguguguguguguguguguguguguguauccuccccacugauuugaaaaucaccgauuuucuuuuccuagugccuacaauguagcugcccuaauuaaaugggggaagagaaagcuggcuugccuuuuauuuaaaaaaauaaaaaacuauuucauucaaagaaaaugugucaagugaauguacuguagcacagauuccauuacuugaaaguuaucauuaccugucucccauuaugauaaacuucaguagugccuuaaagaaaccuuuucaacugaucugcuuuucauuuuuuaauaauguucaguauuauucuugaacauagugacagaaugcaauccuaggacugaagagucuaaauguauucuauuugucaugaguauuguauuuagugacuugaauucuuuuuuauguagauguaguccaucaguuaucuuauauauuuaucagaguucacuauaaagaaaaaaauuucuuuaaaaauaugaugcagaagagaagaaacuuuaugcuauuaugugagcaaauuagcugucaaaaccaacuuuaaaaggcuuaccaaauagcauccuacccuuuggaaaguaguugccaagguaaagaguuuaaucaaaguaauuucuacaugaugccuauauuucaauaauuuaugaacgguacguuugaacugaaaagaccuccaucuaauaaaaacacaaguauuuauuuguuuuuauuuucuuacucauagaauuuuuucuuuauuccucuaggaauauauaacaauuggauuuuguuuaugccaacuaacauggcaucucuaaaaugagcacuuaucuuacaugaacaauuuuucaaaaucuuaguguaaaguacagucucaggaccacauaacucccgcuaagacuauuauauacuccauuaacauacugauaugguuuggcuguguccccacccaaaucucaucuugaacuguaguucccauaaucaccacaugccaugggagggacccaaugggagguaauuuaaucacggggacaguuacccucaugcuguucuuaugauagugagugaguucucaugagaucuaaugguuuuauaagggguuuuucccccuuuugcuuggcacuucuccuuccuguugccauaugaggaaggacguguuugcuucccuuuccaucaugauuguaaguuuccugaggccuccccagccaugcugaacggugaaucaauuaaaccucuuccuuuauaauuuacccagucuugggcaguccuuuauaguacugugagaauggauuaauauacacacccaauggaagaauggacaaaagcugaauaacauaaaauucaucacaaauuaagacugcuuuuggaguaaaauaauguaaauuacacuuaugcccucaugcuguauuucacugcuuuggccagugguucucaagcuucaguguacaucagaaccacagggaaggcuuauuaacacagauuguugggccucacauucagaguuucugauauagaguaggucaagguuggggccuaaguaaguccaugucuaaauuccaaacauccaagugaugcugauguugcuggucacgggaccacauuuugacaaucaguggcccagguaacuacauccacacagaugccugccaugacuccaaauccaccucucaggaucaggcuuaucuauccaauugaccaucuggauaucuuggagagucccuaaguacaaaugcccuacauuaccuaaaaccuaucucagaaaaaaaugacaccaccaugaagcaaguugcucaaguuguucaagcuuagaagucauucuuaacuacuuucucucucuggucacauucuauuccuacacauguuuccaaccugucuacuucaucucuauuaccacacuaaucuaaaccagagucaucucaugcuuggaccacagcaacagccuccuaaucagauaaauacaaacacuccauuucuacuuuuuccccacccgaucuguuuucuguaaugcagacagaauaacuguuauaaaacauaaacaugaugacauuaaaauucuccaaugacuucuuauaucuuuuagacaaagucuaaaauccuuaauguggcuucccauaaccuccaagauaaagcccuuacuauaucucuucaggauuaucuuguguaaacucucccaccuaacuaugcuggccuucaaccacuucucauuuuauccucccucagggcuuuugcucaugcuaaugucuauaaacagucuccaccuugcuuuuuuagcaaacuccucauuucuuggaucucagcuuaaauggcaugucuaauacaaaccuuuccugauuccccaaaauaaauaaaucacuacuauauucucaaaaggcacuguacacugcuacuuuaguaugauuaaacacacugaaaauuacuuggucauacuacaacuauuuaccucacuagcuaagcuccacaaggaaccauucugucuuguucaacauuuuaaucucaaggccuguacagugcuucacacauaguaagugucccaaacuaggcacugauuggcugauacauagacuauuauaaaaauuuuuauguguuaauagagaagaggagcaaacaaaaguagaaaagagcugaccaaguucacagaaauguccagccaugggcuuauucccacaggacauccccaaccuuuucaauugggcucaccuagcccuuuucuuugggcccacacaccucagacucuaggaccaaaauuggcaauuggcagaaagauagagauuucaaagucagcuuuucauuuacccaguaagaucaccucagauuauaauacagaaguacauagcaagaguacagaaauuagcuaacugaucuagauguuggaggaggugacaauggagucuugauagaguauaaagaacauuacaaauggaagaaacaccuagaucaaaguccagaaauuaaaaauagcucagcauccuguaaucucagcacuuuggaagguggaggcgggcaaaccacuugaggucaggaguucaagaccagccuggccaacauggugaaaccccaucucuacuaaaauacaaaaauucacugggcaugguggcgggcaucuguaaucccagcuacuugggaggcugaggcaggggaaucgcuuguacccaggaggcggagguugcagugagccgagaucaugccaaugcauuccagccugggcaucagaauaagacuccaucucaaaaaaaaaauauauacauaccucagcaaugccgaaacauuacuggaacacugagguauaaagcccaaagcaguggaaauuuugggcugcacgagaaagacagggaucagaucauggguagccuuauuugacauaauaaggagguuaccaugagcucauagccuaacaggaaaaauauggaaaacuagacaucauacauaauaauaaacucuaaaauaaaggaaguggccggauauagaacaacaguuauccugccauggguauggggucaucaugaacaaagcauacaaacuucuaccuugaggaugcagggaggugcacgugcaauauugugagauucagagauaggggacauucauuccaccugaugaaggaacacuucccgagggagcaaggucugaaggggucuuaaguucuggauauacagagguuacgguuaggaacauucaaggcucaagcaaaaucauagccaaaaccacaaauauuacauggaauauuucuggaauuaauaauuauguuuggcuggagcauaguggcauaaagggaaggaaugaaaaggauauaaauaaaaguagguuugaucuuaauacugagaggaugcaaauaccaaagucaucaguuugauuuauaacaaacuccauuuuuuauuaagaacuauauauacuucuuaaauuuuauggaaacuaauaacuugccuacaguuucuucagucaacauauaauuuucaaagucuuucaugggaagaaaaugugcuucccuaaccuauucuuuauuuacucugccaaugacacccaaaauuauuacuuccaucuggguuuuaauuacaccuguuuuucccagggggaaaaaaucaauguaaauccaaauaaaauauaguagauaguucuaaaauguaauuagugauaauaaucaagcaauuccuacaggaaaaauuuacaagucucugaucugguaggaucaccuuuucaaaaugggaagucaucauuacauaauaugaaacauuaaaacuuccauuaaaaggaaggcuaaaaugagucuuaaauaagaugcacucauauuaagaaucuuuuuacaguaacugaagagaaucuuaauuauuuuacuuuacuugagccucucuaaaaaccuuauugccaguaauuugggcugacgaauguagucaauacagaagagccucaauuuuaacacuucucccucaaagccugucccucuugugguuuucugauaggcuauuguuagauucauuuacaguaaaauaauuaccagcucccuaagcaagacacauagcagguuaucuauugucccuuagaggacuguuggacuguucuuaacaagcauacuaaauuacaauagcagcuuuauugcaauuaacaaacagacaugaaucaccaauccaguuauaucucaaaagagagaaggguuuucugaaguauacugcugugguuguuuucugaacaacuguuuuguaauccuaaauucaaagacccguauuuaagcaaacaggcacaugucccaggagcaggcaacacagauagaauaguuuuucuuguuauucccaacagaaagaguaauaguauaaugauuuagagaauuaacagagugcagacaugaaaagauaccagcauuccccaucaguacguaaagcacucacgcuugaucauuuacagcucugucugcuugacaucuuccagucucugaucccaaagcaguagcaccaaggcgcaacucugcuucuucauuuacauugacauucuaaucucgagaugugucagaauuaaaguuggcaaguuuccagacuauuugaauucuuucauguugagaaaaaugcaauugcacugugcauauucauaggaaucccauggaggcucccagaggaucugcucacagagacaaggaauacaggucagugccuguaagucaaugagaccacauugcccacucauaagagguggagggacgcuaaugagauaagagacuuggcccaaaugcuucucuacaaauaacagcaaagcacucucacacaaacauuucuaccaacaaacucaaauauuuccgaggagaauuagcuuguuaaaaagaaaguuuauguucugaauugaauuccuaaugguuuugaaccagaauuacuguucccccaacuagcauuucuauacuugggcuacuuccuacaaguaauucacacuccaaaaacaguugugggggacuggugaaggaaagacaguaauuauacugaaaauguaauaauacaaaauucacuucuaacaaaucagauacaacuuauucagugugggaggugugcaugaguuauucacaagguaacacaauuaaguuuuaacauacaauuuuauagggauugcacugaaucgguagauuuaaugauaaugauucuuccaaucugugagaauggaauguuuuuccguuuguuuguguuaucuaugauuucuuucaucaguguuuuguaguucuacauauagagaucuuucacuuccuugauuaaauauauuccuaggcauuuuuuaauagcuauuguaaaugggauugucuucuugacuugguccucagcuagauuguuauugguauaaagaaaugcugcugauuccuguauauuaauuuuguauccugaaacuuuacugaauccauugaucaauucuaagaguuguucaguggagucugccggguuuucuagguauaagaucauaucaucagcaaacagggauaauuugacuuccucauuuccaauuuagaugccucuuauuucuuaauacuuucaacuuuuccccauuaaguauaaugucagcuguggguuugucuuauauuuucuuuauuauguugagauauguccuucuaaggccuagucuuuugaggauauuuaucaugaaggggugcugaauuuuacugaaggaaauuuuugcaucuauugagacgaucauaugguuuuuguccuuaauucugugucuguaauguaucagauuuaccaauuuacauauaucgaagcauccuugcauccuugagauaaaucccacaugaucaugguauauuaaucucuuugaugugcuguuguguucuauuugcuaguauuuuguugaggauuuugugucuauggucaucagagauuuuggucugcaguuuucuuuuauuguugucuccuuaucuggcuuugggaugagguugaugcuggccucauagaguaaguuaggaagaauucccucccccucaauuuucuggaauaguuccaagaggauugguauuaguucuucuuuauuauuugguagaauucagcugugaucccaucugauccugggcuuuuaccaaugucauuuuucacagaauuagaaaaaaaaaauccuaauauucauguggaaccgaaaaaaaaaaaaaaagccaaaguaauccuaaggggaaaaaaagcuagcugcaucacacuaccugacuucaaauuauauuacaaggcuauagcaaccaacagaguaugggacugauauuaaaauagauaccaagaugaauggaacagaauagagaacccagaaaugaagccacauaccuacaaccagcugauuuucaacaaagucaacaaaaauauacacuggggaaaaugccaccuuauuuaauaaauggugcuggaaaaaaugaauagccacaugcagaagaaugacuggacccauaccuccuuucaccauccacaaaaauuaagauggauuaaacaccuaaauguaagaucugaaacuaugaaaauccuagaagaaaacuugggaaaaacucuuccggacauuggccuaggcaaauacuuuaugaccaaguucucaaaagcaaaagcgacaaaacuaaaaauagacaaauaggauuuaauuaaacuaaaaagcuucugcacaacaaaaggaacaaucaacagaguaaacagacagucuauagaaugggaaaaaauauuugcauuugacaaagggcuaauauccagaaccuacaacgaacucaaacaacucuacaagauaaaaaaaaaauuaaaaagugagcaaaggaaugaacauuuuccaaaagacguacaagcagccaacaaacacacacaaaaaaaugcucaaaaucacuaaucaucagagaaaugcaaauuaaacccacaaugagauaccauuuuacaccagucagaaugacuauuaaaaagucuaaaaacacuguaauucuggcuauucagguggcugaggcacaagaacuguuugaacccaagaggcggagguugcagugagccgagauuacuccaccacacuccagccugagacagacagggaccuugucucauuuaaaaaaaaaaaaaaaaaagucugaaaacaacagauguuggcaaagaugcagcagaaaagggaacgcuuguaggaauuucaguacaaccuuuauggaaaacagaauggagauuacucaaagaacuaaaaauagaacuacuauuccauccagcaaucccacuacuggguaucuacccaaagagaaagaaaucauuauauaaaaaugguaacuguaauuuguguguuuauugcagcacuauucacaauagcaaagcuauggaaucgaccuaagugcccaucagcagaagacuggauaaagaaaauguaguauauguaacacuacauuaugcuauucagccauaaaaaagaauaaaaucaugucuuuugcagaaacauggguggaacugaaggccauuauccuuagugaaauaacuuagaaagucaaauaccacauguucucacuuauaagugggagcuaaacaauggguacauauggaccguggaguaaaagacacugaagacuaugaaaggugagaggaugggagaggggugagggcuaaaaagccaccuguugaguacaauacucaauauuugggugauggguacacugaaagcccagacuucaccacuacacaacacauacauguaaaaaacuugcacuuguauccccaaauauacaaacaaauaauuucuuugaaaaguuuuaacauacacauuuacagugcuucucaacaauuucugcccuaugguauauagagaaaauuauacucuuuauaugagacaugaguaaacaugguuuguaugugcagcuggagugaacuagccugggggcuccagccacucucaaacucuucaucucuucuccacucccaacaauuguuuuuguaaaaugacacacuuuuauugucaaaaaaacacagucagaucagauaguuuuaaaaaugaaugucaccauuuagagauaaccauugucaaugcuucacuaaaacaucauuccaguuucucucuacacauauacagacacaucaguugcacaccccaguugugaaacucaguaauaaggcaugauuuacacauauuuguauuaacgcuccaacugaagacuuuuucaucuuuaagcccugaaagugagaaaggaaaaccuaauaaaguaugaucuuuuguuaauaacauguuuuauaauuuucuagcucauauauauuguucuugcucuaccuuccccacauacacaaguaaucuaguuuucugugaucaaaacuauuuccuugaaaucuacacccaacuuguacccagaaauuagauuuaaaacucuaccucuaauccaacuuuuaagauaucuuguucuuaacagaauuagaaauauucauuuuaaugguuucuaagucaucaguucuaugagaaugaaauauuuucccaauccuuaagacaugaaacaugaaaaaaaaaauuucaaccacccaaauaauccauaaaaaucaauuaaccuaaguagucuauugagagcagguccucugugcaguuuugauaaucacagacauugaaaaacauuauuguauuugauuuuacuuuuuaucucccaauaacaaaucuuauacagcagaggcuauuuuauggaagugauaagguuuacgccagauuuucaaaauuggguaaaauguauaaaacagaagaauaaaagcaaaguuggaacuaauguggucuuagccugauucaaaaagcucacuguaauggguugaauagugaacccccaaaaugauaugccgaagugccaacuuccagaaacuguaaauaugaccuuauuuggaaaaagcuuuuuuguaauuaacuuaggaucuugagauaagaguacugugaauuaagaugggcccuaauccaaagacaaguccguugaagagaaggagaaacaaacagaaagacagagaagaccaugugaagacugaggcagcaacuaaaaagcuauuucuacuagccaaaggaugccaucuugagauccuaagugaauuacgaaaacccuuuuucuaaauauuauugucucaauuuuacaguuuugucaucuaugaaacuaaggcaagauuucucugacuugauaucacauaggaagggacaaagcaaagaucugaacucaggaagucgggugcaaaaacaugugcuuuuaauuacuauauuauaaccucuuuugcuugaagaacaaaguggaccuugggguguaaaggaaaauaaacagacauauaaagaggccagguuacagagacuucaaaauacaaaggauuuuguccaugaugcagcauauagagaacaaacauuucgggcuuuuaaugcauugcccaguucauugcauugacuccaucuccaaccucuaucuugaccuauccaguuuucuccaucuuuaaugcugacuaacccacuagugucaaccuucuuaguagucuccuacuucuacucuugccuauucaaacuauucuccacaaauaagccaggauuuaucuaucuuuuaaaaacaagucaacucacuccucuuaacaccaucaaugacuucacaggacucuugaaacaaaauaaaacuccuugccauacucuagcaaggcccuaaaugaucuggcuuucccuucgacaucgucucauuauucucauccaucauuauguuuuagcugucacagccuccuuucuguuuuacaagcaugccaagcucuucccuauucccgggacgucacauuuguuguucccucugcaugaaguccuuuuuucccaguuccugcauggcucauucacauccuucaggucucagcucacauaacaucuccucagaugucuucacucuucaccuaccuaagguggucucuuaaguuaucccaagauuguauuuauuacuaccaaagcccuuaucacagugugagaauauccuuuauauacuuguuuacugccuaucacaacacagaacagaaggcccaaggaggcagaaacuuuguccagcuuguucaccacagaaccacuguaccuaaaacagugguugguacacaucaaacauuuuagaaaacauuaguggcaagcaaaaaaaggaaaugucaugaugaacuggucuuccgagaaacuuggucuaggaaguaacguacaggaugacuucccaaaagcacagacuaaagaaacagacaaauuaggcgccucuuacuaaaaacuuaguaauaaguguuuaaaggcuuggauaagaacugauugaguaagaacaacaaagaaaggagugaaauuggccgggugcgguggcucaggccuguaaucccaggacuuugggaggccgaggcaggcagaucacgaggucaggagaucgagaccauccugucuaacacggugaaacccugucucuacuaaaaauacaaaaaaauuagccaggcgugguggcaggcgccuguagucccagcuacuugggaggcugagguaggagaauggcgugaacccaguaggcagagcuugcugugaguggagaucacgccacugcacuccagccugggcaacagagcgagacucugagaaaagaaagaaagaaggaaagagagagaaagagagaaagagagaaagagagaaagagagaaagagagaaagacagaaagacagaaagacagaaagaaagaaagaaagaaagaaagaaagaaagaaagaaagaaagaaagaaagaaagaaaaagaaagaaagaaagaaagaaagaaagaagagagagagagaaagagagagagaaagaaagagaaggaaagaaagaaggaaggaaggaaggaaagaaagaaagacagaaagaaaggacugaaauuuagaaacuugcagaagauaaaggcaauaaaauuuaguaaccccuuaaauacauaggauacagagacuaaaaaauguggcaagucaagaaacugucacaaaccucacagcuuagguuacauggaagacuuccauagcauuugaagucuauacuuuauauacuucauaauuuaaccuuuauuuuauccaacaggaccaaacacuaaguacccaacagagacacuugggaggcauaguaaacuucacagaggugccaucacccaagcugacccaaaaaauaaccaguuauuuuugucaaaacuaagaagacauuaaauuauuacauccacguuuaucagaaaauguaccaacauucuguacaccagcauuauauaaauggggguacucuguuauaagucaaggauaggaaaugacaucaaguggcaccaaaaacaaacaaauuugauuucauacagugaagagacagaucagucagagcaguaaacagcucuucucuaaaggugacaggguacuggaaagagaccacaggaaugguaggacaacuaagguuguuuuuauagaaaucaugaaauguuguuaagcuauagcaauaaauguagcauaauuguugcuaaguuauuuaguauuauuuucuuuuuuuaaaauacauucaaguguaccaugaaaaauuucaguauucaaagcuguguccaaaagagaaaauaauugggaauugcugaccuucaauauuucaagcauugugcuagguaguggacaaauaaacauuaauaaaacauagccucauaaagcuuauaagacuaauuggcuaugauggaaaacaagcacacacauaaaaaaauuauagaaagaagcgugacagaucaacuucuggcaugacaguaugaggaucuccacuguucuggucucccgugaaacugguuaaacaaauuuuuuaaggcaaaugaucuucagagcagacagcaaaugaagaaauaucuguucuuacaaaaauggaaauucgguaagaaagggaagaguaugguauuugaaccaagacugcucccuuacuccccauucccaguucagaaauaaagagggaacuuuuguaaugauaaaagagccaaucaaucaggaaguuauagaaaugauaaacauauaugcagccaauaaugaugcacuuaaauauuugaaauaaaaacugacagaaaugaagggagaaacagaugauucaacaauaauaguuggaaauuuaaauaacucuuuuuuugauuuuuuuuuucuuuuuaagacagggucucucugucaccuaggcuagagaucagugguacaaucucagcucacugaagccucaaccucccaggcucaggcaauccucccaccucaaccucccaaguagcugggaccacaggcgugagccacaaugcuaagcuaauuuuuguguguuuuauagagacuggguuucaccauguuggccaggcuggucucaaauucuugggcuaauaugauucacccccucggccucccuaagugcugggauuauaggcaugagacaccauggccuggccaauaacucacuuucaacauugcauagaaccacuaacuagacagaagaucaacaaggaaacaggagacuugaacaauacuauaaacaacuaaucuaacagacaucaguagaauacuccauccacaacaccugaauauacauuauuuucaagcacauguggaacacugcuccaggacagaucauauucuaggccauaaaaaaaccucaaugaauuaaaaggauaaaaauaauauauguucucugaucacaauagaauaaaauuagacaucaauaacaggaaaaauguggaaaaaucauaaauagguagaaauuaaccuacuccuauguaaccaaugggucaaagaagaaaucaaaaggggaaucagaagaaaaacaauuacagaacauugugguaaaugcaagaaugggagcuagcaaggagcuaaaugugcauauagaguugacacuaauucuaccuaggaaaaugcaagaaagaagaaaacuacagaacagaggaaguaacauuuaggcaggucuugaaagaugaauaugaauuuauguggcaaagacagggagaaagaaaaugaaaaacauggaagcagcuucccaaagcagggagguguugaagugaaugauaaaaucugaaaugaugagcaguuaggaguggcuagcauguaggguaugugguaggagaauggcagucgaggaagacgagcuggaaaaagagguuagggccagauuguuaauaaacaagaacacuacuccaaggggccugggcuuuacuuuggguaacaagacaucauuaaaguuguaaaaagagacaugauuggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaagagacaugaucagauuugcauuucauaucauauucuaugucacaguacucauguauauuaccauuuucuccucaguauauauaacaaaaguuuuucaagacagguaaaauacccuguaguucucauggcucugccacaguuacgggcucaaugcugggaacacugcagccaucuaaaaaaaacaguuacuuuuucacugcacuaauaguacaaaacuucuagauauauuuugcucauaaacugaagaacuguucuuuuguuugcaaauucaguuagccuugcugacuauucaauauaacugaaaaaaaucauaacuuguguuuccauagcuuuuaaugucacugaaagaagccuuaacauccucuucuccuucauuacuacauuacuacagccacccauuguggcaguuagacaaacgaagccagcauuuggagagagggaguaggacugagaaauuggccaagaaaaaaaaaauguauuuaguucauggaaaggaaacuugaagggaaauccaugauucuuagaaguggaagaguuuagggaggaauguuugggaaaaccguagugcugacaaugacuuugcuuaaggguagcaagagugaagaggaaagacaggucaguagaguucagaaugacuauaagcccggggcuuuaaaaauuucacaaauaagaaagguugcaggcacugagagcaaaaagaaaacuggaugaaguguugccauagaggaaagaaauccagagugaaaucucuagcucagcuaugacaauguacucugugagcaaugaaaguucaagggguuuuuggaauacuacaaaacuauccaucuuuaugguggacaaaaaguugcaaauacaggaaaacacacucacucuaccaggcauuggagaaaguagaacaaaaugcagaucuggccaccuaggagcucaaaucuaaugaaaagggagaaaugcaaauuaauaugugccaucagugaaacaaggacugaugaggcuguuugucuacagccaugagccacaggguggagugacugugcugaggguaaggaagagcuucucagaugaaugagaggaucauggagaauggaaaggaguuugcaccgacagcaucacauaauaaaggccuugcaaagagaggauauagcuuacccuaugacaugaaacaguguggcauaugaggaggaaaugaaggaacacaaggcaggaaaggccaucaggaugcaauuacagagggcuuuuaguacaauguaacagccuaacaaacgaccucaaaaucguaugaucaucuaagcaggacacccugugaggaaaacaaaaacaaaaauaaucagaaaucaucauuuacaaaauaauuagcaauguuuccuugggaaagaccugauugaacagagaaaagccuuuaaaaugaucagaaaaugaagggaagaggcaacacuaaaguuuucaaguuuggacugaagucuaugaaaucaugauaucauuaagggcguauucucuaaauuucagaacacuagcuuaaaggggaaucauugaaacuuaagggagaaaaaaagcaauucagaaucauacaagaauuacauaaaugcucaugcaauucaauuuucagugcuaagaacagacuuccccaaagcaguauuccccuggucaaauccucuagacccucaccaaucagaauucauuucucccuccucaagacuuccacagcauaugauagcacuuaacacagucuuucuugugucucuccaacuguaagucaauuuccugaggcuagagaccacacuuaauucauauuuguauacccaacaguaucuagauucaauaaaugcauauuuauguacugcaaaauauucacagggauacuauuaaauacaaaguaaugugcuuaauacuucugcaugauaaagaaugagagacaacaauaacccugaaaguccucauaucugguagggggguuauguaugaaaaccagucacuauaauccaaaaccaaggaagaagguucaaucaaagcuuacacuuguagguuguuauguuguuuuucauucauuaccuacaggauuccaaaaggauuuuugauagcuuacagaaguacauacaguauaacacuaaaaagacuaauuauugagaaggcacacauaaagaaaaaauaauaagagaagaagauggagucaggacaguucacgaaaaguuuaacagaaguacaguuagagaugcacuuggcaucaaaaccaacaguuagaagauucucagcaacaguugcucaggagaaguuuagcuauuccugacacugggacaggacaguuaagaacuuucuccuaugguuguucauaagacaaagacuauguaauauauggaccaucuccuuaagcauuccaccacgaucaacgcaauaaugacuuaacugagauugcguauuaaugacccucaaucugucaaugauuacaccacacuaccacucaguaaaagcaauucucaaagggccaaaacucuacgaugauguggcuugaauuaaaagaaaaggucuacucccuagcagaaugaacggauuacauauuccucagaaauauuaugcaaauauuaucauagagaccguuuugauaaggacaaaguggcauagaguuugagauuguggucuccgagaaaaaacaggaauauaaauauucucuguugucaauuaagggcauauugaacuuagagaauuagcagauuaacaaccagguuugcauuacuucaugaaaacaaaacagcagcauguggagaguaccccacuccuaagcaaaggaaggccaugauuucucucagaaaauggucauggauccucuuuaacacacccaucagugggugacugaggucccagagauguagagccuagucagaaugauuuagggauacacacuuuccaaggcaggcauucccaaucaccaugcuguaaaagaaaacauuugauaagacacccuuagaauaauucaaauuaggcaauguuucaagauaaacuggcugcaaaaugugcucucccuagagaagugagaugacuugcuccaugggguuguuacuaugaaccauaaaauaucagaggaucucugcaauugauuuuagagaaggugcuaugaaaccauucuuacagccaauaauuagauaucagaaacaauguucuuuaaagcccaccucaauccugucugugguaauaaauuaaugauaccagcauaagaaacaaccuuacuuuucucuacaugggaagaaaaauaagaaggagcauauauccugcucacuuaagugugccaagccauuacgauacaaaaugaaucucuaaacguacauauuccugcuuuaccugcucagaaguauuuacuaagcaaucaggaaaacaucugcaaacccugauuuugacugugguauuaagcaucauaacugcuacguaaagccaccauaaaggcuuuuguauuaaacaccauaacugauuuguaaaggcaccauggauggagggcaaaggauggcacuaauaucauggauacagauguaacuuacagucuuuuguuccacaaaaucaagaauccacaccaaaaaaaaaaaauaaacaaacaaaauauacuuuaaauuggcaauauuuuucucaagguauugaguaugaaaauggcuacgucggcuugcuaguuuuguucaaaguuguuaugaaauuaaaaacugccauacauucugauucgggcccagaguuggagggaauugaugauuauccaauaaaaaauguauauaagucuaauuacagagaacuagaaauguaaagccaaaaagacagcccuuugaaauagcccucaagcaguuucacagacaggagaacuuccacggacucccuucugcaugauggauaguuggaccaacagaaagaaauauuggagucuauaaaguuugcagcauuuaaucuugcuucauaaagcuggaaaauauaaucuauccaaauuccaaucaaagagaaucuggguuuccauaagcucaauaaugaaaugccuugcauagguaaacaucaaaaauuaccaacauuacauuucuaagagucacaugacgauucucuuguaauuuauuacagauuuuuuuuggcugguuuucguucuuacuguuguuuccaaugcacuaagauauauguuaaacaaugugcuaugagaguuucaaagacagcagagaucacauucaauuguagauaugcagccauaagcaggaauaaagauguggucaaagggaagagauauucuaugaaagaaauucguauuugguggauuuagguuauuuguuaauaaaauuaacucaagauggauuaaagacuuaaaccuaagaccuaaaaccauaaaaacccuagaagaaaaucuaggcaaugccauucaggacacaggaaugggaaaagacuucaugacuaaaacaccaaaagcaauggcaacaaaagccaaaacuggcaaaugggaucugauuaaacuaaagagcuucugcacagaaaaagaaugaacaggcaaccuacagaaugggagaaaaauuuugcaaucuauccaucugacaaagggcuaauauccagaaucuacaaagaacuuaaacaaauuuaccagaaaaaacaaccccaucaaaaagugggcgaaggguaugaacagacacuucucaaaagaagacauuuaugcagccaacaaacaugaaaaaaaguucaucaucacuggucguuagagaaaugaaaaugaaaaccacaaugagauaccaucucacuccaguuagaauggcaaucaauaaaaagucaggaaacaacagaugcuggagaggauguggagaaauaggaacgcuuuuacacuguuggugggaguguaaauuaguucaacuauuguggaacacaguguggcgacuccucaaagauguagaaccagaaauaccauuugacccagccaucccauuacuaggcauauacccaaaagauuguaaaucauucuacuagaaagacacaggcacacauauguuuauugcggcacuguugacaauagcaaagacuuggaaccaacccaaaugcccaucaaugauagacuggauaaagaaaauguggcacauauacaccaugaaauacuaugcagccauaaaaaaggaugaguucguguccuuugcaaggacauggaugacacuggaaaccaucauucucagcaaacuaacacaacaacagaaaaccaaacaccacauguucucacucauaagugggagcugaucaaugagaacacauggacacaggaaggggaacaucacacaugggggcuugucaggggguuggggggcuagggaagggacagcauuaggauaaauaccuaauguagaugauggguugaugugugcaacaaaccaccaugguauguguacaccuagguaacaaaccugcacauucugcauauguaccccagaacuuaaaguauaauuaaaaaaaaaaaaagccuggaaagacaaguugguggcaaauucugaaugaucuugaaugcuaugguaagauuuagugcuuaauuuguaagguaaucguuaucaugaugaacugaaccuggaccugaaauuauaaugagcaaauuaucucaaguuauucuuucugucgcuucaaagggauauauaaaucaaaaggccaauucugaaaauuuuaggaaagagauccaagcuauuuuguagacccagaaauaaacuuuauaccuacuguucuauuuuguuuuguuuuguuuuguuuuuuaagauggagucucacucugccacccaggcuggagugcaguggcgcgaucucggcucugccuccccagcucaaacuuuucuccagccucaguauaccuacuguucuuaugcuugguuguuguguuuuaagccuucugugaccucacggaaauuuugauguugacacagcuccagguuuuacauaaauuuaaaggccauuugaauuggaauuugauuaaugaacauaaaaccuaguagugaaguuaacacucucuuaacauccccaccacaaaagcaaagccuugaauugagucucacucuauucaaaucacucacauucuuauugcaaauuucaaaccuacuuauuaucugguagugucuucuccccagucugccacugcacauagaaaagaaggacauaguuuaauugcuucccaugcucacagcaguaaguccacaucauucuuaauuuuguuuuauaagaguuuuucuucaaauacaaacaucaugcuauugauccaccauuagguaucaugugcauuaaguggauuuccugggaguggggcuguugaauccuuucauacuccauugccuaucacccuuuacaaaaaucccucacugugcaacacauaauaugaggaauaagaaaaauuaggagaaauauucuaaauauauagaagaagguaaauagacugccuauauacuugguaaauucugaucauauuuguauauucguuggaauguuuuaaaugccuucagauguaauuuuaaaauauaaucuguguuuauuuaagcaugauugacuucuuuuuaaaaaaaaaaaaaaugaaugauuuaaauccuacagacccuacuuaugucagaggucagcaaccuuguagaaguagugugugccaagcugccaguuccuauuucugucaagcaagggagaaaagaagcagaagcccaaaauaggcaacugagaaauaucugugauacacagauaugugaggccuuucugaugaaucuauugcaaauugaacuuuugacccuguauaaauccccuuuuugugcuucauguuuucugauugcacuuaucacuauuuaauacucugucucucuuucucucucucucucacuauauauauauauacaaacacacacacacacacacacacacacacacauauauauauaucuaauuuucuauccaccucccaacuagaaugcaagcuccaaaacaguagagauuuuugucugcuuuauauucacuauaccuagaauaaugccuggcaccuagcaggauuucuguaaauauuugugggaggaaagaaggaaguguguucaaauaaagauccuauagaaguucuucaugugcauuucauaccuuacuaugugacuuuaauuagaaaccacucccucccuuaaaauccaaaugaggccagcugcuuaagaaauggauaucauuucuagauaaaaagaggcaguggaaagacacagauaguaucuugcaauuuggggugauucaaucagaaaagaucuuuugagggaaaaaaaaaguucaacaagaaacaccaagaagccuuugcagaagaccagugguugcagcagcagcucccaucaucuaaaugucuucuuuuucaaagggcagggcccuccugggcgauggcccacaaacaucucacagagucccuaaggaguucuaccaaacugaaugagucuccuaauuacaacauuaaaauaccuaccauccagucuuacuuuugacagauguccuuguacuuuuacagagcuuagagugaaagcaucuaaaaaaauguuuaccuuuaaccugguauaaggaguaauguaccuuuuuucuuccuucaguuuaaaauccauuccaccaaaaccuggccgucuacacacaaaauauaaugaugguuaucaggggccacaggaaaaggaugagaaaaauggugauuaaaggguacaaaauuucaguuagagggaauaagccuuagugaucugaugcaaaauggugacuauaauaaauaauaaugcauugcauauuucaaaauuacuaaaaagguagauuucaaauguuuucaccacaaaaaaaugacaaguauauuagaggaaggauuuguuaauuaacagauuuaaucauuccacauuguaaacauguaucaaaacauaauauuguacccauaaauauguacaguuaucuguccauugaaaauaaaacuaaaacaaaacaaaaaggcuuugcuaaaggaaucuccacaagcuuccaaggauauuugaaaaguucuaccuaaaucacuacuguggugauuuaagcucuuucuugccugucccccugcagugaagaaagaacagcugcucaucaucacucauauaauaucucuucacacacagugaaaccaagaaaacaaccauauucaaaaaugccugucaaaagacaaucguccugggaaccacucauggccucugugucuaugauuucacugaacuugaagacuguaauuaagucccuauucagacuucacuucucuaggcuaaauaaacccaauccuuuagacuuucaucacauagcagauuucucaaaccuuuuaauaauuucuguuggauuccucuggauucucuccaaauucuacauaauaaaaucaugaccagggcuucaggagaaaaagggaauugccuggcagccucuuaauguuauccucuuacauuuguacaguuuguuuuuccucccuaugugaauuacccugcacacauuucuacagagcuauauucaguagauguaaauguacucaguuuacauguacuaguucuuccaacuugccaugauuuuuuuuuugaaguguaauccucuuuuuguuuuccagaguacuggcauccuagccugguucaaagaaauugacauauuaugugucacuaaugaaaaggaaaaacaucaggcuaaagacugucaucuagagaguauuauucagaaucuacuuccacaaacuucccagggugggccagguggguuuagauuucaacucugccauuuacuaguuucaggacuguggcaaauauugaacauuuuuuggagaauaauaaugccuacuucccaggguuaucaugaaaaaugaauugaguuaauaauggaaagaauauggcagagugauacgugcucugcauaauacuauauauauucauuauuuuaucuucuuuauggaacaaccauuauaaccacuuugaacuacuuucacagcacaaugguaaaggccaagagagcucauuccucuauagaaugaaacucaauaugaaggaugaaaggcuggucaaaauaauaagucaaaagacuuaacucuuagcauauaccucaccauccugcuuuucagucagagcagcagcaaggacaugagauauaagcaaugguguacaccuaagaagugcagggaaacucaaaaaaugauaacccaguaugagcaaaauaaacuuagaaaccaaaccccugaauucggcucuuuccccaguguauugauugagcauuagaccaaaagacugaucagguauaaauuuaguauuuuauuuuagaaaagaauagcuuacugcuccaaagauaaucaaaauauuaauccuuuucacuuuuugugagagcaauuuuugauucuaauguuuuuaaaaggcauauagguuucaauauaaagaagcuacauauuauuucaaaugaaaaacaagaugaaaauccuaaguagaacagggcaaaaaauuaauaauguauuuuuuucaacgacuuuccugacauuugaccucuugguggggagucuacgcagcuagcaaaccaaauacguaccuccuucacaaaacuacuauaaaaauauaacuacuguuugacaaagcacuuacggauaugcuucaaaauugcugauugacaaggauauaauauuaucuguaguuuuaaaauauuuuuaacaaugugguucaaaaaacuuuccauguauuagauucuauguaauguaaucuuagcagagagaagucacauucacaacgugaauaaauaagaggagagcuaacaugcaauuucuuccauacaccaggugcucugcuaaacaccuuauacaccuuaucucauuuaauccucagaacacuuuaccacaagugaauggggaaauugaagcuuagagaagguaaauaacuguucaguguaacaaauuaagaaugauacucaggaauacauaaaucaagauauagauuucaacccaacccuauucugaucaugcaaucaaguuaguaggucaucacuagcauuuauuuuaauaggauauuaauagaacagagaaagaccauaaauaguaaaacagaauaaacuucuuugaaagucacugcucuaaaccacugcuauauuagaagcaacuaaacaucaaagaaacauuaaucuuaaaagcauucaagaauauucagagaucauuuacccuuaccauuucacuuuacagaugaagaaacuuaaaguuuggguuauuuucuuuacccauagucauauggcuaguugguggcaaaaucagaacaagagcccagggcuaacaaaaguauauugauuugagagauguauuauaaggcauaauuuacuuugaguuaaacagauuuuucucaauaauuacaccaggaacaugggcauaaaccuaaacugucucaggaaaaccagaaugagcaguauauagcucuagaaauuaaccaaaacuugucaaacaaaaguaaacauggugagaaaaaugaucguucaauggaaguuuuuucaaaacaauguaguuuuaauuuacauacagagcuauaaguaaaaauaacccuuauaucuaggcuguaauucuuuuuccguguuuuaauguuuacauaauuuaaacacgaaucuaucagugaaacaagaagaaaagauuauaaauuuugagcaaccguggcaacaaaaccaucaggaccuugucaaugacucacaaugauuuccuaguauuuuccaguguugauaccaaaacuggcaaggacagauucaaacuaaauugcugauacugugaaauaaugcucaccagaugcaagcgccauguaaugcaagugacaguuucuauaaauauaauucauaacuaauauuaauuuucaaaggacuuagcaaaaacuaaaaaaagaaauauuuuauuuucauauguaauuuucucagucaguauuucagagugaagauuaguauggguauuucuuaccccagcuaaguauaauguagcaauaaauggacuuuucaauaacugagaagaaaacuaauauuuuagccuaugaaaucauuauguaaauuuaacuggcuuauacugcagcccuuaugacuugaaacaucuguucgauacaaguuuucugauaauaugugaaguuucaaacugcauauuacagcauuuugcagcauauuuguaacaugaugguuuuguccuuuacuagauaggagacuuucaaggugugaccuguaacaagguacugaaguuacuacuuacuucaccaucugcucauauguauuuucaucuaaaauuacauagcauucauaacuauauuagaaaacugucuucacacaauuuggcacuuaauuuuauguguugauauauugccugagguccccaaugcaguaucaugauaaacaaggaccacagauaagaaccaaaaaggagauaaaagggugguaaguuggcaaaacacauaugacaaagcuuaaguacugaaauugugguacagcccuaaagccuucacacauagacuguauacucauaguuuagacacaaguugaacagauuaagagugcagguuucccuuuccacaaaagauuagaauaaguaaaauggaaaagagucacaagacugucacagagaagcaugcagcaaacaauacacaugaaauaugaauugggaagccagugaaaaagaaggagaaaucuuauuauacgguuauucauaagaaguccaaauaaagccaacaaaacucucuggcuguucuagcaggcguauaaaugugugcaaccauuguacuaccauuuuacauacacaaguaaaauuuauauauauauaaaaccaccuagagauacuuuuccacauaucacauggagcuauguauaaugaaauuuugucaguguuauuuaugauaguaauccaaaguaacaaucacuuggagguucgauaauaaaaauguggcauaucaacaaaaauuaacucuaaauggauuuuauacccaaauauaaaaccuaccacuauaaaacuuucggaacacauagaagaaaauuuucaugaauucugaguaggaaaggauuuauuagaaagaauguuaaaaaaaaaaaaaaaagcacuaaaaaugaaagaaacaaauugcuacacugaaauucauaaaaaugaaaagcuucuacucuuaaaaauacaucauuuaaaaaugaaaaaggccaucuauauaauaggagaaaauauuugcaauaaguauaucugacaagggaguaauaucaagaugugaagaacucauaacuuuauaagaccaauaaaccaucguuaaaaugggcaaaauaaucugaacagauacuucacaaaagaagauggucaauaagcauuugaaaagaugcucacauccuaauucaucugaaaagcaaaaacugaaaccacagugaaauaccaauacaugaaauuaaaacgacuaaaguuaaaaacugauaauacuagacacaaacagacauuucgccagagaggauauaaaaauggcaaauaagcacacacaaagauguucaacaucacuagauaauuaggaaaucgaaauuaaaacuaaaaugagguaucuuuacacaacuguuagaauagcuuuaaaaaaugguaaucccaaugcugguaaggauaugaagaaauuauauaaaucauacauuugcugguaggaauauaaaaugguacagccaccccagagaauaguuagaaauuuucuuuaaaaaaaaauagaaaacaaaauuuaacauacacuuaguacacacuuagcacucacaauacuaggcauuuaucccagagaaaugggaacuguccacaagaaagcaugcccauagauauucauaacagacuuuuuuuguaauaaucaaaaguuaaaaacaauccaaaugucuuuuacuggcugaaugguuaaauaaacuguguuauagccauacuacucagcaaugaaaugcaaaaaacuagaacucucaauacauguaacacaacaccuuggauggauaucaaaggcauugcacugagugaaaaagccaacuucaaaagguuauauucuauaugauuucacuuauauaauauucucuaaauggcaaaauuauggagaugaagaacagauuagugguugccaagggcccacaaaaguggagaggaaauggagaaaagggagccaaaagggaugcauaagaauauaaagggcuagaaugaggaaucuuugggauaacaggaaaguucugcaucuugauuauggugguguuugcaugaaucuacaaaugugacaaauuccauaggacuauauauacauguacacugaaaugaauccauauaaaacuagugaaaucugaauaaggucuguggauuguaccaacaucucuucccugcuuuugauacaguucuaaaauuacacaagauguuaucacuggagaaaacuggguaaaagaaacacaggaccuuucagcauuauuuuugcaacuaugacucuauuucaaaauaaaaagcuuaaaaauaaaagacugacaauauuccaaguguugucaagaaugugaaggaacucaaacucuuauuuguuacuggugagacugucacacaaucacuuuauaaaacauuuuggcaguuuuagaaauaaaguuauuauauacuuaucacaagacucaggaauuccauuccuacguauuuaccaagagaaaagaaaacaugacaacacaaugacuugugcauaaauguauauaccagcuuuaaugauacuagucaaaaacuagaaacaacgaaaauauccauaaacaggugaauggauaaacaaguugugguauauucccacaaagaaaaauugcacagaaauaaaaagaaaugaacuagucauucaaacaacagcauaaaugagucucaaaaacaagcugaacaaaagaaaccagacucaaaaaguguauacuguauaaguccauuuauacaaaaucuaguuuaggaaaaaugaauccacugugacaaaaagaucagugauuucaugcagccagaagcaggauuuacugguaagggguaccaggguacuccuucacaucuuggggugaagggaauauucuauauauugauugugauguugguuacaaaaauguauucauuugucaaaacucacuauacauuuaaaaugacauuaucuuauuauauauauuauaacuuaauaaaguugaaaauguggcguaugcuuaaaacagaauaucaaguagcaauuaaagauuaugaauuuuauguacacauggcaacauggaaaaggaggaaagaaccaagcaggauuuauagcacaauacuucagcauuaauggagagggagcuuauuauacuggucaaggagguguggacucuagaaccagacagccucagcugaaauccuggcuccacacuuaugaguuacauacccuugggcaaauuacuuaaucuuucugugccaagagggauagcaguacuugccacacaggguucuugggaggauccgauaaauuaauguugcuaaaagcuuaaaacagugucugggauuugaaaaaugcuauguaaguauuuguuaaaaauauauaauaaaacagcugggccaagcacgguggcucucgccuguaaucccagcacuuugggagacugaaguggguggaucaccuaaggucaggaguucaagaccaggcuggccaacauggugaaaccccaucucuacuaaaaacacacaaaaaaaauuuagcugggcaugguggcaggugccuguaguuccagguacucaggaggcugagacaagagaaucgcuugaaccagggaggcauagguuacagugagccaagaucgugccacugcacuccagcagccugggugacagagcgagacucugccucaaaaaaaaaaaaaagcagccgaucuuuuuuucaaggauauacauauaucuaaauaaggugauggagaggaaacuguaaggacauauauuaaauacuuuacauacauauucaaugcaagaagaagaaugcaggcaguaugaaagaaaaguaauaaacuaaaauaaagggguuaauauugaucaguaaugagugucuguuauaagcaaacauagucugugcacuugaagucauaaaugggagaaaguacagucaaaaggcacaacuaucaggacuaacuuuauuuaaggacaagccuacauaccucacuauuugucuugaauuaccagaaccauaaauaacugguguacaaugucauugagacuuaagaaaaagagacaaaggcaaagacagaaggcaccaagacaggguacaguuaaaaacacacacagacaaaugccaaauacauuugagaaagaguuuccaucauguucauaaguaggauauuauaacaagucuuggacagcugucauuaugcauaaauaauguaccacaaaauugaaagcuacaugaacauagaaccggccagaauaccaaacaguggugguacacaccaguuaucacuaaauagcuguuaaucucauucaauaaccaucacugaaugccuacuauaugcuagguguucuaguaagcucaucaaauaaauaaucuucaaaaugcaacauagaauucaguggccauuagaaaaaucaaacaagaguuugucauuuucagaagcaaauacaaaacuauuauuagugggguuuucccagauaauucuuuaaagguagcugaagcagaaaaaaaaaaaaaaaaagaaaugcgugauuaucuacuuaaaaaggacacaaaguggaucuuuugaaaaauaaaauauuaaacuuauuaaugagauaacaguuuacuguaguuucugaucauaagcaacaugcacacaaaagaggaaucucaugugugaauuugucuuuuuuuuuuaauaggaaggauucugcagcuaccaugcaaagauacuugcauauggucuguuuacacauagaauuuauugucuagccagggcccauuuuaaaaagaaaagagaacaaaaggacuaacggcaauauacaagcacaaaugaacaagggcugcauccuugcugacgaaauugcaguaacuacaaguaaggaaaguaauuauuucaacagguaucugaaauaaaagcuggauagacccuagagaaguggaguggaauuacaguaaaacuuauuuugaaggaaaaaauauuaagacaucuauagacauauaaguaucucugacauucucaguuaagagguucuuaguugaguaagugauacugguccucugggaucaggucacagacuuacagagucaaaugccuguaacaaguaucacacacaaccuaaaacacuccuggauaacauccuguacuuuuaagugcagagauuuguuugcagcuuugcugagguccucaauucuguuugcauagcagacccaccugaagaucuuucuaaaaguacagacacggaccccaccaguuaaaucaaaaucacuagggcuggaagucauauguugucuacuaaucagccaaaauaaugaguaaaggguuuuucuuuaauuaaauuuuuuuuauuuugagauaauuguagauucacaugcaguuguaagaaauaauacauagagaucccauguacucucuagccacauugucauaguagugacaucuugcaaaaauaugaugcaaaaucacaaccaugauauuaacauuaacacagucaaaauauaaaacaauuccaucaccacaaggaugccuucuguuguccuuucauagacacaaccaaacuccuuccgcacccauccccaacuccaaguccugacuccgggcaaccauuucauaauuuugucaugucaagaaucuuauauaaagguauucacuugugaccuaugugcauuaguuuucuuugaugcagaaaaauucccuggagauucagccagauuauuucauguaucauaccuuuccauugcugaguaggauucuagguauauauguguacaauuaauuucaccacugacaguugcagaacauucaggauguugccaguuugggcccaccaauaaaguugcuacaaacauucauguacagguuuuuguuggaacauaaguuuucaucacucucagauaaauacacaagagugcaauugcugggucguaugguaauugcauguuuagguucauaggaaacugccacacuguuuuuuuuccagaguggcuguacaauuuuguguauccuaucagcaauauuaugagugauccaguuuccucacauccucaccagcacuugauguuguuacuuucuuauuuuagucauucugauagguguguaguaauaacuuauugugauuuuaauuuacaucucucuaaugccuaaugauguuguacgucuuuucauuguacuuauuugucaucuguauaucuucuuugguaaaaaguuucuucuugucuuuuguucauuuccuaauugaauuguuuauuuuuugcaguuagguuuuaagaguuauuuauauauucuagacacuggggguuuguuuguuuuguuuuuuuuuuuggcaggagauaugguuugcaaauauuuucuccaagccugcagcuuugucuuuccauucucucuuaacaagagucuuacacagaacaaauaaggcccaauuuaucaaucuuuccuucuauggaucaugcuuucagugucaagucuaagaacugauugccuagcccuagauccuaaagauuuuaaccuauuuuuuucuaaaaguuguauacuuucauauuuuguauuuaagccaaugauccauuuugagcuaauuuuuguagaagguaugagguuuaggucaagguucauuauuuuaccugugaauguccaguuucuccagcaucauuuguugaaauuucuaaccuuccuccauugaacuauuuggcuccuuugucaaaaauuaaguuggccacaucuguguaggcuauuucuguguuucauauacuaugccauugaucuaugugucuaucccuccaccaauaacacauugucuugaauacuauagcuauacaguaggucuuaucaaaaugguuuuuaaauguaaauuacgccaugucaguuucaugcuuuaaaaaaaaaaaaaaaaaaaaaaaaaaaaaaccuuaagaauucccugccacaauuagaaugauauccugacuccuuauccaggcucacagagcuguacaugacuagauucaccagccucucaggucacaccucacacugcacaggcccaggucaguacccauuagcaucaccagucuuuuuguucucugaguacaucuuaguaacuucacuggaaugcccuugccccagauuucuacaagguuaguucucugucaucaguucucaacuaaaauguuaccuccuaaaaaaauacuuccuugacuauccaagcuauacaaacacccaaguuuaauccucuacauaucaguuagcacuaccugaaaauuuuaucauuuauuuaccuguuguauugucucccugaccuccugaaccaaaauauaaguuucauaugaacaggauccuugucugccuuguucagcagaccagcacauagaauagugcuugacgucccuauuuaugaaguguggcaugaauaauaauaaguacagcaauaacaaaaacacaucuauacauagcacuugucuaaaagcucuuucgauaacucugugugugugugugcaggcacaugcgggcucauucagucuucaugauaacccuaggaggugcuauuacuguucccauuauauaaauaaaagaaauugaagcacggagagguuaaauaaccaaaucaagguuacacaucuacuaaaagagcauuagucaucacacaaaaaaaguaaugaaauaaagaauuuguuuuucucuuuggcuuaucuuauggagauuaugacaauuaccaaaaucuuuauuaccuagaaucuuuuauuuggugacuuauaguuuaaguuccaaagaaaaauauugccauauaaggaaaggguaugacauagaauacaccugaaagagaguuuucuuaauaugacucguuugugagauaauuucuggggcuaccacaucccugguuuuacacuagaguccagugaccugaaccuccaauacugaagucacuaaauuuucuucacaaaauaacuguauccuacuagcaucaagacagcacauuacacugccaucuugccuccauccuugaaauuuuagaaagcaaaauauggccucauacaaauaucauuuggaauucugaaacugcaaagauacccaggacucaaauguuuaaaaacccaaaugcauuucuaaguauacauuuucccccuuagauugccuuguucugcucuaaguauccucaaagugcuuugauuuuuuuucucuaagugagcuauagaaaucugaaaaguuaaaauagcauguauucuuuacagaucauuucaucauuguaucaacuaguaaguauuagcaauuuauaacguaugaauauguucucacucuuuccuuaaagagaaaaucacacagacaucagaacaaugaaucucuggcugaauaaauuuaaaaguucagucucauaaagcaaauuuuuuguuuguuuacauauacucacaguuuggaagcaaucaaucuugauuauuuauuucugcaaugcuuuuacuuaccucuauaagugcuuugggauuugauuucuaugaucaugacuaugcaaaguuagggcauccuauauuuuauuuugugggacuccuuucauauuugugaagaaauaacuuaagguugauucucccauucuuuaaaacuacaccugauccauaugucagaaauaauaauggcaaaaacaaggcaauuuuucaaaacugaguugacaguuuuugaauauuaagcuucccaaagauaugggcuucacacauuucucuguacaauuuuuaaaaaggaaacacaaaaaucaaucucaccaccuuuacuaggguucuucagggauuucauaaaugcuuuuuggugagaccucaucauuuaaugugcaauaaaagaaaaaaaggugugauggaaggaacagaguugagggaacaacuacuaaaaccacaaaccucccaaacgaacuuuacucugaacagaauaaaauacccuauugaauacucuaaccaucaguuguauaggaaaagaaaaaaaacauaaaaauuaucucauacauuaauggaaaguuuauugcaucagaaagaaaaugaauuuccauauacuguuaauuucauacacuaaaaugaauugaagaaacuaauuauucauaacgaauauuggccuuugggaaacacugcuuccuaaaaggauuuaauggucaaagcuugugugaauuauuaucaugaauuaaacuaaugaaaggaugaagauauuguuaacagaaguucugaaaugcuaaccuugccauuucugucaugagaugagaaaucaauguccaaauaacaugugcaguuaaagcuuuaacaggaaauaagugccacagaaucuacagaaagagguuuuuccuaucucucaacaaaaaauauaugaauggagguaagguggagaaaggggacaauaguaaaaaucaugccccaaauggaaaugaaauuagcacccugagaaugaauugagaagaguaaaaauuaacguucagccauuuguagaauauugugagcccauagguguguauauauauaaaauguguauauauacauauauauaacguguguauauauauguguguguguacauauguauaguguguauauaaaacacauauauggguguauauacauauauaauguauggguguauauacauacauaauguauggguguuuauacauacacauauauaaugugugugugugugugugugugugugugugugugugugugugugugugguguauccuguaaagaggaaauuaaaccaucugaauuaucagugcccaaaaucaagaugacccacauguuacuuuaaaaaauauauaauuagaagggaaauuuaagaaaguuuaaaccuuaccuuuccuauuuuccucaacaaacaaaaagaaacaacaaccaacacauucaaaaaaauugaucuacuugacacugaucaaaggaaagucucggaaauaagaauuugaaaguauaaucuaccuaagagagagggcucuuuguuggagaaaguggcuccagauuucagauuuuaguugaugacaggaagugaaauaagaaaacucuuugacaaguguaugaauagagaaacuuugucuuguuuuuuugaugagguagguuguuuucuuuugauuugcuaugaaauggcaucuccagagucuugcaaggguuaagaagagugggaagcuggguaggaaaaaaaaauccaagaagaguacgagcagaguuggagagagggcuaaauuauuagaaaaggaauggcacuuuguuuagcaacccagaauagcaguagugugaagcucagugggaucagcuggcuucagggcuuuacaaagaaauccauuucccugagugcuaaauauuuuuuuugagauggagucucacuuugucacccaggcuggagugcaguggcgcgaucucagcucacugcaaccuccgccucccaaguucaagugauucucccgccucagccuccugaguggcugggacuaauggcaaauuaauaaauuagcacucugauuuauauaucaguaauaccagaggcugcagugcaguggcacgaucucagcucacugcaaccuccgccucccaaguucaagugauucucccgccucagccuccugaguggcugggacuaauggcaaauuaauaaauuagcacucugauuuauauaucaguaauaccagauaacauauauuuaugaauuuguuuggugagucuauccuggaaaggcuaauaaacuuuaaaauaaugaagaaucagcuuucagguccugugaagcuaagaaccauauccuagaaccuggucuuagaaccaacacacucccugugagaaugucacuaaccuggaugaguucuccauucuauuguucucuaucugcauugcuuuacacaaaaagugguugauaauuagguaaacuagcuucugaggaaaagugguggaggccagaauagggcaagggaauggauggcugcugauaccuucuagaaacuaucacaaauuuuuauaauaaaucucuaaauaucaugaaauguaaaaaagauggcccaaauuugcaaggaucacuuugauaucuuuguuuaaauaaaauuuauaucaaaaugugugcaaugacuaucuuuuccucuucuucauucuauuuuacauuucuaaauuuuccaaaguacauauauacaauuuuaaucaucaaaaaaauuuauaaauucacagaagauuuuuagagcagugaaacuacccuauauacucuagcaguggauacauguuauuacaaacuuguccaaagccauagaauguacaacaucaacagugaaugcuaauguaaaaugugaaauuugggugaugaugugucaaugucaauucaacuguaacaaauguaccaguuuggugggggauacugauaaauggggaagucuaugaauguaugggaacaggaguagguacauagaaaaucucuguauguuccguucaauuucucugugaaacuaaaacuucucuaaaaauuaugucuauuuaaaaaauucuagcauaaaucugucuuuauuuauuugguaucuaugucaacaaauuuucagaaauauuuaaaggccuuucauuuuuauauaugagaucacauugauuaucacuggacucuguguguguguguguguguguguguguguguguguguguguguguguguccaguuuuaaagcagaaaagggguuacugacugggaagcuguaaugaugagaucucuugauaaaguaaugcaguguaagcaaucuuuagagacucuuucaauuugaugauguuuucugacuuuuauccuuugggcugaaucaagaaaaauaaaacaauuuacaaaacuaagacucugcuacccacagcaaaugggggaggcagggaagacuauauugauugucaauauauagcaacauuauauuuuuuaaauuuauccuuaugaaaauuaucucucauuauuaaaagagcuucucugauguuuaaagaacugguuaacuauauucuauauagauauauauuacauucuaauuauauucuauauauauuuuucuaucuauuuucuuuauauaguccuuaguuuaucauuucuguccauuuucuacacaaauaagaugggaaccucaaaaaaggaaauaagcaccucuauuauacaaucuuaaauuggguuagaaaacuuaguaccuuacuuuuggauccuaaaaaauauuuuauugauauauuccagaauuuaagaucuuaauuuucuuauauauuugcucuaaauggcacuugaaauaagaaacuaaagagugauuaauauuuggccaauguuacaugaauguuacuauuuaucuuguuauucuuauuuuaacaguauuuaccaauacugucgagucacuaaguuuugauuuuugguuccacuccuucuaguuucacuuaugcauuuuaguccugaucuuugcacuaaacaugcuuauguguaccauauucuguaauaaaauauaacuaggcaaaaacuaugauuaucuaccucgcaguagguaaaaauauagaagguuccagagugauacuucucaaaauuauaucugcuauauauaacauauaaacuuugcauaaaaacaauauaccauuauaaaauauaauuacauacauuuuauauauauaguauuuauuaaaucgagaaaauauuuucaaguuacuauguuccccauaaguuuuaccauauucauaauuuacaguuuguuuuuauuccuugagagaauuuuuuuucuuacuuggaacuauuuccuauuuguuccaauuguguuuccaacuuccuuagaaauggccauagcaauacaauuuuuauugauauacuagcucauggggcauuguuucuuguuguuagguguaaauccaguaauaauaaaaauaaguuccauaaauacaaaacaguaaaauucaaccaaaaucaggccugauauuaaggggauuugaauacauauacagaauauaauugaacacuuuaagcaauucuacaaauuuuaagaaauagagauauagauugagauuuucacaaacuaaaacaauuauagugauauaguucaacucagucucuuaacuuacaacuaugcuugugcguaucuguccaaauucaauuguauuucuggccuauaagauuauuugcuucaaucaaccaacauagagaaaaaaaucccaggcuaaaaaguaaauauaaugucuacacuggcaguacccuaucucacagauauauugugacaaaaucuuacuauuaauaucuguaaauauuauacaccuuucaugaaaauaugaaagcuaaauaaauauauaaggguaaacaaauaaaaucuaaagguaaaguuuuauuuggugcauuugagaaaaauacaaaagaaaaggaaacuuugggucuuauuggugauguaggaaucuggagauugaagacguaggcaguggggauagugcaggagugaaaaaacaagcaguuacaaaaaauuauuuaaacuugccaucuuaauguaauaugcuuugagucggccuuuauuucuauguauggagaacaaaaaguuucuaggcagaaaaauauuauaaaauugauaguacagacagugaacuacuacaauuuaaaaacaucugacucuuucuggccaaucuuacuuuaaugguaucaucauacaaaagaaagaaaauuacauggaacaaaugagaaaaaaaaguaccuuugucauaaacuuucaaauauaacauuauaauaaaaaauucucaggagaaauuuugggggaaaaaaagauguauucuucaauaauaauuuaacuuggccuaaauucaugagaauauccuccaguuuugcaaacugccuucaauuugcugagaaccauucuuuuaugccagcuuaaaauaagcaaagauuacacaaguaccaugugccaccuuaaauaaggaaagggaaaaaaguacaauaugguauuuaaacagcugugugaagauacugguuaaaacaagaaucauuuuucagcugagcuuguaaugcuucauuuugcuaaauuuaaacuagugcaucauuaacuuaaccacugauuuguagaauaaaguacagaaccgcaccugcauauaauccaauaaacacaauaauuuuucaaaugguugugaaauugucauaauuugggaucaagauuugagagaaggaagaaaaaauaagaagacauuauuucacagauguacuggagaaaauacaauuguuuucauuauuugcaguuuuauuugagugagcugacaaauguacaacaaacaguacacguggaaacacacuaguaagaauucuaugccaggcaauuagugaagaugauugcaagaaaucaauuuuuuggaaauaaacaaaaauuuuaaauguuauauggccaguuuggaugaguauuauaaguaaaugagcucaaaccaguuaacgaaauggaagaaaacagagugugugcucaaaauaauuuugcucccaaagguccauaaggaaccauuuaguauaucagaaguauucauuuacuaugugguaucucccuggucaaagaauugauacuuuuucacauagauucacucagucuugucuuuccacuauguuagagguuuuaaaccccaccgaaaaguucaauagauacaauauagggaauaugauucauguauuuggaugaaaaaaagaucauaugcuuauuuucacuaacaauuagcuaaaaguuuaaauuucccuuuauuaagaaugcagacaacaaaucacaguaguauuuguuguacuugugaccgacagaaauaauauauauuuugaaauauuguuacacucaucacuaacuccaaaauuauaguaccuguuagaaguaaugccgcaucccauuacuauuacuauucauguauuacuauuuuagagauuuuaaaauauuuugauggcacuauuucaauuuaguuuauuuccuuuacaauccuaugcauuuauuuugugcauuaauaacauucuggccgggcacgguggcucacaccuguaaucccagcacuuugggaggccaaggcggguggaucaccugagguuaggaguucaagaccauccuggccaacauggggaaaucccaacucuacuaaaaauacaaaaacuagcugggcaugguggugugugccuguaaucccagcuacucgcggggcugaggcaggagaaucgcuugaacccgggagguggagguugcagugagucgagaucaccacugcacucaagccugggcaacagagcgagacuccaucucaaaaaaaaaaaaaaucuaagacuuuugaguucacaugcuuaauuuuuuuuuuuuuaauucugagacuggauccacgaacuucgccagauuggaaaagggguccauggcacaaaaaguauuaagaaccucucauuuucaauuuggcacauaagauaagggaaacguagggagacaagaaacucuauagcuuaaaauuaacuuuuauguuaaaguuuuguuucuguuggucuuuauuuuuaauucuggaagagcaaucauccuaaauuaagccaaucaaauacauauugcuuuaagcacuaauuaacaccuucuucuucuaccuuuuauuaguucuaagaaauguucuuugguuuaaaauuuuccacuaauaauggaaaaaguaugaaauuucuuauccuuauuuaaccauuuuaaaauuaacuccaauauguacuacauuaugacagagcagauuuuacaucgcccugacaguaaaguauacugcauucuuggucagaugaauguaaugagcuucuuguaauccuggcuaauugauauaggaaugggggaaggauuugcaagaucaauagccguauaccaagugccagagacaagaaugacuggcucuaguaaaaaagaacacaucuagaagaguaucuccaaucagaauugcaaccugauuaaauuuaaaacagagcauuaugguuucuaacgccuauucuccuuugcgcaaggcaaguaggugaguaaaaugaguaugugcuaaaaaucucuuuuaaaauuuuuaaguauuuaauagcagcgguaaucucugacauuucucuagugaauuuacugcuuuugauuugcucuccuggaugggagaacaguuccagggcuuuccacuuguccccuucuaccacaauauccuucauuccaugguucagaaagccaauauggacauucugcaagcuacagaggauaucuagucaagguaagcauugaagaacuggacaaugaucacaagguagauaaacaaacucccuggaacuacaguaagaguaauucaaguuacaaagaaagaaaaaggaaaagaacaugagagaagggaaagaaagaaggaaggaaagaaggaaggaagaaaggcaggcaggcagggagggagggaucauuugguccccauaaggucacacuuugacaagaacaauggucaagcauuuugggucuccccucccugccaaggauuagugucaaguaagagccauguaugguaaucccugaaauaacuaagaauuucccuuuccacaauguacaaucauccugguaaaugacugagaucacacuggggacaacuugaagaaagauuuuugguauguauuuguagcaauacucaugcuuuaucuucagagggauacaguugcccucauuucauuuaagggcuguggcucugugaacuggcuccggucuagaaacugagugagaggccaugauguuguaucagggugaggaaaugaguuuucugcucacgacaucaauuauguuucuguacccuagagucuguauuuuagugauauuucagccaccaucaaaaauuaaaaguuuggugucacaauagucugauugucacucuggcucuuccacccauuaucgcaauuguacucacuuugcuuccagugauuacacugggacacucagccucugccacuccagaauuccaucauuccauuaaaaugagagagucuauuuugaaaguagcaccuaauaucacauccaaggcaaucagaauacagccuucccagauuucuucaaggacacugauguucccuucaccaaugcauuucucaauauuuccaugaggaaagcauuugugggucacacaugauaaacccacugcaacauuccuaucucccuaaggcuuugggauauuuucaugcaagacugaagucacuauggccauuacagacucuucaagaagagggaauuuaaucuccuuagagaaagaagaagagguugguuccacaauaaagcacuggggaaacugcagaugaagcauagaggaaacuggaguucaaggcucugagauuuaggugaguucacucacauaaauauauucauuucaauuaucaugauccaugucuaccauucaugucuuaucuuccauauaagaaagcuagugaggcugugaauucaacuuguacugugauucuauaauucucagaacugaaguuugguucuuauuuucagcugcaucauuacugcaaugauaaaagacaagacaauuuguguuggcagugggaguggggaggggaucauagaucucuguuuacgugacuauccuugaacugagagaaguccugaacccauaauuuccuuucuauaaaccuucuaguguagucaaaaacagccaacaggagucauuauucaauccauaacagucaauuacaacuuccauuugauuucccaaaacuuugacuuuaguaaacacuucauuucugauaagaaaggugauacauuaaguaacugagcugacccugcauggaacggcaauuuuccacuggcaaugauauacuauuguguucaauugcaguauggucagauaaccaaucucaaauucucaucuuugaaauucugucuccuaaaaccacuccugguuauuguucacuaaagaaagcagaaacuacuauagacauuuccagaauaggaaauuuaauaccagaaacugauuauacaguuguugaagggguuagaaaaaaaaggaagaaauaaauacuugaaggcacaaaacaaaaacaggguuucaaaccaaagugagggugcuaccccacuaggcuggagcccacaagccugcaguaauugcugagcuccuggaaaaacuucuacaggugccacugggaaugcucuguuauugcucaacagagccuauacuguccagcagcaggaguacugcuacugcuauucaagaugccaacacuaaugcuucuggaacucacagccaccagaggucaccuucaguauccucuucugcaugcugaaguacaccauccaauaaaaggaaauaaauagcugcuucuucucuccuaccuuacaaucuuucaagauugccuugcuuuggcuguaccuaauagaaaacuugcuagcaauggaaucuggcaugugugguucacagguuuuauaucuuugcaguagaguguggaagggcagauauauagauaagagauaacagcacuaacugucacaaaaccaaacaauaauggaaaaacagaaugugaugcauuuuaucuucuaaccauuuauaaaauaaauuaaauauauguuuuaugguauaauaauaacuguaaagaaaaccaaauacuacacaagcacucaaaaugccauucucaaucuaaucuuaacuuucuuaauaaucaacaaauacuuacugugucuauguuccugacauugugacaaaucccagaguuacagauguaaaaucaacuauaggaguuuuuacucucgucaggaaauagaaucagaggaaacagacaaaauacaguaaauaauaacuagacuauguguaucagguauacaggagagccaacuacaacagccaagaagggucauagaugguguauaauuuggauauuuguccaauccaaauuucauguugaacugcaauccccagcacuggagguggggccuggugggagguguuuggaucccagggguguauguuuaauggcuuggugcugucuuugugauagugaguucucgcaagaucuagucauuugaaagaguguggcacuuucugcccuccacucucugucuagcuccugcuuuugcugugugaagugccuguucccgcuuugccuuccaccaugaguaaaagcucccugaggccucccuagaagcagaugcugcuaugcuuccuguacauccugaagaacugagccaauuaaaccucucaucuuauaaauugcccaguuucagguauuucucuauagcaaugugagaauagccuaauacaggcggcuucagggaagugacuuggggaaaaacuagggcuucuaaagaauacaagaaaaaauaauauuucagaucagaaaaacagcauguauggaggcauacagaccugacaaagcauaagauguccuggaaaguagaauuguauauaauuugaaauauagcaaaugaggagauaaucaggaauaugccgaagaaaagguuagacaggcaaaaggugagcaaaguaugauucuauuaauauauugcucauacaauugauugaaugauguugcauuugaaauuuuuuaauuuaaauuuuagaaagauaauugccagaggaauggaggauugacuagagugaauaagaugaggaaaauaagaucauuuagaaagcuguucuaguauaggauaauaaaacugaaguaaugcaauaacuacugaaguaauacaauaaacugaaguaauucccacuugucuaggaaaaagcuaguucuccuccuccuucucuaugcaaguuccccagcuucuaaucaaucuaucaguuaagcccacuuuaauaacuauuaauauguuuucaauguccauuuuaauaacuguguuuucuacaagauuaaagaaauaaaauuauccuauagauuuuucuaaacaaauaguggagaccuauggaauauaauugcaaggguaguaaaaauguaacuuaaauuaagcugugaaauauauucuauuuuuugucugcuauuuugucaugacuguuugacagaaaaucuacccuuuuaauaugccaaauucacacauauuaauuaggagaacuagaaguuaaccaaaguaaaucgggaggaaaauauuuuaaaaguauacgugcauaucucacccaaagaaaaauuccgauuuaauucucacuucuuuuaagguggcccucccccagaauaucguugacuuuuuaaaacauaucauaaggcaaacauuugugacgcuaucacaguccaucuuauacaaccaaccaggaaaaauauccucuuuaaucaaaaucaguaauuuugcguuaagcuucuuuuauugauaugaaaaauuugggcaguccugcagagagaaguccaaauaacacaggaaacuagcccugacaggugguaagacaauaggaagaaacuaguauuuccucaggaucuugcuuauacauaugguacuuaugauacuuuacuaaaaaguauuuaucugaauccuucaguagccuaugagucccuuaauggcaggaaaugacugaaaaaaaaaacaaauaaauaaagugaagacagaaacgacauggauuucuaaaaauauuucugaugcuucugcauuucuuaaaaauuuacguggauauuuuccaggauggacaauuaucugugcacacaaugcaauuugcucuuccaaauccuuucuaccacagcuucagacuuaagcucuauuuaauguaaaccaaucauaguaauaccuuccucaccgccacguagucuuucaguaaugaaugagacuacguccauuuaagcaaacaacacacaaggaaacauuuccuaguggcuucuuaaaaaaaaaaaaaaggcuucauuuuucaacuaauaaaaaggugaguauuacagauaauaacuacauaggaauguaaaaaaaaacuuacucuggcuauggaagucugaaaagacuucauguaagagauaaggcuuaaaccacaccugaacaacaggaaaguacaguuaugcaucacuuaaugauggaaacacauucugagaaaagcauauaggcaauuucauaauugugcgaacaucacaggguauacuuacacaaacauagaugguauggccgacuaccccuagcuuauggcuccuagacuacaauccuguacagcauguaacugcacugaauuccauaggcaauuguagcacaaugauauuuguguaucuaaacauaaaaaagguacaguaaaaacaugguauuauccucuuaugggaagaccaucaaaaacacagucuaucacugacauuaugcaguggcacauggcuguaucugagaguagacaggaauuacaacuggguggaugguauaaagaaaggcauaagaagcauaaagaguggaggauguuagauguauucaaagcacaagccagccaccccaaguaaaagacucauagacaaagaaagaacaugcaggaaacaaaagucgaaaaaagggccugaaaaccagaauauauuucauuauguuaagagccaacaaaguaaaauucuuaguuaugaucuaaauguaugauuuagggaugaauacauaguuagggagaaaagaaaaauuauuuagccaugaauaaauuaauccagguucuuauucaucaagauuccauuuugaagagggcugccgcuuaggaacacucaagcuacgagggccauaaauuuaacacacacauuucuuuaugaaggaguagagagaauaaacaaauuuuuuaaaaaguaaagggagaaaagggaaaauaaaguaauaugcaaggacauccgauagucaaaauguauuaucucauaaauuuauaugcuucaguaaaaaaauuaucauauuuacaaucaaaaaaggccauuuguaaagaaucucacauauauuaucucugucaaaucucacaacaacccaaugagagagauauuguuggcuccuuuuuuuuuucuuuuuuuuuuuuuuuuuuuuuuugagauggagucucgcuaugucgccagacuggagugcaguggcgagaucucggcucacugcaagcuccgccucccgaguucaagugauucuccugccucagucucucaaguagcugggauuacaggcacgugcaaccacgcccaacuaauuuuuguauuuuuaguagagacgggguuucaccauguuggccagaauggucucgaucuccugaccucgugauccgcccgccucagccucccaaagugcugggauugcaggcaugauuuuuggcucguuuguacagacaugaaagugucucaacgugguuaagugaguuuggaagagccagauuauuauccaggccucugacuuuacauccuguacccacucaggccuaccucauuucauucaagagauaaguacaacacaaaguucaacaacaucugaagccauucugaacuagaaauaaaugaagauucuaauugucaguauaucauuauucagacauaauguagaaacaaaggauuuugccaagcuuaauaugguuuggcugaaugcaagauuuauauauuaagauccaacauuauaugggcaaagaaauacuaccugacucucuggaaauugagguuuaucaaucagacucccuagauauucaguauuuugaagauauaauaauacugaaucagagacagaaaaaaacuaguaauaaaauacucaaaggucuaaaaauuaaaggcaaauuuucuuagcaaagaguacauggcauucuauuuaaaaaucaacaauuugucuucauuccccagaucauaaacccaaggagaccauuauaaggcugcuacaaacaaucugucaguuugauuucacuugguuagugaggguguugauuuuguuguugaacugcuuaagaaaaauuuaagaugcuuaaagaaaguucuuuaaacauauuaauaauaagcuuuucaaagucugugaauuuaauauuucauuauuuccuugaaccuguuagaguuaagugaaacuuugaaaauuccaggaaagguucaauaaaauuuguuauagauucuacauggucucauuuuccuuuacuuaagaaaaaauaccaaauaggcuguuauauuuugaaaucuacauuuuuucaaucugcccuuuaaugagcaccaauuaugguaaauaaauauuaacagaauauaaccacuuacuuauaaugcaauccuuauaauguuauauuuauccaagccaugaaggauuagggaaguaaaaacuacacuagcuuaugauuuagcaguuuuauuuuccaauauaggucagaaucuaaaaaguuaaagagugaaggagggccacggggccuuuaaggagcccaaauaucaguguaaaugaaagggugauugauucucuccucaaagcagauggcguccuuuccccagaugccugguuaauacagauguggaagccaauggagaacucagguuccuuacaaagaacagaaaagggguugagcacacaaacaauucaagaguucaagggcugguggugaaaucugguaguaacagauugcagacacauacagaugucuaaaggaaacagcaaaaggaagaucugggaagcaacuccccaggaaaagauuuuaccauagaaaucaucaucaucauuaagaagccucagaucagauguaaccuauagcagaucugaacaugacuaaacccuagacaaaaguaauuaauuccaaaacagugguauggaucaauucaaaugagaaauugauuuucuaguucugaggugcaauggcaaacuuguaagucaaaugauauccuagaagacagcacuuuuuaaagacaauaccuuaccaagccacuugaagacggaauaacuauaccauaaugaagaaaaauuucuauuacuuaauagauucuuuuaaaaauauuuuagauacuaaauuaggacuauuacauaauugguauuaucuauauuucaacuauggaaguaacaguucuucauuucaauuaacaagcuaauauacugucuauucaucaugauucgaccauuagccagacuuugcugaauaauucuaagauuagccugccauuuagccacaaguuagccaacuauauagauaagugaacuauuuugcuaucauuaccuuaaauguuguccacacaucacaaugaccaauaagaaaacaucccuguccuaccauccugguaaucagaaaaucaccauguggcuuaauguaaggcuaaguaagcguuaccaaauaugucuguaggagggcaagucugagggcacgauuacacuuucaagacuuugugaggaaucauuuguaaucuugucacacucaaaaaaagugcugagagcauucuuuuuucacccucacaucauccagagaacuguucagcaauauaaagcugugaccuugauguucuauauagcuuaaagaccauaguuaaaguccucauaagcacuaaaagucaucucugcacaggaaguagaauauccuucuacacuaaugugcuacauauuauagauuucuccaauauguuccaaauauaauauaauguuauuuccaaaaccguaaaaaaaauucauaguuuagcagaucuaaguagaacuccuuuuggcuggugagauggugggaagagauuaggguagaaaguggaagaagcagagucauaagagaauaguaaucagugaacuaccaaaauuuucaucauucaaaauuuuuacaaaucaaaauuuuagcuuuaaaucaauuuuauauguuugguuucaaagaucagcccucaauaacaacccuauaaucuguuuuaauacagaaggcuauauucuauagcgauaaguucuauuuuagaaaagaagcaauuuaaaccuaaguuuuuuuagaauguuagcauaacauauaguaugaaacaggaaacaaacagauuaaaggaagaccagaacauuggcugaaaauacaccuucagggcccauuuccagguaaugcccaaggccuccuaggggauaacuaauaguuaauauuucggcugccacauuccaugggaggucguaacaaugacuuuauauaaaaauuauuucuauuuuucucuuuuauuuuuaacuuaguacuauuaacuggagcucuuucuucccuuguuaacuauucauuacuguauauuucugugcauuaaaaccacuuuaaaaaaaaucuucauccccacaucagccuccaucgugggaagauauauauacacagaaagagaggaaaagucauugauccccagccauaagucaagugaggcuucaacaauagaucauacccaggcugcacacuguuaggucacagaacauguggucacacuguccuaccaagacagaagcuaauucuaugaaaucccaaacuacaccuucuuguguuucuccauucaccucagucaauggcuucaccaccauccauccaccuucuuacucaaaucagaagcugaggagccacucugccucuucccauucuuacaguccaaauucuuguucacucaugcaacuauucauuucucucucacuuccucagcauuugcuucagcccauauaauuucugaccuaggugauuuuaucaguuuccuaacugguuucccuuucucuggccuacaacccauaaauucuaaaacacaaucugaauaaucuuucuaaaacauuuuaggaacaacccacuacccucagaucaaguccaaacucuuuaacacuguuuacaaggcccuugauaaucugacugguugcugcucacacugaacucuuaccacucccacugugguacccaacaaugccaaacaauuugaaauuacucaguuacucauauucucucaguacuaggcaccaccauuccucauccagaacacuaaagcaauugaguuugauucagguguaauccucaagaaaacauuguuagacuucuccaguuucuccaggugacacaucugugugcucugaaagcacccuaugcuuauaguuaucauaccauacaguacuguuuacuuuguucuuccucccccaaucacugauuauuagauccuuaaaguacaagcaacuuauucauauuuguaucauaaugacuagaauaguacuuggaacaaaggagacacucacuaaauguuugcugaauuaaugaauaaagauauaaaugaaaggcgguauguguuccauguuuucuucaagaaaauauggccaccaaaauguguaugaacuaaguauucuccaaucugcccaauggaaaaauaaauaaauaacagcuaagaguuugucauaaauuucagggcaauccuaaugaaucuaggaaagucaauugaucaagaggcuacaucauggccuuuugauuugacuuacccuuauuugcuccuacgauaauaccaaaaaagcaucuguccauacagugagaauguaagucaacacacaauuggcucaggguaagcagauuacaacucuauuaaaauaaaagaauuauaaucaaaauccugcuuccguauaugauuuaaucauugcacacugauuaaauaaaugacaauaauuauaaagaaaaaucuccauccauuuugagugcuccugagaagcuagagacuacucagaucucugauuugagguaauauucucaaugucucaaauuaaaugcaaauauucucauggaaaaaaaacuacaacaaucuuuuuuuuucucuaaauuauuaauauuuaucuuugagguugagauucucagguuuuuguaguacaucaugggagugauauaaaaggaguccuuaacugcaaaucaaaauuuuagccuuaaauccaaagcuugcuuuacuauauagcuaugcucuaaaucaccaaauucagaaauccuuuaaaauagacacuugaaugugguuucaauguaagcacucucuuagcagacucacucuucaaaguccaaaaugaaagaaaaauuauaugcucagcaguuuauuuaauuaaaaggaauggaacuacagagugauaaguauagaaaaguucagcaugucuuuucaaaggacuguaaaaaaaacuuccaacacuuuacuuauauucuugcccuugugacuaaguuauggacaaugaaacaccuugaguuaugauacaaauccuuaaaccuaaaaugccauauguuaaaacucaaauuauguuaaagcccauaacuauuuuaaaacccuguguauaaugugaucuacugcauucacaguacuuaaaguacuuucauuuuugaacuuuuauaauuucugcaagagaaaacaaugccaagagacaucccuacaguaauuaauguaagauaacagcuuugaauuuacaguuauugguaauuuaauuagucuugaacauagccacuauaagacuugauaacuacuaaacaauuauuaaugaauaaaaggcuggcccccagauucuuuuaugccagacccauggaaauaguaugugccagauaaauagauucucaauaaauauuuauugaggucgaauugaccccaugacugguuagaugcagaauuuuaguucacaucauauagacauucugaaacugaauuuaacacaagcauaauaucagcauaauauuauacugaauuguacagacagaaccaugagucacuuucugcuccaaaucaaugaaauguugaaguagaaggaacagcauaagaauucuccauuauguagcuaaguuugaaacaaugguagagaaaucuccaggucccaaaaaaugaaaaagaaauucgauaucugggugguagaaggaacugaauuuuaaaaaaaauuagaaauauacuaauauuaguaauauuaauacuaauauacaaauacauuuaauagugguguucucagaucacgacgcaaaaucuccccaagaaaccuacuaauaaugaauaauaauuuacaugagaaaaagaccuuuucaccugcaaauuaaaaagcagguuaacauuuaugggucaugguaaaagcacuucuccaaagaaaauccauagcauuaaauacuuacauauuuuuuaaagaaauaaaaugaggaaugcaucuauauuuuauaucaaagccuacgucucccagcuuuguucauagcauuaaauacuuacauaauuuuuuuuuuacaaaaguaaauaaaauggugaaugcaccuuuguuuuacacggacggcugcaucucccacauuugcaaacucuucacuguaauaaacucucuuucuucaaaaugaaaaaaagaaagcaaauaaaaugacuuaaacauuuaauuugaaaagcuagaaaaagacugacaacagaaaacaaaagcagaaggaaauuaauaaaaauaaaaaugaagucagaaaaacagcaaaauuaauaaacagaucaaaaagcugguucuuucaggcaaccuacagaacaggagaaaauuucugcaaucuacucaucugacaaagggcuaauauccagaaucuacaaugaacucaaacaaauuuacaagaagaaaacaaaaaaccccaucaaaaagugggcaaaggauaugaacagacacuucucaaaagaagucauuuaugcagccaaaaggcacaugaaaaaaugcucaucaucaccagccaucagagaaaugcaaaucaaaaccccaaugagauaccaucucacaccaguuagaaugacaaucauuaaaaagucaggaaacaaaagcugcuggagaagauauggagaaauaggaacacuuuuacacuguugguaggacuguaaacuaguucaaccauuguggaagucaguguggcgauuccucagggaucuagaacuagaaauaccauuucacccagccaucccauuacuggguauauacccaaaggacuauaaaacaugcuucuauaaagacacauccacgcauauguuuauugcggcacuauucacaacagcaaagauuuggaaccaacucaaauguccaacaaugauagacuggauaaagaaaauguggcacauauacaccauggaauacuaugcagccauaaaaaaugaugaguucauguccuuuguagggacauggaugaagcuggaaaccaucauucucagcaaacugucacaaggacaaaaaaccaaacacugcauguucucacucacaggugggaaaugaacaaugagaacacagggacacaggaaggggaacaucacacaccgggaccuguugugggguggugggaguggggagggauagcauuaggagauacaccuaauguuaaaugaugaguuaaugggugcagaacaccaacauggcacauguauacauauguaauuaaccugcacauugugcacauauacccuaaaacuuaaaguacaauaaaauaaaaaaagcugguucuuugaaacacucaacaaaauagaaaaauuacuagccaaccuaauaaauaaaaaggugggggagauuagggugaaagcccaaaaacacaaagugaaaaauaacaaagaagaaauagucaucaaaagagaugaacugaaagagaaaaugaagcacaaagaggaaaagaaaucuauuguauaugcaaauaaaucugaaacauagguaaaauaaaauuucauuuggcaaaacugaccauaauagagagagaaugcauuaaggaaaugccuaaaaagggaaguaaaacuaauuagucaacuacagaccauaauucaucagagguuccuuaaauuaaguugaggcaagucacucuuuuucaaguugagaaaagaugcuauaaaacaugaaggcauguuugagaaaaccaguaaauauuuuuaacaauaguuccuagagucaaauaaaaaauucauucaaaaucauguguaauauaauguuuaaguguaauauauucaaaugagaaauuccaauacuauauucccuaacaaagggaaaaaaauaaauuauagcuaaaaaauaaauauucaauaucaaccaauaucaacaacaaucuguuuauugacaaaauguauuuuuaguuuuuaaaaaacaauaaaagguaaauaaacuaaaauucaaagugcaaacaauaacacaccaaagauuuuuuuugaauacugaaaaucuaggggaacaacugcucaacauuugguugcuucacaaucuguuaauuuuuuuaaucaaauaugacuaagauaagucugccacauccauaaaaacauuaacugaaauuaauaugcaaauuauggugccugugugggaugccauuucauuaauuucaauucacugacauaauuguguucucugaauuuaugagauuugcaaaugccaucucauagagaaugcaauguucagugaauguuauuuuacuagcauaaaacccaauaauagguuaauccacaaaaaagaaauauaagauuuuaguuacaaaauaauauauguuuucauagcuguauauucuuugagcuaauucuuagagcuuuuuaaaauaauguuuaacuuuuaauauaacacugauuaaugguagcaaucuuggaaaguucaaaaagguauauaaaaugagaaccuuuuaaagauuagcuaucuuuaaauuauaaauaauaacaguauuugguauauuuugcuucaaucuucuuguaugcagauaaguacaaaugugaaagcgcgcaaaauaaauauaauguuuuaauuccauuuuuuccacuuaauauagcuauagauauuuuaccauauuaguaaaugaauuccaaaauauaauuuuaaaugaauguauauuaagaucaucauguggaccuaccaaaauauuuuuaaucuuuccauuauuuuuuggaguuuagguuuuuuuaguguuuuaauaguauaaauccuucuguaaucgagcccuucauguaauuauuugugucucugauuauuuccuuaacaaaaaaauccuugaagugaaauuccugaaucaaaggauguaaauuuuaauauaucaucuaaauaccuuucaaaaauauugaaacuuuacauuccgaccacgaguauauaacuucuauucccuugaccccuuuuccauacuacauucuaucuuuuggcaucaucaguguaguagaucaaaauggcaucucacaguugauucauuugcauuucuuuauuagagagguugaaccccucaugaaauuuuacuguaguaauaauguucuggaauuuuaauuuaaauuauaauguaguuuugccuauaacugaauugugagcaacauugcuauuuauaauuuauuacugcuugaaguugcauacuguaaaacaugcuguguuuaaauuauguacaguauuuuuuuaugguuagauuucauaaaaucuccuaaaccaaaccugaguaaauuucugcucucuuuacuugcuauuacuuucaggucuauaaagauauaaagaaaauuacacuuaaucgaauuuuauauauuuuagguauuuugaaggcaauuaguucaucauaauaccucaauugagauauaaauuaugcauuuauaagacugagauugccaaauaaaaauuaagaugcuuagcaaauaaugaauuugauuaaauuuuuaaaauuuucucaaaacuacaaaaaaguuuuugaucaauaccaaagauuauaauugaaauaucuuuccaucucagauauuaaaguuacaauaauuccaaaauuaugggcaugcauucucccuccauaagugaaagcuguacaaugccucaauucucaguugucucuuaaacaauuccauucagaaaucuucuucagcugcuaacauauuccucauuaagauuccuacuucucauaaacauuucuccaaagaagacauaaaaauggccaauaggaauaugcaaagauggucaagaucacuaaucaucagaaauaugcaaugaaaaccgcaaggauauaucaauucacaccugcuaggauggcuguuaccaaacaaacaacaacaaaagaaaaacaaguacagggaacacuggaaaaacuggaacccuuaugcacuguuggugggaaaugcaacagcucuggaagcaguauggagguuccacccaaauuauaaaaagaacuaccauuucuuggagcaaucccauuuucagguauuauccaaaauaaauuuugguuuuugguauuucaaaauaacugaaaucaggaucucaaagaaguauuuguauucccauguucacugcagcacuauucacaauagccaagauauggaaucaaccuaaguguccaucaauagaugaaaggauaaggaaaacguaguacauuuacauacucuagaauauuauucagcuucuaaaaagaagggaauccuggcauauggauggggaaaaaggggaauccugccagcauagauaaaccuggaaaacacugugcuacaugaaauaggccagucacagaagcgcaaauacugcauacauucuacuuauaugaaguaucuaaaauaguuuaauucauaaaggcaaaaagggaauggugguggucaggggcuugggagagggaaaaaugagaaguugcuguccaacugguauaaaguuucaguuaagcaagauaauaauucuuaaaauucauguaagagaaaauauuaucaaaauagaaugccucauuuaaccugcuuuaugaguguucacucacauagaucauuauauauaaaaagugucacuguaacuaaauaauuucuacaauuucauuaacauguacucaacucccuuugcugcaugucucuaucauagcuguuccugcgagguacuguaacccaccauucauucauccauguacuucuuacacuucaaaagacugaacuauuucuuuuguagcacuuggcaugagcaaauacauaauauauuaauaaauaaaaauaaauauaggaaaauucagcucacaaaugugcuauuugugcaugaaaaggaaaaauauuuuuaacuauuuucagaaauaaguuagaggcuagaaaguaaucuuaugguauauuaauaauuuaaaagucaucaucaaauccugugguuuggccaaaauaaaugcagaaguagaaagaaagagagccauaaauugcuuaaggucagaaaugcaagcugaaaacauaguguacauaauacaagaaauucuuaauucuccagauuucuaugugucaaaaggcuccugauuucaguguggaaaugaggguuuuaacuacauaccugaaucaccuguuuggaaaauagguacguauaguagauauauaauauauaagaauacauaugagaauaaaguauuauaaagcagcauaaccacccacauuucaccaucuuuucaucauuaaacuaaaaaauauuuuuacaaaaccacaugaccucucagucauaauagaacuaaugaaacuacaaagauccaaucuuacucagagaacuuguacgauuuuugaaaacagcaccauuaaaacagcucucucagaguauucuccuauaagcucuuaaaaguuauuuugaaaacugucaauacagcugggguucuuuuccacccaguggcagguuacaaaggaauauuaaagauguuucaaaaacugauauaauucaggaaaaauaauuuaaacaauaugacugcaauuaugacauauuacaaugaaauacauggcagcuagaacuaaauaggagcccacagaaugauacuuagaaaugcauuuacaugguuacugaguuuuccccaguagaaaagcaacuaucccuucuugcuccuuauugguacaaaaauuauuucagggcccacaaauucuaaaagcauuacaaaguuugaagaauauaaaguaaauggcaauuauaaaaaguaaggguuuauauuuuacaagccccaauacagcaaggcuuagaauuaguuauaaaaacuagagguguguuacgucuuagaguagguaacagcuggauacuguguagaauaaaugcucaugcccaugggugggauguucauaaugcugaagggcaagagagagagauguauagcuugagaagugauguggauaauugcuugucauuaaacagcagaguaauugcugcagcaaauucccauguaacuauuccacaugaaacuucaacgugcccuuggacuuacuaaacauacauaguuuucucagauaaaaagacagcagucaaugaugcaccacacuuaaaaagaucauuauuuuauuauuuagucucacaaaaaaacauugggacccuaaccauuaauaacacagagaaaaaaaaagccauugauuuuuacauuaguaagaccuugguaagaucucagaaucuacuuuuuccuaaccugcucagacuaggugucucauaaagccuacaauaauuuaaaagaucgucacaucuuuugaaaagcuuucauguacaaucauguuauucaguauucaaauucauaauaagccaagauacgaaacauuuaaguugcugcaggauguugagcgcuauuaagaaugcauuaauagagaggauucuaggcagcugaagcuguggcagagguauaaauuugaaaguaccaaaauauccugaaaagaaacagaaacaggaagaggaaaaaaaagagaaggagaagaauuaaaacuacacacccuaucucaacauaacuagaaaacaaggaaacuccaaacuucaaaguacuuguaaauauaaauauaaacaucaagaccuaccuaccucucucaugugcuccugccaguagccuucauggagaccaagagcaguucaggagaaacuacacaaacgagagcagagaggaguuaagggcagguugaaccaugauuuaaaaccacugcuagaaacagaaagaaacucagcccuuggcccuauauauacugaaaagugaacaguuagcucagaacacugauaacagaaaggagacuugaaaacgcacaugggacaugacaagccaccuugcaaaggcgucacuuuggagagaaaagacagcuaaaacaacaggagagguuucuuuggaaacuauacauuagagagagaaaaaggggagaacauuucgaauuacauaaaacaaaagaaaauuuaaaaauuggaaggcauaugccauuugaaaaccaugccauccaguaaagaaacaauacuuugcuuacaauaacaggagagggugcucuugaacuagaaauguuaagccaucccaacauacagauaaacaaaaaccuagcauaaaaagaaaauugaaaauaaggacccaaacaauuaaggugauaaaaaauuccacccucucacacaaacaaauggcaagacacuggcaagaacaguggcaaaacagaagaaaaccauaacacucaaaacuaauaaauauccauaaauucugcaauuagguagauuuaaaaaacaaccuugaaauaagaauuaaaaacuaaguagagaaaugaaugaccagaaaauuuuaaaaggaaaaaauaaaacaccaauugauugaacacagaaagaaaagagaagaaaaauacaaaaucacaucagaaauggaacguaaauuacaagaugcccaaggaaaaacagauuugaaagaaaaugcaauaagagacacuggaaaaauaguagaaaaucaacuaaaugaauaaaaugaaauagagaaaaaaguaaaaagggucaaagagaaaguggcugaaauggaagacaggaaaaagaagauacaauuuauauauaaauggaauuucugaagaagacuuuuuaaaauaaaauaugacuaauaaugaaauucuaaccaagaaaguauucaaacacaaacaaccacaacuuauauacugaaagggcccacuagccacgggguggggggaaaaaaaaaacuuguaacaaucaacucagagacauauuuuaguaaaaguaguagacauucaagauaaaggaaaaauccucagggaauccaggcaaaugaauucaaacaacauacacaaguaaaagaauuagacuggcaauagauuuaucaaaaauaagauucauauccaacaagagguuaguauacaaaauguacauaaagcucaaaugacucaauagcaagaaaaccaaaaauccaauuuaaaaauggucaagauaucugaauaaaaauuucucaaaagaagacauacaaauguccagcagacauaugaaaaaauguucaacaucgcuaaucauuagagaaaugcaaauuaaagaccacaaugagauaucaucuuacacuuaucagaauggcuauuaucaaaaagacaaaaguuaacaaauauugacaaggauguggagaaaagggaauccuuguauacuguuggugcgaauauauauuaguauaucgauuaugaaaaacuguauggaaguuccucaaaaaacuaaaaauagaauuagcauaugacccagcaaucccacuucuggguguuuaccuaaaagauuugaaaucaguuuguugaagaaaugucugcauuccauguuuauugcagcacuauucaccaucgcuaaguuauggaaucaaccuaagugcccaucaauggaugaauggauaaacaaaaugugguaaauauacacagugaaauucuauucagcccuuaaaaagaaggauucugucauuuguagcagcaugugugaaaauggagaacauuaugcuaagugaaauaaauaaggcaaacaaagacaaauaucacguucucacuuauaugugaaaucuacaauaaccuaacucauagaagcagagaguaggauggugguuaaagcaguucaggcaguaaggaauggggaaaugauaaccaaaggguauaaaaucucaggagaaauaugcuuuuuuuaguucuauugcacagcaugaugauuauagucaauaauagaguacugcacaucuuaaaauugcuaagagaguaacauucaaauguucucaccacaaaaaaagguauuugagguauugaauauguuguuaacuaacuugauuuaauuauuccacauuguauucauggaucauacaucacuuuauacuccauaaauuuauacaauuauaaauuaucaauuuacaauuuuuaaaaagauucaaagcaagauaccaauggggcagcauuuccauaaggcuccaggaaauaaagggaaauccaaggauuuguauauagccaagcugccuucgaguauccaagcuauaaaaaaaguuuuuaacaugcaagaauucaaggaauucuggauccaugaguucuuaaggaaucuacuagaagaugaccuuaacccaacuuguuauuaacugggaaaguuaagcaaaaaaacuaauaguauacauauauauauuuauuuguagguauaagacacacgggaaaauacaucaugugcuauaugcuauauauuaugugcuguuuucucaaaguagaaauaaugccacaaaaacaauaagacaaaaaggcuguuuuauaggcaugaggcaggaacuaaagaauaucaauaacagccgaauaaccagauguuaaaaggucauaauguuuaaauggggaauaaggacguuaguaaagaaauaaguauaaacacaucaucuagaccaaaauaaaaccuuccuagaaaaaaaaacuucaaaaaucgaauaguaaaaaagguuacuagagaaagaagccaagcaaauauaauauagcgugcauaauauuuauaauaugacaaaauuaaaaucaaaacaucagucuuuucaauaauugugcaggcacuuaaccuaccaacugaaagaaaaucauauaaaaucaaaugcaagccaaaaagcauuaaauguaacaaagaaggacacguuuuaacgcuaaagccaaaaucacaauaaagacauauuaaauauaaauaucuauguaccaaauaauauaguaccuuuuuguaaaacaaaaacuauaagagaugccagaagucccaaaaagaacacuaauaauaggagauuuuaacauacuacuuagaacaaggcagaucaauaaacauguaaaaugaaaauuuaaaaacaccuacaauauaacuaauaagguagauuuuaugaauauaugucaaacuuuacacccuaaaaauaaacuuuucucucaaaugcauguggagcaucacaaaaacugaucauauauuaggugauaaggaaaauaucaguauguucuauaaaauaguaaugcuauaagaaauauuuucuaaccaaaauuaaaauaaaacuagaaauuauuuaagcacuuuuuaaaaaaggcuccuugcgaugguuaauacugucaacuugauuggauuaaaugaaaucagucuacuacuccacaauggagguaagggauaucuggaauacaggagaucccuuagggugucucuuaguauuaccaugcccucugauuaaggucaaugggaaacuacaacagcccaauccagucagggcuacaaauagcccagacccuccaggaaugaagguuugugucacuccaccaggaaaaaaacaagaccugcugaggugcuugcugaaggcaaagggaauacagaauggguaguagaagaagguagucaucaauaccagcacgugaccaguugcacaaacaaggacuguaauuguaaugaguauuuccuccuucuuuuguuaagaacauguuugugcauguauauauuuguacaagaaaauaucuucauuuuauuuccuuuuuccuuuaaaugugacauaagauucauugacuugcuaucagcauuuaaguguuguuaaccuuacauaauagcauuuggguuggggauuugugcauuccugguuguacgaaggauaguuuuauuauguuaggcauaauuaugauauuauugucuuuauuugaagacuaugauuucaggaaauguauauggguucaaguugacaaggggucgacuugugaugguaaauauugaguggauuguaauauugauuggauugaaggaugcaaagcucccuaggugugucugugagggugcuaccaaaggagauuaacauuugagagacaaaggagagacagacccacccucaaucuuagugggcaccaucuaauuaaucagcugacaguguagccagaauaaaagcaggcagaacaugaaaagacuagacuggcauagucucccagccuacaucuuucucccgugcuggguccuuccugcccuugaacauuggacuccaaguucuucaccuuuguaauucggacuggcuuccuugcuccgcagcuugcagauggccuauugugggaccucaccuugugaucaugugagucaauacaccuuaauaaacuccgcuuuauauacacaucuaacuuauuaguucucucccucuagaaaacccugauacacucuucaaccuguauaucuucuucuagaaaaaaaccuuuucuuaaacaacucuuaggugaagggguaaauacaagcuaaaaguagaaaauauauuuuaaacaauuauaagcacacuacauaucaaaaauuuuuauuuuuauugauguaaaauauacauauguaauuuaucaucuauaccauuuuuaaguguauaauuuggugguaauaaauacauauuauauauauauauauuuccccccuucaucuccuccuccccucuuccacuucccagccucugguaacuacaaaucuacucucuguguucuugacagucacuuuuuuagcucccacaugaaugugaacauguuauauuugccuuucugugcuuggcuuauuucacuuaacaaaacggccuucuguuucauccacguugcuguacaugauaggauuucauucuuuuuuauggcagaauaauauuccacuggguauauauaccacauuuucuuuaugcaugcaucaguugauuggcacuuagguugaucaaguauuuuuaaagcaauggucagagaaaaauucauagccuuaacauuucuaucaaugaaauuuuaaaaauaaaaaagaauuaaauucccagcucauaaaggcauucaggguaauaagcuaauuuguauaacauggcauuucauacaugcaugacuaaagaaacaguccccagguaugcucuagguucucauccuuuuuucaacuugguccuggcagugcaaaagacuuccagggaauuuagcucccuagaaguugauggcacugauugcccaaguauguaagauaauaccagacuacuaaaauuauuguuuuuuaaaccuucacuuguauuucuuccauuucccucacuuuuccuaacgucucucaguacacagaaaaaaacaagagaaagguugauucgggguaauaucagucagguaacgauggaauucagaaauuugagacacaucucuucuuucuugaggcauaucacucuuauacuguuaaucauuccacagagagcucuaacaagaagcuuucauuggucuuugaaucuguagcaggagcaguuuauaggccaagucccauaagcucagcugagauucacacuuaccgaugcucuucuggaaucuaaaccuuaacacuggcauaagaagcagaggagacagaaaaagagaccuaaaaaaacuuuucuuuauagaaaagauacaaacuagagcuagguuucagccucccucaccuucucuuuggaacagaucuuacauauuuaaaaccauauuugaugaaauggaugcaucccuuuaaauaguaacagauaugaggaugacuaccaaauaucucucuguuauuauaagccuggagagucccaaaaaagucagccagacaacaugaaauguaaaaugucuaaagaguggaaauauaacaaagcuaaauggcaaauggacagggaggaaauaucuacagcacaaagaugaaagguuaauauuauauagaacaacucaaaauaaaaauagguaaaaguuaucaacgugaaauuuacaggugaaauaaacaugagaacaugaagauaucuccaagaucacuaauaacuuaagaaauacgagaaaguuuauugaaaugcuguuuauagcagcaguaaguagaaacagccuaaauguccaucaguaagaaaauuacuaaaaagacuaggaaauacacauaucaaagaacacaacaggacacuuuaaaagaaugaguuugagcuacauaaacaacauggaaaguucucuaacauuuauugugacaugaugacauuuauuguaaaucguuuaaagguguguaauaugcacaaguuugauccuucuuauaaaacagcaggaaaguauauauuucuacauguauguauauaauuucauggaaauacacaggaauaaaguuaucugggaugauauacaucaaaugaauaauaauuaccuaugggguaggaauugcucuuggcuaaaaaggguaagaacguucuuguacuuuguacaucaauagauacuuacuugauguuuaaauuguuuugucaaaaaaaugguuucaaguauacuuaauuucaucuuaaguuuuuguuguuguuugagaagggaucucacugugucauccaggcuggagggcagaggcacaauguuggcucacugcagccucaaacucccaggaagaaauccuccugccucagccccccaacuagcugagacuacaggugugugccgccaggccggcuauuuuuuuuuuuuuuaaguuuuuuguagagacagggucccacuauguugcccaggcuggucuugaacuccugagcucaagcaacccacccaccucagccucccaaagugcugggauuacaggugugagccaccacaccaggccuuauuuuaaagugaauggaagauaaagaaauaaaaauauuauguguuuaaaauguuuuagauacuuuuaguuaugaugacacuucucaaccuaacuuguagucucaaccauauuuuuauauguuuuaucuaucuuugauuugggguggaucucucaauacuaucuuucagcuuaaaaauuaucucuaacaguaaauuuucuagaguuuaucuugucuacaguaguguuuuaauuucaauuacauuuuucaauuccacaguuucuaauaaguucucuuucauauucaugcauucauguuucauucugccuauuuuguuauauaauuucuugcucuuucucaaugaaaguucucucuucaauuaucuucauaauaaagcacacuuauuuuauaguauugaucagaucuuucugcuaaauuaauuuuacccaaaaugaauucauguuuacauuauugauuaaucaaguugccuuucucagaaguagacuuuuuuuuuuuuuuagaauuuugguacucagucuuauuuauacugaauaagguaaaguggcuuaacagaaacuagucuugauaagguaaaccaaauaagugaaaauagugccaaacacagauucauaagcaucauauauauuuaaugucaauuguuccaaucuuuucucaacuccaacuuuaaauuuuaaucaaguuaaugaaaagcaagccuacauuguuauuauuuaagucugaauauucggccuucagaaauucugcaaaacuuucuugguucaguaagauuucuauauuaagauaaaaaaucuaucuaaugcaacgaacauccacagcugucagcuaaaugaaaugucuggguuuucuuuuuuuaaaaaaagcagagaauuauaaaaaguaauacacuaaauaguuuauuuuaacuuagaaacacaaauagauauugauuugccuaucuuuuaaaguuauuugaagauauaaaaauuauuuaagaauagccaauaauagaaauuaugccauaaucaccccauuaauuacuuuuuuucuaucuuccauggcucccagcacauauuuugcaguaucuaacugaagguauuaauuaaguuauuuggauggaaggauggauggauggauggauggauggauggauggauggauggauggaugaaauggaccaaugaaugggcagauggauggacaguugaaugggcagguaggcugacaaauaaaagaaucaaccauucagcaagaugagccaagucugaccucaaauuaguuaaaccuagagugucuuaguuacccaagguaaacagagaaacuaaguaccauacaugggcagauguauggacaguugaaugggcagguaggcugacaaauaaaugaaucaaccauucagcaaggugaaccaagucugaccucaaauuaguuaaaccuagagugucuuaguuacccaaggcaaacagaaaaacuaaguaccauacauucaggauuagauuuuccuucuuuuccaucaacauuagcagaagcaaaaccagcaacagcaucaacaaacauucacuaaaaaucugucaugugaaggccucuaugagguuuaccagagauacaaagaaauaaaaaggacugccucugcacauaauccaguuggagaguuaaaacacacauaaaaggauagauuacgauucagggcaacuugugaaagguggcaaguaggugagacagagaacagagugagacaaaggaagaaggcaagggcagaagcacagugaaagcacuucauggaggaggcaggaccucaacuaugguagagaagagaaaguucugcagucaaaugcacaguggcagagaugauaacuguagggcaaagaugagaucaguuuaacagaggagaguguuuguaggaaagauguguagaaguuaugugugauuaaagaauagaagcaaacugugaaggaaagaaaugcuauugcuauuuuuuuucuccuuagcacguuccucccccccuuuuuuugcuaugaaucucaauauuuuagauaagaacauuaaaguucaaccaucuacccccaccccugucauucuaguuacaguaaauuguuauugcauaaauggggacuagguauucucaauaauaaacuacauugguaaaaauaauuaauggauaugccauaaaucaaacaaucauauauaauaaguacacuuaauaguacaaguuuaugaaaaauaaauugcuuuaccuacuugggaguuaguuuaggaucuuauagcacaaaaagcacacaugaaggaaauaaaaauuguugauccuuaucuagcaucauuuagccagacacuguaguauaugccucugauuaucauuucacuaacacuuacuauauacucugugagguauuauugucuugugaauaaagaaaucuagguuuguaauuuuuauccauuaaugagaaagaacuagcaauagaaagaauuagcaggaauuccacauucuugucccuuugccccaauauugcaugcaugugcacaugcuuaagauuugcaguuggcaacaagcuucaccaaaaauaaauucugucaauacaacuauuuauccugagucucaagaauauugucccaggagucaauaacuaccuuuuuucuugaucccaguacacuacaagugagcuccucuggauuuuauuuguacaaacgauucuuccuucaaacuaaauuacuguaaaaacacuuaccacaaaggaaauugcuaacaaaaucauuaucuaccucaguacaaacuaauguuauuacuuucaggaaacagaagcaacugaauuauauaauagaaauauuaguuuaaaaggucacuggaugucagaauguaucauuuugcagaagccucuugagacuauucaucagaaauuauaaugcuuagaacaucaaauucaaugccaugauucagcagaucucucuccucccugguucauuuagcaccagccaugaagcuaaguaaagggaagauaguuauucucucugaaaagagagaguauuucucucugaaauaauuccuuccacuugcaauuaagaagaauuaaaaaaaaagagaggcccauguaaguuguucuuuauuaauauacaccuaauacccuacauaaauauauagaacauacaccuugacauuagcucuaggaagaaccagcuuagcccuacaccgcauuuuacagaugaagcaacuaagacacagugaaguaaagaguuuaaccaaucaaaauugcagaaauagugacugaaaaaacuggaaguaaggaggaguaauuaaacaaacuacaccacuccucucaacuagauaaaaacuauucaguacaauugaacaugaaacaaagauacaaaagcuaguaauguuuucaguccucuaucucauucaaagacuucaacucaacuuuuuauucuguaccuauacuugcauaguaaaagaauuuuggugaaaauugacuaguuagccuucuguaauauaucaaaauaccuuccaaacaccauacugaaaggaacugaggcuaaaauagcauucaaaagccauaucaaauaaggaugcuauguuccaaaacacaugguuuaagaacugcacauagccccccagagugcuaguugggauucucaggcaaauuauaguugucaaagaaauaucaauucuuuguagaucacugauacuaccauucuauauacagaauacucuagaaacaauucacuguaacauauuaaacauaaucaagaaacucuaguacauguggaaaaaauagaaaaaaaaaguuauuggguaucaaaugaacugaaauccgaaaguuccuuuuuccugacuucaaguuuuguagcauacacagugcaaaaagaaucauuauuauugggcaacaaauauaucuauaguaauucaauaugaucccugaauauuugacauuuuuuguucuguuacagacuucuuuguacuucaaagagaugacagccugauaauacauccauucaacuuuuuccuaugucaaaggaaaagcugggauaaacagaaaaauauaaaagauguuauucuaguuguucuuaaaaaacaaaguaauuauauccuauuuagauucuuuaagaauuaagacuguguauguuuucagccaauaugaucccuauuuccucaaaacacaucucuaauguccaccauacuuucaaauauagaacauaauagaaccacuuuggagaauucuuuagcuguaucuccuagggcagaacauguauguacauauccuaggucccaggaaguccacuccuagauuuauaccaaagagaaauucacaaauguacaggaaaguucaagcauuuguaauagccaaaaacuggaaacaacccaaaugucuauuaacaagaggauggaaacauaaaucauagaacagucuuacaaaggaauacuacauagcaaaaaaacauugaacuucuguuauaaauagcaggaaugaaccucaccugcacaauggucagugaaagaagucaggcacaaaagaguacuuacuauaaguacgcuuuugauuaauacacacuucuggcaaaucuaaccuauggagacaaaagucaucuggguaaagacaggaaggucacaugagggaggaaauguucuuuaucgauauugaucagugugauaauuacauggaccaauacucuggaaaaguucaucaagcuguacuuucaagaugugugcacauuucuguuuguaugauauacuucaauuuuuaauuuucaccaaaaauauuaaguauauguuagaauuuuucaaagauuacauucugcagcaaugaauucagcagagcaauauugagaauaauuggauucuaguaauaauucgucuacuaaucagcuguguaaucaaucuuuaauacaaccuaaccucucagugauaauucugguagccaauacaucacacagaaaaguucucaagauauuaaaucaauuuuauucauuuaacaaauauuuacuaugagccacuguucuaggcaccugucucuugcauucuaauggagggaaacagaaaauacucagcaaacauaaugaaugaauauaugaauaaaugauguaaacugcaaucaauguuuaaaaaaacauaguuacauacauaugaauuuguacguguauauauacaccaaaugagacuuucaauccagucuuaacacaccuaaacauauauaaauacagaaaggaaacuggcuugaaauaacuauuucauuaugaucuaaauuaaaaccauucccaugguaaaugcuccugcauaaaucuuuauaaauaauuagccuugauaacauaugaaauauuuaaacauauccuugaaaccacagaggauagagcuagaaccaaaaaggcagauuuuucaaaggaagaaauuaguucaauauugcuauggucugaacgugucuuccaaaaagcaaguuuuagaaacuuaaucccaaugcaacaggguugaaaggugaggccuaaugggagguguuuaggucaugcaggcuccaccuuuaugcggagauucacacuaauuacaaaagaguuugaggcuguguguuugaucucucacccucuuuugacuucuuuuugcucuuccaccacaagaugaaacagcaagauggcccucaccagaugccagcugcucaaucuuagacuucccagacucuagaaccaugagccaauaaauuucuauucauuauaaauuacccagucucagguaggcuguuauagcggcacaaaacaggccaagacagguauuuaagaaagaacuuuaaguaaccaaaauauuuuaaaagacaauauuaaaagagagauuugauacuggauuguagaggagaaauaacuuuuguauuugggaggaagguuagauuugacuuauagaaaacuuccagaacuuaaauuugucaauugggaguuuucaauauauacuaaaauauuauauuuuuauaaaaucuuuuuugcauauauacaaaauacaaagaacaaagguuggcugggcacaguggcucacgccuguaaucccagcaccuugggaggccgaggugagcagaucaagaggucaggagaucgagaccauccuggucaacauggugaaacccugucucuacuaaaaauacaaaaauuagcugggcgugguggcacgugccuguaaucccagcuacucaggaggcugagguaggagaaucccuugaaccagggaguuggagguugcagugagccgagaucucaacacugcacuccagucuggcgacagagugagacuccaucucaaaaaaaaagaauaaaggucauauacaauuuuacacugguaauaaacugacauuugaauuucucuguauuaucuuauugaucuuaaaaaugcuauuauaauuacgcaaauauaauuauauauaauuuucuguucauuauucaacgagcauugucuagaaguauuuuaaauaugucaacuuucacuguaauucuagcuagcuuaaaauuuuuguaguaguaaguauucacucuuucaaagauacacgaaucucuaaaaaguuauaugauuucuuuaaaauuuaacacccuucuaacauaaaaguuaugcaaaaccccagcaaacuaccaaaacaaaccauguauaugcuaaacucaaauugccuaaaaauuuaaauaacagaauaaaguagcaauaagauucagugaggaccuguuuauaccacucccugguaguuucaaacagucucauugauuaaaccuaaccaagcugaaaauccuugcaacuaccuauuaugcauacuagacuuuugcagaauauuaucaacaaauauuuauugagugguuguaucccuuuccaaucuauuauucacacuacaauuacaaggaucuuuguuaaauguuaauuguaucaagucaugccucuucuaaaaaucauaaauggcccccugucuaccacaacauuauaucuaaguucuuaaaauggcucuuggaguauuauaacaugcccugcucacuucugugacuuuuccuuucucuagucucucugaacuaaacucuucaacuacagggauccaacuucaacuccucuucugagcuuuucagauucuggcucuaaucacaagcuaucaccucugccuaccacacuauauccuguccuuucuaacuuccacucggccuucacuauucagcugagacaugacauucacccagaauccuuuccuggcucccggcgcacccagugcuucacuccuucagcaaccacauaguguguaaugucccgucuucuccacuaucagcaagagagggaccauuucucugugucccugcucuauauacaauggcacuuaguaaacucaguaucuuuuuaauacaugagugaaagauaucaaugccagccccaugcugaguccuugagacauaacauagaauaaaaauguauuuccugcacagagaauuugauggucuagguguucauuuacauuugaaaaggcagggugaaacagaaaguaaccuugugaucaccauaaacucuucaagcuuuauuuuccucuucuguaaagugaggaaccuucaccaccccauuuugugguacaaccaucauuuacugaucaaaacagaaaacugaucguggucauuguuucuucucucucccugaaacgcuauuucccauacaacccaaaaagucucgguaugaaccugcaaagggauauuuugaaucugaccacuuaucuccauuuuuucuauacucacaguaauccacuuccccucucuuagaccucuaaaugcauuauuuccauucuugccccauccaauuuauuuuaauauagagcugucaaacuauaaauagaagucacuuuacuuaaaaucucucucaaugacuuccuaccauccuauuaaugaucugauuucuacugaccucuccaaacauaccuccaccagcuuuguccuaguaaagcuccagccacauggccuccuccagaucuugcaacaugccaaguuuuuuccaccucagaaccuuuauacaugcuguucauucuggcuagcacauucuucccuucacuuuguguaugccugcuuccuuuucuuccuucaguuucaauguaauaccucuugaaauagacuuuccuuggacaccauaucuaaacugaacucucaaucuguauuccuguuuuucucuauuacccauucacugaucuuuccuucuuuguucuucagcauauucccaauagauagagccaugucuggcauacaguagaaagacuaaaaaugauuuaggaaggaagcaaaaaggcagggaagcugucuauagguguaauauaugcagacuauuuugaugugaacacaagguucuuauuuucucuaaauuucaccuucaacagccuaacacccaucaguagagauggauaaaugccuucuguuuugaacacuaccguucauacauaaguuaccugagauuaagucauguauuaacauguaucaauauagcugaguuuuuaaaaguagaucgcuguuaccuuaggaaggacaaacaggagaauggaggaaaagaagauaaaacacuggagaauuuuaauaagagagaacaagucgacaaaguucugaaaaugaaguggcaccuaaaggcaccaggaagaggccacagugauaaaucucuggaggagaauaugaggcaaaacaacauuuaagucccagaaacccagggacucaacucggguauaacaguaguaaaacugacagggcagagguaguaguaaagauaaacccugaguaacucacauacaguuuuccuuagaguuuuauugaacagauuuauuaagaaugaaaacuggaaauuucauauaauaucacauaaaacauuauccacauuuuaagauucaauaaauuccuuuaucacuccugggcaaaucuaauauuacuaaauguguaauauuacuaauuugaggucaaguaaaaauuccaaguagacagauuuuuacaucaaacuauuuuaguugugcuucauuagaaagcucaacaugaucagguucauuuccucuuggucaccugaggcacaauuugcuacccaccacucugcaauaagcagcuguuugcaauaagcccuauguugcacacauuggacugucuccugggguuuacaggauguugauuccuaaaggccagauuuaacacuuuggggaaauauaaaagacagcaugcaaauacagaagaagaaauaauguaugguauuugauuauuugaggacugcaacauauuacaggaauugguuaccacagaaacugugaucuguaaaugguccagguggaauaugcuugaaaauaacaugauaugcaaaaacugaguugacucauagaacaucagaggaggcuagugcaauggagauuaucuagugggauucuggcuaguggcuaacaagucuagcucuguauucaaaguacuaaugucccauuugacaauccugacuggugaacaucaggccuccaccaaaauagcugcuauacuguccaggucauuuuaaggcagcucuguuauggaauucuucauauugagugaaaaaccuaccuaaacucuuuaauauacacccauguggcuaugcuccuuagagccaagagaauaaacugaauucaucuuccacaucuccacaaauacuuggaagcagcuauugcauauccucuugccucaguuuucuugucuucagauuaaauagcuauagcuuauucaauuucaaccauuacugcaagacauaacauuggguuauuucaauuaccuaaccacucucuucuaaauauguugucauugcuauauuucaaugaucaaagacaaauacacuaagucaacgauaagaaccaucauauguaguaagugcuuuguaugucuuauuucaguaaagccuaauauggaagacauuauaaucaccaacuuauaaaugaagauacugaggauuacagaaauagaaauacuugcuagaggcuauauugggaguaacaaagucaggaauugaacccauguugacuccacuaugcccuaacccuuguccugggcuauuucaggagagaccuaagcagagcagaggagagaaggggguaagagacacuacugagcaucuguuagauccagaaucuguuauucaauauguaagcugacucauauauucaaacuaucuaugcaaucaacauaccaacuacauuuuucuccaaguaguuuggauggagccuuccaaaugauccaggaaaaagugugaacuuaccucacacuuacaggcccacugaguuuuuuaagugauaaaauuuauacuuucacuaugguauuuuaaaagaucccucuggaaguauacauggacagauaaacagaaagccacacuagagacugagagcuuauagcucugaggugagccaagacaagaagcugacuagauuacagguguguagauggaacaauauuuaugaauucaagagagauuuuuaaaagcagaacugacaguacuuggugaugcuuuagauuuguaagcugugguauagcagugacuuagaauguggcucuggucagacucugggcuuuaaauuccagcuacaccacuuuaauuugugugaaugaagcuauacuuugguuucuguaacugugacauaggcacaagagcaccuaacucauagagaugcuggcaaaauuaacugugauaauagauggcagaggguuuaaaaagucucugucucauaagaaauguucacuaaucacuaaugugauugauaaggagaagaaggaaaaaaaagaagagaggugggaaaaggcagucuagaacgacugccaagucucugcuuaggugaaugaauaaacucagagagaacagaggcagaaaggcuggcuugaggaagaagaauuuuguucugaaugugaugggcuugagguaugugacaggcauacagauagcaauagauugaagaauauggagugucagcaggguagucuagccuuuuaaagaagcuugguuaagaaggaaagcagagaggauguaagggccagaggagggaagugacuuauuuuuauggguacacaagcaaguuagaguuugaaagagaaaugccagaagacagggagggguugaagguaaaaacgauuaagaaguggacgaaaccagucuccaagggacaaggucaggaauuaaacucauguuuugcuccaaagccccuacccuaacuccugaccugacuacuugagcagaaaccaagccagggcagaagagagaauggauaaccagagaaacaggcuaagagcacaagaauaagcuucaagcaggacuaagaggaacaguaggaaagagggaaggauggcuacagagaggaagccucucuccgguguucauauuucccaaucaccugagaucagcuccaaggagguuggggaguagaggguugggcuugaguaugauuaucagauuuagaauauaugaaaaaaacaggagagaaagggacaaaagaaaagccauuccugcaaugagcuucuacucaaucuuucaaggcccaauuccauugugugucaucugugacauaguuccccaccuuuccucuuucauaaaugaaauuuaucucucacagaaaauuuuauuuuaaaaaguucuaucaagacuggauuaagaaaauguggcacauauacaccauggaauacuaugcagccauaaaaaaaaggaugaguucauguccuuuguagggacauggaugcagcuggaaaccaucacucugagcaaacuaucgcaaggacagaaaaccaaauacugcauguucucacucauaggugggaacugaacaaugagaacacuuggacacaggguggggaacaucacacacuggagccugucgugggguggggggaggggggagggauagcauuaggagauagaccuaauguaaaugaugaguugaugggugcagcacaccaacauggcacauguauacauacguaacaaaccugcacauugugcacauguacccuagaacuuaaaguauaauaaaaaaaaaguucuaucaaaguauuuaugaagaugaaauacuucuaaagugcuuauauaaaaucuuuauaugagaagauuuuaucuucauaaauacgucucuccaacuaggucacauuuuguuuaaugcuaaauucucauccacucccuaaaacacaguagauguucauguuuucuuaaaaagacugagccaguuuucgguccaucuaacuauacucuaauacacuuccuucuccauuucaguauguuagaaaccaaaugaugcaguuuuugagaauaacaaauaaagaaaaccugcaaaauuguccuaauagcaaacaguuaacaugagucugcccuacgaauaagaucauugcuuccaaacguuuuuaaaauacucccaaugguauuauuaguaucauuuauagaacuagacuugugugauagucuuuagaaacuguuaagauagcauuaaaauauaucucauaggucccucgaugcucuccugguacaaaaugaaccugugccauuuacauauuagcugacucugacauccaaggguucugguaucugaaagcaaugaauaugacuucuucuguccaucuuauguguaucucauaagcuccuaaggacuuuccuggaaagauuuuagacuagcaaagaaauauuuucuucaucaaaaauccuuucaaguauuuauuuccuucccaaguagacugaguucuguguguacugguuaauacuuuauaagcuucagcuugcaugcagaacacaucagaggcuguuuuauuuccagacauaguuuuccugaaauuuuaauuguuugccaugaggaaaaaaaugauuucagagcucaaacuacauuaccuacgaggagucucccagagcucuaauuaccagaaucagaacauaggauugcuacuucaauuccauuuuucacuaaaauauuggcaaaauaacaaauuaaauaaaauuauggcuaauguuaauaacaauaaauuauuuaacaaauaugaaggagcaccuauguugagcagcugcuauguuaggcauugggaugguaaccaaaaugcaugaaacauuguuuccacucccccaagaauuuuacaggcaagugggaugcaauauaccucacuauggaaaaaaaagugagacagcaaaaaauaguuuuaaauuuuugagcaaaguuuaaccaaaugcaacccaguuaauuuacaucaggugccuuucucuuuaaauuucaaaugauaaaagucagcuucucccucuaaacuucaauaaggcaaauaaauauuucuuggcuuucaugaagcccuaggagccuuaacuaugcaacaguucauucacuaagaaugccuguagaggaagaaggguagucaggugguaccagcaaggggaguagaaugaagucccugcuuuaaagagagacaagagcuagauaaaacagccacugaaagaaaggaaaggaaggggaggccaaagaaaauacauggcuucucuuaguagggccaaaucaugaggcccaauccagccuucuagcuugacuuccucuccuauugucucucaggagcccucucccuguucuagucaaaauaaaugucucuucucugauguagaauaagaguccccgacccacacccaauaucauggcucucaucuacugcaugugagcucauuacuuuauuuaucaaaacaaagaugguccuuuuuuuuuuuuuugagacggaguuuagcucuuauugccuagacuggagugcaguggugcgaucucagcucacugcaaccuccaucuucugcuuucaagggauucuccugccucacccucccaaguagcuuggauuacacgugcacgccaccaugccaggcuaauuuuuguauuuuuaguagagaggggguuucaccauguuggccaggcuggucucgaaauccugaccucgugauccaccugccucagccucccaaagugcugggauuauaggcgugagccaccacaccuggcccagauguucccuucuuaaaaggaauccugauguuaacuauuaaaauaauaaacuauauuacauaucaucaagcuugcauauauacauauauauauauauauauaguuggacuuaucuuuauuuuuuaaauauuaguguauauuauuauaaauuguuaggcuaugaacucauugaacagggccaucuuaguguccccagauccuaaagcaguacacaguagguguucaacacacuguaauguuacaauauuccuuccucagauaggggggucuaggcauauaauaauuaucugcauuuuauaugaucauucuucauaaauaaucauagccacaauagcagcuuuuaucugaagucguguauugauucagagaagguuucagcuugaccucaccauagaauaucaacuuuucacuuccuuucuauagaguauuuuauacuauaggaaaagagacucuaacaccucuuccaaaaauaauccauaacauuuaauaguuuauucauagucaccaugaggacuuugaccucucaucuuuuguaucuauuuuuaauuguguuagaggccacauuacccuaauuuccuuacaaaguuuccacuuagaccaaaaccgugaauacuguaauuguuggggaugaugaauuagaugaaaaauagacuaugcauuuucaaucauugcauuuaguauuauuaggguagauggccaacuauuacacaguaagagaugaaaguacaaugcaaauugaugaagaaaucauaaucuuaaaauuuucaacaacaggcugguauugauuuugaugugaaaguaaaaagcuuacuuaauacauuuuuugcucaauucgcuauugcguguacacugggaaaaauaucuugcauucuauaccaacccauuaaaucaaaaugaaugaggggagcauuuuuauuuuauuuauuuauuuauuuauuuuugagacggagucuugcucugucacccaggcuggagugcaguggcgcaaucucugcucaccgcaaccuccgccuccuggguucaagcgauucuccugccucagccucucgaguagcugagauuacagacgcgugccaccacgcccagcuaauuuuuguauuuuuaguagagacgggguuucaccauguugaccaggcuggucuugaacuccugaccucgugaucugcccaccucagccucccaaaguucugggauuacaggugugagccaccgcacccggcccaucuuuuuuacuuacacugcacuguguaacucccaauuccugaugauagccagcuacaggagcaauucaucaccaacaucauuuuaucaucaaguucuuucauaucugauaaaaccuauuccuuucugacauauguaaauuucaaaugagugcuacagauaaaaauuguuaaauaaguggcuauaaugugauuccaaaaacaaaaggcacccacucacuguacuuuguuaucuaauuacaugaucauucuguuaaacuucaagcaauguauuugaaauaagaaagugcagacauauuguccaucucaauuucauaaauguuguaucauauauccaaugcauaucacuuuaaauuuuuucaaccugcauauuucaagacagcugcuacacaguacuuuaauuuuuccuguuugauauauuaacaugcagcugaaucugauuugguuacaacuucucagugaaaaagauguucaucuacuuaaacaucaguuucaacagaauggcacuugacagagaauauuuccuuuuucuguacuacuuuuuccaguugcauuuuauaucaguaugcuucccauuaacacaacaaauauauacauaaaaccaagacauauguguaaaagguauaaaugcagucaauuagccagauguuuggaaucauggacacaaacaucagaagcauuauaaaaccuacaggaaugguaaugcuugacaggauaugggagaaguauuuuuuaagaaaaccuuauaaacauaguacaaagaugacaaagacacaauuauagcccacugcagcccugaacuccuggguucaagcaauccccuggcuuagccucccaaguagcuggguaaugcagguacaugccaccaugcacaacuaacuuuuuuuuuuuuuuuuuuuuugauagagaugggguaucacuguguugaccaggcugaucuaaaacuccuggccuugaguaaucauugugccucaaccuucuaaaguacugagauuauaggcaugagccacugugccuggucauacuguuuucugcaauagaacuuaccuccucucucucaugcuucuguagcaccaaguaucagaaaacauaaucuagucauuucuagauaagcuuacaucauucugauuuuccucaguaauuucugcauaugcucaucuuaagaauucaugacuucucauccuucucuucccuaaggugaggguuacguggugagggaaguucacacagcagccgcaugguaucggugagaggcauuggaccuguagcacucugauuuggcaccugucaagucucuagucacagcauuugugugaucggguuuucagugaacuaucuguagucuuaguagacucuaaucauguauuccauacuaccauuccuggcuucuucucaacauuacugugagguccuuuaaagcacuggucuugcauccagcucccuuguucugcccaaaagugcaugaagucucaacugccuuccugggcccauaggagccugcuaacuaucuucuaccugcuuuaucuacagacuucucucauauaguuaaccaucuccaucuaagugauaccaugucauucaauaugggacacacccaugacauuguugcuucacaaaauuccagaagaagcaggcugugcagccauuccaacucugccaccagcacacuaucaucagacaggggccuuagauaacgcuugccauccccuggcuuucaccuggagagugaagcacaaaucuccaaugcucaaaucuucaacuaaagggagcuucuaucauuaucccuggucucaggcuguagaggaaagaaaggcagaacacagggcugccaugucuccugaaccuuguuucaacuccccuucuaaccaaggcaacacuuauuuaauaaugugaugagaucaucucacucuuuggcuaauuucuuuccaaucuguuguuaaaaguuaaaauaaaaauaaauuuaugcacugauaucuucagagcuuuauuuuaaaaacucaaaacccuuuucuauuucauauagcucagcugcuugaaauacacuaucuugugugucaagauuauuaagccaacuagaaguuucaggagccuacuuagaacucagaaaaaagaaacuuaacuuuucuuuauugcauuaacacucuucucugaaaaaacauuguaauggcaauaagguuccguccaguucagugggaaaagggcuauggguauugaaaacauauacagacuacauauauacauaaauauacacauacacaaaaaaggacuuucucagaauauacaacuuaauauaucaaaagacuaucuuuauacauuuuuaugauagacaccauaaacauagucagcuauauauguuacauaaguuaugaauagaaaacacugguuuuauccacauauuucuucuuucuccuucuucugugucuucugaaaacauuugaaauaucaaccauagcugccuacauaggguccucugacagaauauuaggugauaaaaugguauaaggagacauauaauugaagugguaagaccagauauuacucagagagaauguaaaaucaauaaagaguagaacaucaagcuuuauauuuaggaaaaauggggacagaauaacucugauaccaaaaaaugaaaaaagacaucaggaaaaaacuacagaaccuuauuuauaaauauagguacaaauuuuccaaauaaaaucuugauaaauccagcugaauaguuaaaaauaugaccaaauaagauuuaauccaggaauguaagacagguaaauuuaaagauaccuauuaagguaacauauuuaccacauuaacagauaaauagagaacauauauauuaccaucuuuauugauaccuaguaucaaaggccaaaguacuugaaaaucuaauuuccaccuaagguaaacaaacagcaaccgacaacgaaaauaaagcucuugaccaacuggaaauagacaggaaaaaucuuauuugauaacauaugaggagccuaagggaaauauuacauuaaaugauaaauaucagaaggaugcccaugaaagucaagagggacgagagguucuagucaacaaagaaaaaaaauugagauguauaaggcuuuaaaaaaaaaagaaagaaaauguguuauuuugaauaauaugacuaccuagaaacacacagacaauaaacuuaaaaauauaaauaagaauauucugaaauaugguuggaaucaagaucaacauuaauggccuucuuauacacagaaauaagcaacuggaagacuuauuggaaagaauauuuuuuaacaauaacaaaaaaauauggaaaaccuagaaauaaaccuaagaaggaaugugcaaaguuuauaugaagacaacuauaaaauuuaaccaaaggaaauacaagaaguucugaaaaaugaagauacgccauucauucgacaaaaaguuaaaucccuacccuauccuggacccuaaucucaauagaauaaacacagcuauauagguacuagaauaaaauauuagagaauaaagagaaagugaaggaucugaaaaggauacuacuggggaaacguacuaaugaauuuaguuuuucccaagguaaucuuuagcagcagcauccaugaauaacuuuuaugaauguccaauuuauaauacaguacucuaaaacugacaguuuuuauugaauauaaagaacaaugguugccugugaaaagugaaauuaaauuuucuucuuaaaaguuccuuuauuuuuuacaauguacaucgaauuuuuuaaaaaucaaaaugaauaaauuuuuaaaaguuaaaaauauaauguacauaauaauacuaaugcaugacaucaguuuggugaaauauuuuucuuauauaaauuaauuaugaaaauuagcaauuuauacacuauaaaucuuuaaccagauacuguauaaauaaaaaguguuauuacucuucaaaacuucuucaauguaaauuguaauauugggcuuuauuacuuaauguauagaaucuguguauauccucuuaauuaguaauuucagauauuuuuucaaaauuucucuucuucaguuauucucauaaauacccaccaguuuuaagagcaauuuugaaaacuucuacucaaaacagaaaaacaauaaaaaaacagggaaaaaauagaauagaaaaaccuucuggucacucauaagauguacagaaauguuguucaugaguaaucuuuuaaauguucaccucuauaucaaauguaauuuauuuucuacucucugagcaaugauccaaacauauuugaagcuauuuuuuuaacuaaggagaacauacaauuagucuauuuugauuuugcuucauauuucaaagguuuguguuuaagcuuuauuaauagugcucuuuaaguuauuuuccucccaauaggucuuuaauuacauguaucugaaaauacaaagucuaauucuguuagaaaacuuaaugauucuuaaaauauuugcuuucaugaguauaugauuaucugaaaaacaaacuccaaagggcaauaauuaagcgacaugggguuccacauaggcagaauuuagaaaauuaaacuaauuuucuauuuuauuuaauuuaaacauuaaauuuaaauuuagaaaauuaaacauacaccauauauauauacacagaaaacuucauauugaauaaaauacaaucagcuauaaaguagauuaacagacucagauuccuuuuaggcuaguaaauuugacucauucaacauguucagaugcaguuggcccacuguauccauggguuccucaucuguggauucaagcaaccaaggauugaaaauauucaaaaaaaaauuugcaucucuuaacauguauagacuuuuuguucuugucauuaucccccaaacaauauaguauaauaacuauuuauauaguauuuacauucuauuaggaaauauauguaaucuagaggugacuuuaaguauaagaaaggaucuacauagguuauaagcaaauacuacacuauguuauaucagggauuugagcauccucggauucugguaucaagggagguccuagaccagucccucacagauacagaggaaugacugcaaccccuuauucaacguuaaaucccaauuguacgcuuuuuaguguagcacugaaaaguuuuagaagaauucucauauaaacaaugcuauaaaguuaacuuuccagauaaacugaaauaaaacugguuuuuaaaaaaagaaagaauugacaauuuuauaguuauuuuuauucauaagauuuuaaaagcauauauaggcugggcucaguggcucaugccuguaaucccugcacuuugggaggcugagguaggcggaucaccuaaggucaagaguucaagacuagccuggccaacacggugaaacccuaucuccacuaaaaauacaaaaauuagccaggcguuguggugggugccuguaauuccaacuacucaggaggcugaggcaggagaagcgcuugaaccaggagguugcagugagcccgagauggugccauugcacuccagccugggcaacaagagugaaacucugucucaaaaaaaaagcacauauaugcaagcuacaagauuacuaucaacugguacaguacuuuauaaacuacaaacucaucuuugcccuaggauuaaucacuaaccacuucaagaaggaauguggacacagacuggcccacuguagcauuuaaaguuuuuuggcuaaauacacacaucuguguuguucuuuucaaaccgucaagauauaaaacucauuuaaaaccuauuuuuaaauaccaugcagcaaugaucccuuagaggcagcaacuuuagaugaugcuuaaacaaugaauuuuuuuuccaacaauaacaauuuucuuuaaauucauuuacaaaaccucaccacacagcaugagguauacuuuccugguaagcaacuauaaaguagaauuaacuauccucaaaugaccaugaaauuaagucagccauaucagauuaagaugaccauaaaugcaguuaaaaccaugcuaauuuacauagcccccuaaccauguuuaauugccacauuaaaaacccuucagaugcuggucuguccuuuuacaacuuagaacagugucaccugaauuaacuuguuuugucugaauguugcacuuuguuuuuucauuuauauagcugggaacauucaugagcucuaguuauuaugucuaaauauuuuuauuaaacagaauaaaauaaucaaaucuaucaaacugguuuuaaugaaguaagcaaugcauuuuuaaaaggaaguacucucuuagcccuaagcaacaugagucaucaugaagaaauuauauauauauauacuuauccauuucuaucugguacuuuuaaccauguggggcaugccaaucuucccaugagcauggaaacugaaaguaacccaagggcacuagccagcuuuggaauuacugcuauaaugccuccuacaccacacccaucacacucccauacucugauuucugcaagccacagcaagccaagguuuucacccuagggcauucuggacucuuuugauacccuaucucagaguagaaacccaaucuuuguacugggcugucaaccauucacuuuuuagauucagaguacauaaucauuuggcuuguuuuugcuauacccucugggugccucacacucuagaaugaacuauuugauuugcugacaucuaguauguuuagauuucccuuccuuucuggacuacucuuucacguuuccucaccuaccccacagccucagaugcauuaucuuacuacccucuauucucagcuccucaaugaccaggauauaaccaggaacugaggauaaaucauuuauuccacuuguuacuuaggcaaccccgaaacguuaaugaaagcaucuuuugccaucauguauuauauagaaucuucaguaagcagcaaugcauaacaagacaaaagugacugauucugaccuaccuaaggaaaaaaaaucacauuaucuugugauuaucuuggcuucuucccuaacacaauaaucuuugguuaccauaaugccuaagcucaauuagaagucagaaaccccaaaguauccacaccaggcagcaaagcaagaauaaucaagauugacauauuucaacacacauauaguugcacugaaaggcucccuuaaccaauucaccagacaaccccacccccaaaagaauuaugcaugggugaaauuucuauaguuuuugcacuaaaaguaaagucuucccauggcugccagaaaucaccaauaugaccguucucauuguugaucuuaugcuguuauagcaaccaagggagacaacuggaaaugggagaaagucucuuuuagacugaugaaaauuaacaagggacagaaaucaagauaguaaaggaaggagaaggugcugugauuuagccagagauaaucauugucgacauacuauuauauuucauuuuagaucuuuuuccuaggugugcagauuaguguacucaacuccauuucaguuguguucuuucaugcacgcuaaguuagauagcuagaacaaaagcuaagcuagaaagcuaaaguuuauuuccuagacuuccugacaguuagauguuggcacaucaccuagcucuugccaagccgauacacuggcauuacuuuggaaggcaagguuaacacggugagacagaggcuggcugcuguugccucugcuguuuuuacuggcaaggucagugauacaaaaauuugauuuuucugcaacguagaucugaauguccaaacucuacuuucaugaaaacaaaagcuagggccagggcauccaugugagguggccuccuaauucuccagguuuuuguuuguuuguuuguuuuaaugagacagagucucucucugucacccaggcuggagugcaguggcauaaucucagcucacugcaacuuccaccucccagguucaacagauucuccugccucagccuccugaguagcugggauuauaggcacccgccaccacuccuggcuaauuuuuguauuuuuaguagagacgggguuucaccauauuggcccaucuggucuggaacuccugaccccaaguaacccaccugccucagccucccaaagugcuggaauuacagacguaagucaccgugcccggccucuccagguucauaaacaccacagaaauugcagcuuccuuagccaccuauaaaaugagcagccacuacuccaagcagaaacaugcucauugguuguuaagcaagaaauaaacuuucauuguguuugaaccauuaugcauuuuuuaaucucuuuguuacauaagcuagugguuacccuaacugauaaagaguccaauaaauauuuauugaaugaauguuaaagaagaggaaauaaaugcaagaaguagguggagggagggugggaaagauggugaaagauaaauagaugguuaaggaucuugauuuuuuaaagaauuaaugggauaaauguucucuuggaguacagaauuauuucauacuauuauaauuacuaaauuaauaauaaccuauuugaauuucuuuucuauugguuuuucaguauaacaucuguucacaauuccuauccuguugaaauuuauacucuaauccacuccauaaauuuuaaaaaaugguuuugguuucugauuacaauuucgccauaaugugauuacaauuucgccauaaugucauuacaaauccaaaaguaagggaaaguccuccauaauacauggagcuaaaaucaaauacagacaucaacauaauacauaugcaaaaacuagauuuccauuuuauuacaugcauacuaauuauuaaaauguaacacuuuugauaauauuuuaaagcaguguccccauagugugcucugaagacgccacucugaugguccccaugaaccuugcaggggguccauaaggccucccuuucccaaguacauaccugugugagggaagauuguuuucauacauacuccaaaucaaauaacauuacacaacauauugaaugcaaaagcagauaugagaauccaccuguuuguauucggccagauauugaagagauuuaugaaaaucuaaaacaggccuggggcacaguggcucuugccuguaaucccagcacuuuuggaagcugagguagaaggauugcuugaacccaggaguuugagaccagccugggcaacauagcaagaccucaucucuacaaaaaauaaaaaaauuagucaagcaugguggcacauaucuauagucccagauacuugggaugcugaggcaggagaaucacuugagcccaggaagucaaggcugcagugagcuaugauuaugcugcugcacuauagccugggcgacagagcgauaccuuguuucaaaaaaacaaagaacaaagcaaaaguaaaauagugcccucuucucacuaaauauuuuuguuuugaaauauauaguuauuuuucauaaaacugucguauuuauguugauacauaauaaauauuuuuauuuuuaaaugaugaauauauauuuuaaauuuucucaaucuuaauuuccaauaugcuaaauauugaugaaacuaacccacagaacagaagcucuuuaggguccuaaauuuuuaagaguuuaaugaaccauaaauaaacuagugaaauccuguaacaaugccaggauuccuuuuauuaauaguaaacaauaaacuauauuuaaauauagccaauuuucuauauguacaaaaugcuaggcagccuuccuauugcuguaguagaaauaacauggcauugaacacauggguuuaaauaccaguuucauaacuuauuaacugugugggcaucuguucccuauuauucucacugcuaccauuacaacaaacucaacguuaugcauaucaaaacuaaaauuguugcauuuugcaagcauucuugaagauuuaauugugcaggauuauagagaguaauuuauauauaauuauauacacuuacuaauucaauuaucugggaguauauuuuagcuaacucacuauucagaguuauacuuucuauaguagcaguugcagcauaacugaguauucuuaaagcaagcaauuaauaaacuccaacauaaaauuuuuccuugccaaauuauaucugucuuguucuaucgaaacucaacaaaacauuuacuuguucaagggacuauguugauccaaagauuucccuucaggaaaaugcuggugcugccuagggauacuaguagcuuuccauaaaaaaaguguucaacuaagagagcuguccaggccacucaucuuugauaacagaaguucagcuuuaucauaaccuguaugucaggcauccaaaaccuaggaaacuacucuucauuacuaacaagauaauaaccuuucaguagguauuaucucaauucuuuuucucaucuacauuuuacaaaaugguuuguugaagaaaguuagguucuaaaaaggaagcucuaaaacaauagucuucauuuuuuuucucucauauuccuaaaagaauuuucuaaaaauacacaacauacauuuucaguugacauguaaaaauuuucaucaugaauuuaaaugauugcaaaggcuauaauuucuagcauguuacaaauacugccauuuuuauauaaaacuguuauaccagucuuuuaagaguaccaaagaaaucuaacuuccacaguaaucugauauacaccagcaaccauuuuaucaaaaaaaaauucaagaguuagaaaauuuauacacacuuuuuugcuuaaacucauuuccaguuaucuccccauaggauuuuacccuaauguaaucguuuuuauuucuaaaaguuuuuaacugauccucuaucauacuucucuucaauaaaaauguaccuuaaaauugaacuuuuaaauuguguuuaauuuucuaaaacuguaauguucaaacuaagaaauauauggaaauguauuucuuaaugagaagggcuagauuuuuuucuuuuuuaaaauaguuuauaggccucugaaugaauguuacucauugcuaguauaagguuucacauacauuuuuuuucuauuuuuuauuuucucuguuuaugaaagaacugaaacuguucacuaaguagaugagaaggauguuuuguuauggcaauguuacuaaauccuucaaaaucacauagcuuauuaaaaauauuugaugugugaaaacuaucagcuguuaacucaauuacaucucccuuaagucuguugaaaccgaagaauuagaaaccauaugaguugcaaaaggauuuuuuaccuugaguuuaggucauucacuuuuucaauaccaauaccaauaccaauacuucuagcuaauccucugcuaucaugaugcaagggaauuuuccauccuggagaaguguacaaugagaagaucugggaggggcgagaagucugccuugcuuguuguaacaugagucaagagcaauucugaaaggggaguuaggaaaggaaaagcugcuuucacugucuuucacaggaggaccaauuuuaggacagacuauggaaacugaggacuuagauuccuucaaaaucaacuaugugcaaccuuggcaaacaaucauauacaaauuugaagaccucaaaucuaagggacacuauuccuucacuacuccaaguguuuuaaaucccuucucucugucucuuuuuuucauacacacaugaaugcaagccaaagcccauucacagaaaacaaucauauaaggcacaucuuugcauuuauuauaaaauuauuguuggugccacaauaaucacaauacugaauaagcucuaaauccuugcuacucaaaguauggacuucaggacaagagcauaaagcaucauaacccuguuagaaauguggaauuuggggccccauuccaaacauacugaaucagaaucuaauuuuaacaaaaucuccaagugaucccuaugcagacaaaaguuugagaagcacggaccuaagaagcagagaaauaauuuuuaaaaauguaguuuguaaaaaacauaccucuuguagaaauaauauuuccuccuuuuugaucauaauaaaguaacccucauguuuccauuuuugucaaucuuacuagcaccagccaguguauuuccuaagaccguuaaggcuugaaguaaaaaauauauuggaaauguaucucuuccucauuauccuggauuucuggaguguuagucuagcugauuugucugccuacggucuuuccccccuucaauccauccucugcacagcugcaagaguagaauuuauauaacaaaucuaaucauaggacucuccuguuuuaaaaccuucaagguaucuccaaauuaaaauacaagcauauaaggacaagauuaccugaucccuauugaccucucuagccucaucucccaaccaccucccauuuucuccuguacuuacucuuuuagcucccuguacacaccacgugguuuuaugcauuaccuuuccaucauguugucccuuaccagaauauccauucccuauuuauugccuagcugauuaucaccugugccuaaagguucgauucaguaaucuucuuuuccagaaaacuuucauguaagauccccccccacacacacacaucuaccccuuuauacacauacaaugggcaaagguuauuuucuuuguacugucacagcacuuaccauuuuguauuuaaauaauauauuuauaucucuguuucucuauauagacaguaaccucuucuaaggacuaacaaaauuaacagcacaaagcaggugcuaaacauuaaaagucaaauugaauaaaacaaaacgugauuguuaaucauaagaauuguaauagccagcucuuauaauuagcauauucacuucucuauucauaugcuuuuaguguucuuaugucaucugcuaguuaucauuuuacuuuuauuuugguuuaaaaaaaaucuaccucaauucuuuuuuuugcaacuaggcagaguauacauacguauauagagcacagcucugugacuuuggugaaauuacauaaugugucuuagucacaguuccuuuauuaauaaaaugguaauuacaggaucauauucaguagguaggauuaaaugaggaugcuauagucccagcuacucggcaggcugagacacaagaaucaccugagcccuggaggcagagguugcagugagucaagauugcgccacugcacuccagcuugggcuacagagugagacucggucucaaaaaaaaaaaaaaaaggauucaugugaaauauuuuauauaaacuauaaacauuggccaggcacggugacucacuccuguaaucccagcacuuugggacgccaaggcaggcgaaucacuugaggucaggagaucaagaacagccugggcaacauggugaaaccccaccucuauuaaaaauacaaaaaucagccaggugugguggcaggcgcuguaaucccagcuaccagggaggcugaggcaggagaaucgcuugaacccaggagguggagguugcagugagccaagaucauaccacuucacuccaaccugggcgacagagugagacucugucaaaaaaaaaaaaaaucuauaaacauuauauacauaaguaauaaaaauugcuuauuuuauuaaaaucauccauuauaacaaaaaguacagugguuagaacucuaaacaacaggaaauaccuuaagaaauaagauaaacuuuaaauaagaaggucuuaaccuuucugcugcugaacuuuuaaaauugaauucaguauaaaauuaauaccccgcaguggccuuugcacaauccuauaucuccuuaguuuccuguacuucacgaaagauguaggagaaauaagugauuauuugaaacuguucagguuuugaaacacaaucugcuaucaugaauauuucauuucuugaaaauauuuucaugcuuauccuuuucaauaaugccacaucauaaugcuuuauuucaucugccugugacagacaucauuacuaauccuauauagcugcuuguuucacgccacgcuagagcagcuauugaauuuccuacaacauggcagccaguccugacauucauaugaagaauacuaugauaaauauauaaaggacuauaaauaaggcaacaagaauuaaaacaucauagguucugaagguggcaucuugacuuaauugaaagaaacucaauacauaaccaaagcugaaggaugaaaaggagaaacaauuaccaacuaguuuauaaaccacaauuuaaucaacuuacagggcaaauaaaccuagcacucagaucuuguugaaaccgauuuuuaugaaacuugguuuuaugaaacuugguuuuuaaugccauuccucaccaaaaagaaucauggcuucuggagaaauggcuagcuucagggcuagauagagaagguacacaauuauccuggagcaccuugcuaugccaaaaaguaaggaaaugcucaaaaaugauuuuuuaaaaccuaucacaaagacuuagaauuauaaaccaccaguaaaaaaauuuucuaauaaaaaguagaaggaaaugaggaagaagggaugacugguagagcaggaugcugaagacugacuaguaaaugaagaggaaauacuggcacugguacaucaucauuuugcaaccaugacaauaaagccugguccaggcaagaauuauuaguagaugcuaaaucaagaagagaaauuuacaugcacggucucugaguaucuccccauggauugcucauuaauagcaaggggauaaguaguaacuaaaaaauagagaaacuagacaguaccuugaccagauaaauacugagagcuuccagaugcgaugccuggaaaaggaaaaucauuuauauaauauccuggcuaggaaugcaaaaucugaacuuaacucaugagaaaacaucaaacagaccucaaaugagaagcauucuauuaaaaaaagaaagaaaaaaaaaaaaagaaagagcaagggcgcuguauucuucaaauauaucaguguuauaaaagacaaaaaagcaagcugaagaauuguuauagauuaaagauuaaaagagauuaaagagaccugaaaaccaaguacaauacacggcuccaugcuggauccuguacuggagagaaacaaaaagcaaauguuuauaaacuacauuacuagguacacugacaaaauucaaauaugaaugguaaguuagguaauggcaauauauuaauguuaaauuuacugacacuggauauuauacugugauuauauaaauaaaaugccuuaaucuuaggaaauugcauugcgauauuuagagguaaaggaaggcaauaauaucugaaacuuucggaagauucuaaaaaaagaagaauauauacauauauucauucucucuauacauaugcauucucucuauauauuauuucauaaauacauucauugucucuguauauauguauacacacacguauauauguggagaggagagacagggagagagaucacaugauaaaaccaaugggacaaaauacuagcauguuaacacuugcuaaguccuagcuuuagaagaauauagguauucuuuguaccaucuuugcaacuuugauguaaguuuaaaaucauuuccaaauacaaagcuugaggggaaaaaaagcaggcaaaagauaaacacaaaauucagguacugugagagagaggaauaggagagaggaggaacgcacagaagaauaugcugacaguguucucggugacacuuguggcuguuccucuuauuguuaugcuuuauaacuaccuacaugcuacauauauuccuguguggguaaaauauuacguuaggaaauauuacaucagaaagaagaauaaagaaaaaaauaauguucuguaaauuguuuuaauaauuucuucaaaacuacaauaagaauacgaagagcccucacaaugcaagcacaaaaggacauacgcuaauagguauuuccggaguaacaaucauuaauuuguuuuuauuccuacuggguuaaaagcauaauacuauauuuagguccaguuaguuaguuaccuucauucuuccucaauuugguaguacuuguuucucucagcaaaaaggcuuuuuuuuuuuaacacaacauguaguacaguuaacaagaguuaauacacagaauuauagcuaacauuuauugcuuacuaaaugccaggcacuaugcuaauaaguacuugauauucauuauaucuuucaauuuucacaguuacuugagcaauauauauccuauuauuuucccucuuuucgcauggggaaaaaacagaaauagaaagguuaaguaaccuguccaaagccacacagcuagugugaguccaaauuugaacccagagacucucauucuagaccucauacuuguaaacaacaugcuccacugcacuugaaccugagauucugaucucaaauaguucuuacauugaaaacagagguaaaaugcccauauaguacuuuaaaaccaguggauaagcaauagaugauagcuauuauuuccauucacugagcaacaaacgcuguacauaaaauaaagacuaucuuagauuugaauucuccucuucguuuuuccuuuugaccacucauuaaaaaaaggaaaagguauuauuaaguaauuaagaugccaccagagacaaaaggauagaaaaacuuuuaaaauauucucaaucuauacacacuagauaauccacauuuuauaaauauugaauaugcuuauauggaaaaugcugguuauauuggauauaggaaaaaagaguuuuccagcacaauagaauuaucagguguauuaaguggauaugucauuuuacggcagcccagcauccagcccuuuuccugacaucaccccuacuucuuuugggggaauuuucucuacuaugcaguccugguggaagcauaaauccaaauacauguucuccauuauggaaaccaaagaugucuuuuaaaggcuacuuccagaaaacucucugcucaguccaaugguauagggaagugaacauauaacccaaguucagucagucagacacauucucucaagacuuaguguauuaagcagaaucaaugcacauaccaaagacgugguuagaguuuauuuacgccagcaacacagccuaacauuuuuguugcuguuguuccugaaaguucuugcuaccaagaccuuccagaucugccuaauucuuaucuguuucaagcauaacucuuuagucucccuucaauccugugagcuuuucccaucccagauaccagauaugucuaacaaacuccuuuuuugcuuuuaagucaaucuguuuccuuuacuggcaacaagaguaacaacaacgacaaaucuguaaaauaaaauauaaaagcauaaggggauaaaauuauauaaucuuauuuagcaguucuuugggugacuuuuauucuuuuccaaugguuuaguauacuggaaaaaguacuggccaaaguauuuaaagagcuaaaaucuaguccaggcuuuccaucagcuggcuucaacaucugaagugugaauucauucugguccucauuuuuuuuaaauauguaaaggaaaaugguuugaacuucaaguuuuguuauauucauaaaauauuauguuuuauagaaaggaccaaagauuucaaugacaauaccaauaauacagaccuucuuuuaagaaauuagcacaugaaugacuguuacaguauuuccuauucuuuuuuaauaauaguuuucauagaaauaaaauguuacaguaguuuuucaaugacaaacaggaaucaaauacuuucagaccauuucccuaaagggaugacauuacauaucuuagaagauuuagugguaagaaaaaaauugguuugaaauauuacucucaguaaauagcauuacguuuguaagaucuacaggcaaaacaaugcaucuucuauagguuuuuacauuuuguaauaccacaacauucuccugaaauguaauucccuucauguuuucaaauguuuugcuacaguuguauaaaauucauugguauaauuacuaaggaauauauucauaauaguacuaggauuucaauuuucaugaaagggcuaaaauuacucgugucaaagucaggcaaaauuuugcaaacuggcauuaaucauggauuggugagagucuaaaaagccaguaggaaaucauagaauaaggucagaaggaguuuuaauguugaaaccaauauaucaauagaaaaguauugcuaucaauucuuuaaaaauuaaaaaacaaagccauuuucaaaagccaaucaagauuaacaucauuaaaucacaucuccaagaauaauaauuauuuaauuuuaacacuuaucaagcauuaacuguaugcuugauuuaaaaagcaaugagacuuuguucuucucauaaaaguuuuaucucccuagaccuaggcuuagauauacuauuuguuaccaccucucacagcaauucaaaacacagaacaacuaucauggcagucauuaugcuaaauucuagaugguaaagaggaagaugaauuaguccuuggucuuaagcacucaccgccaugaaaucaacucaauauaaugugauccaugcuagaaaacaaugguauuuaguauaaucuguuaaggaagcaauuaauucuguuuagggacagaggaaaaccuauaaagaaaaggugacauauuaaaauuuuauaaaaaauaucaaaaacucuuauccagacaaaggacuucauugucggucagaucugaguuuaaaccccaacucuaaccuguguugucaugugaaacugagcaaguuguuuggaaaccuagaaucuaggccuaguucugcugcucuuaaaccaugcccucaggcaacauuuaacaucucucagccccaauuucaauggagagagucagugagucauucucuaugauccuuaauuuccccuccaguaauaacaugaaucuacaccuuauaguaaauuagagaaauuccuauugauauugaauguguucauuuagcaaauaccucuagaauauccaacuaaguacuacugggcuuagcaaguggaauacaucauugaacaaaauaagcaaaaaucucuguuuucagggagauuacacagaaaacgucuauggaaaaacuuuuaaaauacuuuauugcacccuuguucaaacguaacuucccugugcaguugacauagacguuaaaaauaguuaacacuugaaaauuuccaaauaaccauaaauauuaacacagagaaagaaaucuagauagugaugaagcauaauuaguagcacuaccaucaaaaucccguuucucuaaauucacacugagucagugagcuuuaguggcuugacaaaaaggcagcauguuaacgagauuccccuaaaccaguuuaguauauagccauauuuuuuuucucauuuaaauuauuccauaguuucuuaagaacuaugauacaaccagguaaguuuuauuuaaagauaaauaaaaucugcacauggugagaaaauauuaacacaaaaaccuauuaucucacuucuuuuucagacauuccacuuccauaccugguguuuuucagccucauuuuaggcuauuuuauuauauaagauuuuuauuugaguuauauaucaucacuguuugaaaacugauuuauuauucaauagucaagugcaagacauccauucuuaggcaucuccaaagcagaaacacagucagaguaugccaggugauggaggggcuacagaaaggauacaugaugagguaaggaagaacagaauauagcugcccucaaaauacauagcaacuugaggagagucguggcaagucuuacaaucuuccaugcuuggacucuucuucacuaaucuacuaauuucucuguacgacuuuucccauucucucguggugaugucuucuucauggcugcuacaguauccuagauucugcagccugccuucucucaaaaugucugcauacuuuugcaucuuucuauuaauugcaucccuuucuuagaaaagaagaucuuacugggguuguggugacuuuccaguauggacuauaaaguccucuuguucagcccccuuaauggcugugugcuuuugacugccuuuggauaauggggucacaagauuuuuaaaaaacaaaaucuuguuagcauaugccuaaggcauccaucaaaagaggacuauagcauaggaguaccagaaaguuucuaagaaagacaugcaaguacuuucuguggacuguucaccauguaacgauacaguaucaccauagagacuguauguacagagacugaacuuaaaagucacucccacaauguuaaggcauugcauuaaaggcacaaaaguaaaguaaacacuggcaaauauauauagcauauacuaaaaauuuaaaauucuaaaaggugugaagagguggguguagucauauguuuauguaauuuaaauaggcucagcuuaggcaacuauucuuugaagcaaaacaaaacaaacauacaaauaaaauauugugaaaacacuguuuuuaaagcugagcuggucagcaucaaacacgcacuucaaaguagugagucuuaaguuucauaacugguauucuucaaacugugaaacucagaauauauugacaaauggccacaauuuuggguaagagaacaaucaccuugacaaacauuuuccaaaguuucaguauuccaauuuugucaaggagaaacagccaggauuacacaacugccagucugagguucugugccaacaucaugcauaaaaauugcaagcaaugaccaaacaaaauauaaaauacaaaggacaaaugcuugaggaaauggauaccccauuuuauaugaugugauuauuauacauugcauacccguaucaaaacaucucauguaucccauaaauauauacacuuacuauauauccacaaaaauuaaaauaaaaaauuugaaaaaaauacaaaacacaacaaagaaaacuuuggaauaauacuuccuuuaagcugaauacuucuauaaaauacuggagccacaugaaagaaaagaauacguaucucuuguucuccuuccuucugucagugggcacaugauaaauauuccuucacccuccaccugccacccaccagaucccacuggcuacuaucacacaaccacaaaaugagccaccuuacaaggaagcagauaccaaggaaggcagagaagagagauggagcugacugccuguaaacauucaaaugaucacuugacuuugucacuucuucugaugaguucuguucuuuuuuuuuuaacauaagcaaauucuguuucauaaaauaaaggaaaugaugagcaugguacaggauggcagauaagaaaggguauuuaaucuaucucuuucccuccuagucuacccaaaaggccaugaacauaauguaugagcaaggaugauaagaaacacuaguuuugcacuagcaaaacaaaacagggacagaauaauaugagcagucauaauuccucaucaguuucauuuuucuauuucaagugcuguagaucauugaucauguucuugcaaauacccauaaagucuacacauugaagaugaacaauuaggguaaaagugaacauaaaacauugauguaaucuguucuguuacccacuggaggaaggaaccuauaaaauuauccaaaguuuuaauuacggaggauuaagagacuugccccuacaauaucuuccaauguuuucauuauugaggauuaagaaacuuuccccaaaacacuuuaaaguagcauuaaguggugaaaaaaaaaaaacuguagagagaaagagaucacaugccucccacaggguaguuguuaaaugaguauuucuuaaauuuaacugaaaauauauaaaaggaaagaaaaaaauaaguuuucuaugaaaaggaaaaagaauucgagaugaucaaaaagguuaacauacuggaagacaguguggcaucugaggaauaaagguugguaucaucuacugggcagaauuguuuugaaaacuggaugagauguuugcaaauauacucagcaaaugucacacaguaaauacauugaaauugagaaaaaacacugaauaaaagagagaaaccugcuuuucacugcuacuaaguaaggugaaguggaaaagaggccaugcaguuaggauccucuuucuugguccuuucaugauccaggagcugcugcuuguaaagcugcucuggggcagacauuucaauuugucuguuuucuugacaacuucaguuauaagcuuugcuaauguuuauaaguucccauuggagaaaaauugguuagugaggauuaugaacugaaggaaaaugccuucaaggauggguugguaagauuaggauaaauucuaauauuauacaaaaauaguaagauuauacucuacauauuuuauaccaaauuuauuucuccugugcugaguacaguaacucauaaaucccacucacucuguccccaagcaugaaugaagaacacgagaaaauacaucagggauuuaaaugaaugcauuuuuaaguuaaggaacucauauuugacaagaauggcuuauguuuuaggaaauacuauuuugaaucaaaucgaaguugagguggguuuuuuuccccuacuuuuuuaaucguggaggaaaaaaaaagccaaacaucaauuucuaaugguagguuugcucugacccuucccauuuuacucugcagcaaagaccucauucaguuccugaaaaaagccaagccuucaucauggucacuucagauuauauaaugggagcugcucugaacuauccaagcacaaagcaggucuccaaaaauugcucacaugcuaaagcuugauauugucaggugucuauaaaugcauacugaauaauguaaauugguaaccugcugacaaugcauuugcauaaaucaagucaauauucauguaauaaaaucaccacugagccuuuuaucuuuccuaguacugaucauucuguagcuaguaaaguccuagacuaggcugguaacuuaaaguuaaugaauggaaagacuggcauccuagaagaacaacuaagaaaaaccuaauagaacuuagugaugagaagcuaguucucaagaggaaaaaaaccaaaauuaggaaaaagaaaaugacaagacucaacaauuccacaaagugagcuuuucaaaguccauucuuucucccacauuauuauuguccuuaugucuaacaaguacucugaugaacaacauaucauaaggcuccuugcauuuuucacaguauaaaggggaaaaagccauauagcucuuacaaaguuaaacccaaaagacagucagacccugagagucaaacaaguaaaauggcuuuggccuuaaaucaaaagcuaauagggccugaccacauaagucugacccuuuaauaguauucucuccuagcuuggcaacccaagugagaaaacaaaguguugagguuaucuaagccugugugaagacacuggaugcugcauucaauguuagcuacagcuaucacauugcugagggaaaguuacauuaaaucagggaaaaaacuauugucacuaagucuagacuuuuguuuucagagacaagaaaaugugaaauuuaagcaucaaauaugauaucacgauguaucaagaagacuugaauauuuuugguaaauauuuacaguuccuaccacaguuuuagcuccuucauagcggggggucuuauacuuuaguguugucucccacuauuuaggaggugcucagaaagagagucuucacugauuauuaacucagcagaacucucaggauguaaacuauagacuaaaaguacucacacacugaugccguauuugccaaacauuaaaaggaacaggcuuguugaguguugcuacaaagaguagaggcaggucaaaagacaaaaacuaccaggaaacagaugaaaagccaucuaaaguaauaauaauaguagucuuaugagacaguaaaauaucugccaccaaaaaaaaaagugguuuuuaauccaauccacuugcuuaaauuaugaugucaaggucugguacucaacuggcucguucauaauaucugagugaagccuggaaaugugcauuuucaacaaacacaguucucauguagguagaaaacaacauguaauccuggcuaagcaacuguaccuuagcaaaccugugaacagauuuccugaguuugguaaaagcgacuuuuuuuuuucaagauggagucuugcucuuucacccaggauggagugcaguggugccaacucagcucacugcaaccuccacuucccgggucaagcaauucuccugccucagccucccgaguagcuaggauuacaggugugcgccaccaugccugacuaguuuuauauuucuaguagagauggggauucaccauguuggccaggcucaucuugaacucuucaccucaagugauucaucugccuuggccucccaaagugcuaggcuuacaggcaugagccaccaggcccggccaaaagugacauuuuugaacugagggucaugugaaauuuaagucuuugucucuaugagauuauguaguuggguaaaauaaaguaacaaccagagcaaaaacaauaacaauaguaauacaagaaaccuaaaaacauauauuacuugagacauguuauaguaccauuuuuaaagaacucaggcucuggauuuaaaaugaccuggauucaaauccuacacaauuuacuagcucugugaccuugaacaaauaacuuaccuucucucagucccaauuucuuacaacaguuagcuaacagagaaauuauguagaguaacacuguguuacauaacgcacacucaaaauuauaaacaaugaagaguaaugguacaaauaucuaaacaaaucugacaaguuuuuugguaaaaaaaauaaauuccaaaaguaaaaaagccccauaaucucauuaacuuaaaauacauauguggccaauaaacacauaaaaagauguuccacaucauuaguuaucagggaaaugcaaaucaaaaccacgagauacuaccucacaucuacuaggauggcuacaaucaaagaaauagauaauaacaguguugaugaagauacggaggaagugaaccccauacacugcuggugagaaugugaaauggagcagcagcuuccgaaaacaguuuggcauuuccucaaaugcuuaaacacagaguuaccauauaauccaucaauucuacuccuagcuauauauauaugagaauugaaaacaguuauucaaaaauuugcaaacaaauguucauaaaagcauuauucauaauagcuaaaagguggaaacaaucuaaauguucaucaacugaugacuggacacauaaaauggggucuauccauacagugaauauuauuaagacauaaaagggaauaaaaaguagugauacauacaacaugaugaaccuugaagacaucaugcuaagugaaagaagucggucacaaagaaccacauaucauguaauuccauuuauaugaaauguucagaauaggaaaaucuauagagacauaaagcauauuagugguugcuagggacagagugaauggagguggcaugguggugacagcuaagggaugugggguuuucuuugaggguaauacaaauguucuaaaauuauucugaugaauguacaacucugugaauauacuagaagucauugaauuguauacuucaaaugggugaaucauaugguauaugaauuaaauuucaguaaagguguuuuuaaaauaaauauauguaauauauauuugcacaauaaaaaauauaguauauauaguuauuuucuucuaauauuggauuuucccccuagaaguagcuccuuaucaccaaguuguauagguuuuucuuagucauucuucuauaauguuacucuuuccuuuccauuucauauguaaauauauauauguguguauguguauguguguaugcguucauauauauaaagaaggaaaacaucccucuauaguacagcucuauaguauaguauccuucuauaguacagcucuauaguauaguaucccucuauacuacagcucuguaguauagcaucccucuauaguacagcucuauaguauaguaucccucuauaauacagcucuaugauacucuucaugcccagcaccuguuccugugguaaacugcuuuucccuccauucuaugucauucuaguacggcugucagucacaugaaauccccaaaucccacuccugccacagaaacugcacaggaauuucugccaaugaacugucucagcuguuuauaguuccaugcuuccaggggccuauuuauucggcuuggcuuuugauucugugauauaaccacauuuuaucuaauaaauccucuucuuauuuugcuuagauaaucucugaguuuaggcugcuugcaauuacaaaacuccauuugauauauacucuaaacuguuuuaaucucuucacccgaaguaaugcuaugaacaauuugcuguuaauccuaccacaguauuuucuaugcauauacaacuacacauccacauauauaucuuaucauaauacuauacauaguauuaauguaccauaauugauuuuagcauccuuccauuaauaauucuaacuuaacuuaguuuuacuuauucauuuuucuuuuaaaaucaaggggaauacggagaauccauuaaaaaaaaucauguuaaaauccaagaaauauuuauggaauagacuugguagcugaagaucguguuuuuuaacacaacuuuagauaauauaaaaaaaacugaaauauaaucucuaaucaauuuuuguuuacaauguaguuuggcagguaauauagaaaaauuauaaaacaauuauaugucaggauguaagcaaaauugcaugauaaucaucuuauaccaguugaagccaugaaaauucaauucaauuuuauuaaaugucaacuguauaauguuuucugauauguggauuguauuggcacucaaaggaccacccaaaaaguuuauagcuuagcauacuuauaauccaguuagucaacauuuuauaauugucacaaauauaaaaauugauaaaacuuccagcaaauuuaaauauauuuaagacaaaaauguucaugacuuuuauaauaauacuucacauuuauuaguacuuacuaaaucuuauuaucuaaauuauuuuucaaagcaauucuaugaagcagguauuguuauaaucacccaagggcaccgcuguaguuguaacuggcaaaucagagaacugaagucaagucuuucuaucucuaaaaucccuuucuuaaucaauaucuguuauaucaaaauuauuuuaaugacuaaacaguugaacugaagaguguuuauaauauccaauugcauucucacaucaguauuaacaaaaaagcuguuagcaacaaauccauugucugaaucagcucaaagacuuauuaaacuugagaucuucuuguuacaugauaaguugcaguaucaauuucuucagcucuaucaugaaggugaauucagauuaauucaagccaccuagcugacuugcagucuuuacaaacauaaaaacagguuaguauacucucuuaaggguguaguuauucugcaugagaaacagguauacaauuccauaagaauacaagauaauuugaaacauauaauaaccauguuguuacacaguagaccuucccauauuuaugcauauuuaauuauaauauuuauuaaaaggcuaaugagaccauuuugaaacacauuuacugaaaggcuaauccaguaguagaauacaaucuguuuaucaacugaagaacacaauacgugacauuuguacacuguaagagaagaccagaauugccaauaaaauaucauugaaaacuucaaguaacccuuaugguaaaaaaaaaaaaaaaaaaaguccuauuaaagauaagaaacaucauguacaguaucacuuccucucuccuacaacauaauucaaacuuaaacugauauguaaaugaaaauuuauauuccagucaaggaacguacccaaugagaguacauaaauuauauauguauuaugcaagauaauaguuguuacagacauuucaucaaaagccauuuuaaaaacugcaaaauaugucaagauguuuacauggugaaaugaaauuucauaauauggcaccuuaaaacaaucucacauuagauugcugcaccucagaaaagcacuauugauauuucacugagccaaagaauaaucauaauucccuuaucaagugaauauaguggaaaggaaccaggcugaaagucaaauagaaacaccauuuucucaaauaauaauauauuauuaauaaugauacauaucugaaggcuuaaguuucaagauccgaaaauuccagaaguauaaaaugccacauauuaucaaacucuaaauaacaaaauugucuaacauguaacugccuacuauuugcucaucaaguaaauaagaacucauuuuaagauuaagaaaacuagcaagucaguucgagucugcaauuuuuagacgaaauaacauucaugaacaacuuuauuuucuaacauuaauaacagauuucauacauccacguaaguuuagguaaaaauaaaauccauguauacauugcaaguggcaacuguucuccauagccaauucaguauuaugaacuaucuaaauaaaaaucaaaaguaaguuacuagaaaauaguaaaauagcuccaucgaaaacucuucugugcauauucugcaacauuaauuaacuuaaaaugauuaaaucacugcuaauuuauuugucaggaaaaaauaauauuuuauuauaauaucuaaaaaauuugaaggcacuucacaguauuacgucuuuuuguuaacaccauccaaugguauauuuauuaguugucauaugaaggccccgccaugagaguuuuuaaacauuuauuaagaaauacccucuauauucaaaguuagauauuuaauaucuuuaaggaaucugaaauagauuauauauucauugacuccuacaacaugcuucagccagauaaugaucguuugucaaaauaugagcaagcuaaucgugugauccuccacacacagacugauaacaacacucagaaugcaauagaagcaaaacuauucaccuaaauggacaugaaaggacuagugcuaggguucagauuuuuuuucuuuaaaauuuuagucccuugaaauuuaacuucuugaauuaacaugcagcuauugaaaaagcagcagauauguaacaauauuuuuacuaacagcuauucccuaggguuccuuaauuauaagcagcagagguaugcaagauggaaauacccaauuagguuuuccuggaccaauuuagcuuguccagcuauugaauauuuucacaauaaauagucacaguugaguuugagagagaaaaauuagcccuuuaguuagcacuaaaacuagucuaaaauuggccaucuggcuugucucugauauacucugauaucauauuguaucaucagacauuguaaaaagaaauaccaggcauaaacugcuaaccuuagaauacaauuuaaccucaguauucuccacaaaaaaguaacagaaucuguuucucuaagguaccugaguugauucuaagugaaaaauaucagguuauucucacuacuaucuauuuuccauguuuccagaaugagagugcaaaucugagcaccguauuuaaaaauaaauagaucugagaauaaagaaaaccauguuuucacccagaugccugcauuuccaucaacaagugcugaaacaccacgcgaacuguuguagcugauuaacccagcauauuucuaggaaguacauuaguuugguauuaguagggugcaaaguacaaaggucagagagggaaguagagaagggccagaccacaucacaccuuacagcagauacuacuaagcugagauuuuuuugaccuguaagacaugggagucacugaaaaagugaaaacagaggagcaauguaagcagagacuggaugagauuuucacucugcuagcagcguagagcuacuuuagugaauaugguauucccuagccacgugucuacugagcauuugaaaugugaccaugaccacaaguugaaagaauauucuggauaaacuagaucaaauaaacuauauuauuauaaucaauaccaccuguuuauuuuuauuuuuaaauguagccacuagaauagguaaaacuguauauaugccuuguauaauacaucucaauuggacaguacuuguauagaugaaaaacugugaggaggaaaauacacuaacaaugaugagaacaagguagacuauugcaaucgccaaggugagagaggacagucucagccagaauauuaagaauggagaagaacaaaagagaaaagcucaaaagaagaaagaaaagaugcaggacuuggugacugacugaguauaaggagucagagagaaggcauuuguucauucauucauucauucaaacacaucauuauugcaugccuaggauaugcagguaccaugaugguuauacuauaaugagcuaaauggaagucggaaaugcuuaccaacucucugguuugagaaacugaggaaaggcuguuaucacccauugaaauagcaaacaggaaagaggaacacuuuuauuaucaucaaauguaucaaguaugaaguguguguagguuauuuaaguggaaaugucugggaagcaauuggaugucaugaucugaaguguaacagaaaugccuacgcugaagcuagagaauauggaaauagcagcagacccauaaaaggguuugcuccaggagagguuguagagugauaaggucaaggguccaagacagaacagugacacaaaaauucugaaaaggagagagaggacagacagcaaguucacuaacaaauagccauguaugaacaagaaaaauucauaaagaguagaaucacaaaaaccaaaacagaagaacuuuuuaaggaaguaacauucaauagaaucaaauacaaaagaaaaguacauaauuucagagaagcauugaaaaguauacacaaugccagaaaaaaaaucaaaaaguauuuggcaagucagagaucacugaugaccuucaugaaggcgaucccaaugguaagaacaagcaggacugccaaagacuccaaaaggcgaaagagcaaaggagaggcaagaaagaccaaguauaaacaacuguuucuaaaaucuuaacuauaauaaaaaaauaauaaaguagugagcacagaaucaagggaugguuugggguauugucauuuuuuauuuuggacaugagagagaccugagcauguucaaaagcucagaaaagcaaucaguacagaaaagcugauuaaaggggcaagaaauggaauaacuaauggagcaagagccugaggaacugggagagaagaccuagaacacagauggacaggcaaaccugaacagaagaaagaacaccucuucguccagaaaugaaagugaagguggcucaagaggcaaagauaaauucagaagcagguaagaacucuagguucuguauuaaaauauuacucagguuauacaguaauuaccgggcaccuuuagcuaacaguagcugcaaaugugguuccauacuuccaaggauuuaauauuuauagcaaauauucgaaagccaaggacacagauucauccagguaggggagagucaucuuuaaucuacucuguggccagucaucuauacucuacuacacaaaaaauaaaccugugagaaaugauugccauuagucauggaggaagaaaauguagacuagagugauuggggacagggaacccacauaucucucuacgguuucuaucuaugcacauggaaguagagagacugaagagaauaaagaggguuucucuccugucuauauaacccuaauuaguuccuucccaaggcaagagucauaguuaucauacuuugccacaguuuaaaccuuuuagaugaaguuauugugcuuuaaagaaaugagcccagauuccccggacuucuacucugccuguuucugggagugguaggcaugccuaggcaggaucugguccuccaggcugaguggucauaauuauuuugugugauuaaaaagaaucucuuggccugcccauccucaucucuacucugcuucagugucuccaccuacaauugaaugagugaagaguauugggcuucacuggaccagaaaaccgagcuacgccuacaaaaccaagacucaugguucaacacuccucauugaaaaagucagacauugagggcuauccagccuuuguccaccuuuuaaacaguacuuuauuucccuguuggcuucuauacauuuuuauaaauaaugcaucaguccagaaucccagaaggcaggagggguagguggaggauucaauaaucaaaaucucaccuugaaccuccaaaaacccuagugacaaacuaaaaugugcacuaaguuuuucugccucuuucuuuuucauuuuucuuuuucucacucugccccuccugaaaucccccuccuuccacuuuuauauguucaagcccaugaauauucaguuuauaugucaccuuaucaaggaaguuuucucugaccuguccaguuacauuucaguaucacugccucaucuaugcucuugugucuuauuuauaucucaauuaagcacuugguuauaauuaguuauuuaauuguaucucccagccaggugagguggcucacaucuucaaccccagcuacacaggacacugaggugggggaaacauuugagaucaggaguuugagguuguaaugagccauaacuauaccagugcacuccagcccgcguggcagagugagagcccccaucucuaaaugaugaagaagaaggaggagaaaggaggagaaggagaaggagaaaggagaaaggagagaagagagaggagagaggagaaaggagagaggagaaaggagagaggagaaaggagaaaggagagaggagaaaggagaaaggagagaggagaaaggaggaggagggaaaaggagaaggaggagggaggaggaggaugaggaagagaagagggggaggagggggaauuguaucuccacuaggaaaucagguagagauugcugaauucagcuuuguaucucaggccuugaguacauugucaagguugguccccacuccaagucacaauucauuccuacuucucccaaacuccuaaagcacuuuguagggcagaaacugggccuugcugcacucuaucagcacugccccucuauuauugaaagaagacagaaagaaggagauccugaaggccuuuguauaauagguaaaaaucuuuugacucuucagccaaucacugcuccauuuggccucuagcuaaggaaucucuuaagcagcaagcaaaaaauaugauucauaaacaagugaaaaugagucacguagcaguaaacagaacuggggccagaaaggcagcuuuggaguuguccccauucauuucaaaaagagcauuuuacauacuuuuuacauauuuacauuuuauguauuuuuuuaacuggauaaaguuaggaaauacauaaauuguacuaaauuuagaauuucuaacuugauuaauaaugacaaaacaccuuauaaaguauauuacagcacacaaaguacuuccuaacacuuccauuuuauaguugaggaaaugaauuuuuagaaaaauuagguggguucuguaaggccuuauucaucaaccaauaaugaacaaaugccuauuuugugcaaugcacugggauuucagcagcccugcccucaugcaccucuuucuuauagggaagacguguaauaaauaaaauguauaugucaaaugguacuacugggaaaauaaggcaagguggaggugggggggcaaggguacaguuuugaauaagauagccaaagaaggccucacugacaaguggcauuugagcaaaaaggggguaagaaagucaagugguugguacccuaaccugaacuauuaaccaaaucuuggauuugcauugcuuacacuccuuucaauacagcaauuugcccuuuauaagagaaaaagaugcugacauucaggaaagcagcaggggaagcaguauccuguucucuacauuuugggcacauuagaaaagugguucagaaaauccuguacaagacccauagcgcuacccuaggccgaagugaguccacaaccacacauucggauacuccaaaaagaugccaagugguccuuuucauugacaggacuagcaguaucacuccaaaugguaaaauguuaaaguuguaacuagagaauguuugaucuuuuuauugcuguuuuuaaaggcagauguccugagugguucauugugguuucuaccauauaaacgucauuuuacucuacugguuacuuggcugucauaagacagaaaaugagcugccauaagaaaagcugauggaaaaggaaaaaaauuacaaauaucugaucccauacccaggucacugucuucaucuaaggcauaauuuaucuuuuccaaugaaauauguguacaucucaauuaauuauccacuuacccucuacuaaucagaaauaagauuugguucaguaaggcggggugaaggaauaaacucaaccuaccaauugcuccacaugaauuuuuuuuuuuaauagaggcagggucuuacucugucacccaggcuggacugugcagccuccaacuccugggcuuaagccucccgaguagcuaggacuacaaccacaugccaccacucccagcuaauuuuuuuuuuuuaagaaacagggucucgcucuguuguccaggcuggucuugaacuccuggccucagacaaaccucccaccacagccucccaaagcagugggauaauaggcauaaaccaccacucccagccugcuccacaugauugauaaauaaccugauauaauaaucuagacaagucaaucuuugcugaauaaauaacuuccccaugaguaauccuuccuaugcccaguuuuccccaauccuuaauaucauugcucuuuuuagacucauacauucauucacuuaacaaacauaaacugaauguuuaagauaaggcaaauacuuuguaugacugguuuucuauuugaaaauagagugugugacuauacaaauacauauauacauaaagguacaucaauuuauauacauuggcccuauguaacccccauuugagaauauuucuaagcaugccagcuacucaaauucaagugugaagguauguguauuugggugugugugaaugaauguaugugagagacaaaggcagacagagagagggaauggauaagaagcaaguaaaguuacagcagacaaggacaugaaaacucauaaaagacucaugauaaacuguaaauacauuuaaagaaaaagaauaacacaagccuucacuccccuucccugugcgaucauaaucacugcccaucaacuucucuguccauaucaugugugcucccuguguuccuugaagguuauguauaaccaagaucuaccuuuaauguguuuggcaaaaauaucugugccauaaacuauuagcugacaagcaauuauauucuaccuuguaaaagaaaauuaggcauaaaauaaccccacaaaaagaagagaaugacuguuucacaaaagaggcaaaagagauuuaaacaagauaauaccauaaguuucuaucucaccauccauuaauuuuaaauuugauuuugcuucuuauaucacauagcacuuauucaaaaauagcagaagaauacuucuaucuaucuguuguccuguaaaaagaaaagaaaauacuauuauuuguauuucuuguucaaacacucuaaggauaaaaguacuguuuucaaaaaugaugagguuccugcagauaacauuuacccacaggauuugaggcuuuuuugugacauaaagugcagaguacuuugaggaugguuacagaugcaauggcacagaaaaggcuuuuaacuuuggcucauuuccucugaccaccaugucuccauucuaaauuacaaccucucaagcuacagauccuuuaaaacuagcuuuuaaaccagcuuucugugguaucaucacaaaauaagaacacuuuguuacuugaaaauaaaagcacaaaauuauuggacucaauaacuguucucauuauugcaaaccaauaaacaagguucaacaagaacucguuuuagcuauugcuuaucaagcugccaaaaaauaaauccaaaagaaaccaaagaaaaaccugccuuaacaauauagaugguuucuuauucauaaacuaucuuuaacaucaaaaauggcuagcauguaugccaguguuauugccuugcauaacagaaucuuaagcuaagcacuaaaguucugucauucacaucuagaauaauaauuuuuuuuacaaaaacuaaaauacggccaggcgcaguggcucacaccuauaauuccaacacuuugggaggccaaggugggcagacaacgaggucaggagaucaagaucacccuggccaacaugaugaaaccucaucucuacuaaaauacaaaaaauuagccaggcaugguggcgcgugccugcaguuccaacuacucaggagguugaggcaggggaaucaccugaaaccaggaggcagagguugcagugagccaacaucacaccacugcacuccagccuggagacagagcaagacucugucuuuaaaaaaaaaaaaaaaaaaaaaaaacuaaaauacuaaauaaccccauuuuuaauagaaauuuguuuuaugauauaacccauaccaaaugcuaccugcucagccaaaucacuuuuagaguccacacagcccuuuauaucuaaaagaaaauaauaaaagugcuaggaaacaagaaguaucugggccaguuacccuugguuaggacugagaaauuagcuggcacagacagcaagaccgggaccaaauauucaaccaguuggcuggggauaguggguugaggucaaggagaugacccauacagcuguaaaauuaaguauaaaaaggggaaauugggcaaacaaauaaauauacugaggauaaugggagccagguuuucuaauguuggagaaggaaccuacaaguacaaaaaggggaaggaagaauaaacccugucguuuggaaucgaggagaucagugggaacauauauuuuuagauaaucacugaucaauagauagauagauggagauguauauguauauauguacguacauauauacauguaauguacauauguauuaguccguuuucaugcugcugauaaagacauacccaaaacugggaacaaacagagguuuaauuggacuuacaguuccacauggcugaggaggccucaguaucauggcaggaagcgaaaaguacuucuuacauggcaguggcaagagaaaaaugaggaggaagcaaaagcagaaaccccggauaaacacaucagaucucgugagacuuauucacuaccacgagaauagcacaggaaagaccggcccccaugauucaauuaccucccccugggucccucccacaacacaugggaauucugggagauacaacucaaguugagauuuggguggggacacagccaagccauaucaauauauguauguacaugcauauauguacauacauauauacauauaaugugcaaaucuguauuuccuagguuuguucacugaaaagaucuagaagcaaagacaccucaguaguaaagagcaaucuuagacccaguagcaaagagcaaccuuagcauccacuaaaagaaaccagaagucuuugguagcgccagggcuggggcaagaaaaguacaagauaagcuugaaccacaccuuuuaacaugaggaacugagaacauagcaucgcuuuugugguaauaaugcccaaaauaacaacuuauucauaaggaaacaucagauaaacccaaguagagaaacaaaacauagcuguacucuucagaaaugucaaaaucauuaaagauaaggcaagauuaaugaagauuccagauugaaggagagcaaagagccagggcagcuaaauacaaggcuuagauucuggacauauaaagaacaucauugggacaguuagugaauuaugaauugaaucuguguaauagacgguaauauuguaucaauacuaguuuccuauuuuggugguuauacugagauuauguagggaaauguccuuauuuuuagaaaauagucacugaaguacuaagggaguacuggggcaucaugucuccaauguacucucaagccaaaaaaaaacuucaaaauaauaauaauguguaaugguaagaggagagggagggcagauugagagagagagagagaauaugauaaagcaacuauaauaaaauuuuaauauugaaaauuugagugaaaaucauaucaguucuuuguacuauucuugcaauguuucuacaagcuugaaaucauugucaaaugauuaaaaaacaaagacauguuuggccuuaaaugcccauauaacuauuaagaaaaaccuuaacucucuaugaagggccacaaucugcucugaauuuugaauauaaaaaaguaugcuugugcuagaggcuaauacagccuauauaauucuaagggcacuaaacaaauaaaauaaggauguuaaaaggugucuugaacgugucuaaaaucuguaaaauguuaauucucacagaauacuuggcuuagaaagaugauguacauuggggaauuauaaauauaaggauaaaauugcaaaauuucccugauagucacaaaauaagaccuauguagacaacaguaugcaucacccagaucccccuucaaagaagcacucacucauggcccauauaugggcagugcagucaguagacagccgccaggucaguagacuucaacaucgccacagcugcagagaaccgcccucccuugggguauucgacauccucagacagggcagggguaacuugagacaacucugaaggccacacugucugagggccccacuggcuugucuaggguucugucaggccugccucacaguuuggcuuccuccccugcucaauccuguaucuuucuucuuccuuuccccagggaugaucccuaaaauacaucucacaccccaaacuccaucucaaugucugcuucuagggaacccaaccugccacaggaccucuuuugugacuugacaaaacauagcuugauauaggcacauuuuauaauuuugucuugugaguagguaacuuuauuuccucaaaagacagguauaaauuuuuuucagguaaauucugucucuaaaucucauccauuuaccuucucaugcggugugacagaaaaaguguacuuuccccuuuucauguuagccaaauauaaaagauaaucauuguuuaaacaacaaauuucccucuuaugguccauuagcuccugcugcuuguuccuguagugaaauagaaauacaacaaacgauuuccauggcaauagguaauaaucuagcaaaugugaauuuccgacuuagcaacagaacaaagcaagaagaaauuauggaacugcaguggggcuaaauuucaauuucuguguauuuuuaguaucacauuuuaaaacaaaaaagcacaaaugcagacacauuaacacguaacuaugaagaauaaaauucuaauuauaggauaaauucaagagaccucaauaaucaaccuguaauaucacuccuuacuucacuacuaaaauauauucaacuaacauaaaacaccuuaccuuacaaauuugagaauucuuacacuuauuugaaagccuauuaucuacuauaauagcagucccaauuacugauauauccuguuauuuucauuuuuaguaauaauuauaaacauggcuuauugcuaauauguaaacgaaagauguucaaaggacuaaagaaucucuaggaagcacaggaauagaggaacuggaaagacugcaagcaucaggagcagcucucuugcugauacuccauuagucaaggcucuccacucccuuguggaacaugcagcacccuguacaggcuacucucuagucugcaccugcucuucuucccaccccugagcuucacacucaccaagagggguuguuuuguucccacacuuauuaccauuucuucuuguuauaguaauuauauaguuuaauuauauuauucacaaucugaugaaauaugagugcagaaaggauuaucguauccaagaaaguaaguacaacgcuuugcaaagauuugauaaagaugaaucacuaaaacuaugaacaaauuagauaugggcaauguuagacuguggacaguuacagaaaaaauaauucaaaucuaggauucuacacucagauugcuuuguaagugucuuaaauuucugcacuuuuaaauaacccaacgugaaaauuauagguaaugcacugccuucguuuuauacagaaugacuauccaaagaugcaaauuuuuuaaaauaaaaagcuucagccuuauacaaucagaaaaauggcaaaaagacaaacaacuacgauaagaguaugaguucaaggaaaccugaauagagguccuuaauauaugacaacacgaccauaccucucuuucaguugccuccacucuccagaugggauuccugcccucuguucuaaaggaugacauugagcacugcccgccuuguccuugaccucagauaugcacuucuucaaucuuaggcuaacucuucucgguuggcaacagagguucagaaagugucuccuugcuucaauguccucuccuaccuuuguauaugcaaauucuucauuaccagcuugauugcauuuauauccagcauacagcaaugugcaaacuauauuuucucuuuggcuauuagcgacccaaggaggaccucagacaacaacauacuuuuagccccaaagucacaugggcaaucacauuuccaaucuuuuaagcacccuuccaauggauauacugucuaaccaggaaaaagauuaacuggaccagucaagucucuuuuuccuauucuagccacauauaaaugaucaaugcccccacccacuggaaauguacagaagcuacaauaaaaagaauuuccugcccagggccaagaauuuauagauuuagauucuaaagcaucugaugugacuacuuuuuuauuuuauugccuuaacuuccuuagcuacaacugaacacacuucccaucaaccuauuacuucuuuaccucccuccaguuuuccuggccuuuaacucaaugccucuccuaaguaugcuugagcuguguuuacucaagccaccucugacaucaagugagaaguguuuuuccuucuaacaccaaccaauucugacacaaacucgaagucccauaauucaauuaauucugauaauaacaaccaggaguuagcaucagaauuuuuagugcucagucccacaaaucaaggucccuagguuacacacacuucuguccaacuuggcuauaaagucugaggugggaggguccuccccucacuucagguucaguaauuugcuagaguggucauaaaacuccaaaaaacacuuuacuuaccauuacuggugcauuaaaaguaccacaaaugaagagccagaugaggagguaaaucuagugaggucuggaaggguccagagcauaguagcuuuuguccccauggagcuggggggucccacccaccuggcauguggauguguucgccaauuauaaaagucucagaacccaagcauuuagggguuuuuguggaggcugcauuacauaagcguuauucauuaaaucacuggccaucagugauuagcucaaucuccagccccuuugcccuccccagagguugucacaugagauuaaaagucccaagcugcuaaucaaggcuuggucuguugggcaaccagccugcaaccugaagcuuuuuaagggcccaccaagaauaaccucacuagaacaaaagaugcucucaucacccuaauaacucaggaaauuccaaggauuucugaagcucucugcugggaacuggaaacaaaaaaagaaauaucuuucuacacuacuauaaugcuuuaaucucuuuuuuccacuuuuucacagaucuuacaagugaauagccaguuacuuguucccuggcucugcaacagcucuccucccauuaccuuuuguaaaaaacuugucccauuucucuuucccuuccuuccuccuuccucaaguuuugcaccaaacaaugugcagaauuuagaacacugcauauuuucaauuaaauuacucuauugucugcugugcucagggaauaucugcagucuguaaacucugcaugcuaggaagagcuauuuaaucuugcuccugacauuuuacguaggagggaaugguuuacaggcucagugucucuagaaagaacacuccccaaggaacaacguauuuauuucucaauguucuuuuucuguuuuacucuuaaaaucuuuccuaccaccaucccucacgcccaagaguacaacuuugaaaucuaauguauaaaacuagcagaaauuaaaguuuauccuauacuuacauuaaaagcuacuccuacuugaagauaugcagaccccuccaaauccuucuuuugauucucugcucacauaaguggguuuuauguacguguguuuuuuuccacaaaggagaggcccaaagauagccaagagaucaggauuggaacaguuucuuaacaucauauucucacauuuucaaaauuuccuccuuuauuagugauaaacuuuuuaaaaacugauuucaaaauaggaaacaguuguucaucagucugcuagucucacuuucaccaaucaacauauuucauugaugauaauauaauuuuuaaaauauuuuaucaucucuggaaucaagauauaucuuacagucgauaauaucauaguuuaacugacaauauuuuugauaaaguacaugaagaaauacuuuaucauaaauacauaagacaaagauaaaauaaaugacacaaagaugaaucuuagguuugauaaauauauuaaguuccucucucaacaguuucuggcuuaccucagauauaaccuauguaaagcauuuagcauuaaauguaguauaacagauuuucauugcugccaucauugaugacaucaacaucaucaacaucaucaucauuucuaaacaaauaacaaaagucucagaaacaaauaugaaucaaguuaggguucugauguguucuccuuauucuauuucuuuucugagugccauuuuuguuuguuuguuuucuauccuaauuuucuaaauuuuucauuuguccccauauuaaaaaacuguaaacacucugaugggguuauguaagguugugcuaaaugacuuagcucagaguauucaagccgaaauaaguuaguucuuucaucucaaagaaauaaguaaauaaauaaaguaauaaaguucuuucaucucaaagaacuuuaaauauccgucccugucacuagcuaccaaaucaaaaaccuaggaaucucauuggaaaauagacuauaagacaauuccaugguuaugaguuuuaaaagauaacucuaaucgaucauccuuuuuuuguacuuauuuuuuguauauuuguaaaauaguaguuacaugaagcaaauaguaucaguguaaggcccauucacuuuucaggcuacucgacaugcagaaaugguggccauugaucagguccuugauuggugucaucgaaguggcaagggucuuucugaaguauuugaacacacuguuauaugucacuguggagcugugcauuaugugugcagcuguucgccaccugaugaguauccuuugacuucaugaguuaaugucuuguaccauucaugugaacaugagaguggccaaacauauagcgcagcaggaagcagagggcagcugugacgggacuggccagcagugguuaggauggugaaaacacuaagaagccaaaggagucaagaguagucagacagagcagguguggccaauugccucaaucaucuuuuucuuucaaccaaaaguaucaaguuauauuuucuauuuuuucuuccacaucacucuucuacccucugccauuuuuuucuuucuccauaaauggaaaccuaaaauguauuucuaccauaauuagaaagcaaucaauaaaaaauuuuaguccaauuuuguucgugucuccacacauuacuacaugaacucaguuuuacuuuauacuguauuauaaucauuugagcaaaauuucuuuauuucuuguaaaugaaugugcuaguauaagaaauaucuacauuuuaaugaaaaucauaguacagguacaaaauuucuaaaagugagaaaaugaagcaaacacaauacagcuuuuugguacuuuuacauauguaaucuuucuuuauucugcuguugauaguuuuugccuuucgcccauuuaaguaaguuaauugaaagcauaguauaauuuaaucucuauuguacuaaaaauacacaacuaucuauaguaauauuauucugccacauucucaaaaaaacuauugggcauuaauuccaucuggacucuccacuaaauaagcauuaguaaacaaauuuacuuaaacuauaaaauucauauuacugaauuugcauauauccagagugucugaagaagagaaaacaaacauaugagaaaaagcucaucaucacuggucauuagagaaaugcaaaucaaaaccacaaugagaugccaucucaugccaguuagaauggcgauuauuaaaaagucaggaaacaacagaugcuggugaggcuguggagaaacaggaauacuuuuacaguguuggugggaguguaaauuaguucaaccauuguggaagauaguguggcaauuccucaaggaucuagaacuagaaauaccauuugacccagcaaacccauuacuggguauauacccaaaggauuauaaaucauuuuacuauaaagacacauggauauguauguuuauaaagacacauggacacguauguuuacugcagcacuauuuacaauagcaaagacuuggaaccaaccuaaaugcccaucaaugauaaaccggauaaagaaaauguggcacauauauaccacggaauacuaugcagccauaaaaagaauaaguucauguccuuugcagggacauggauaaagcuggaagccaucauucucagcaaaccaacaaaggaacagaaaaccacauguucucacucauaaguggcaguugaacaaugagaacacauggauacagggaggggaacaucacacaccagggccuguggaggcuguggggcaaggggagauauagcauuaggacaaauaccuaaugcaugcagggcuugaaaccuagaugauggguugacaggugcagcaaaccaccauggcacauguauaccuauuuaacaaacccguacguuuugcauauguaucccagaacuuaaaguaaaauaaaaaugaaaaagaauagauaaauauaguuagcaaauuauauguauauauacaauacuaucauaacaauauacaaugcuagucuguaguuuguaacuuuuucucauaaaauaaaugaagcuuuagaaaacauuuuucacugggugcgguggcucacgccuguaaucccagcacuuugggaggccgaggagggcggaucacaaggucaggagauugagaccauccuggcuaacacggugaaaccccaucucuacuaaaaauacaaaaacaaaauuagcuaggcaucguggcaggcgccuguaaucccagcuacucaggaggcugacgcaggagaaugguaugaaccagggaggcagagcuugcagugagcugagaucgcgccacugcacuccagccugggcaacagagcgagacucuaucucaaaaaaaaaaagaaaacauuuuucacuauaagaaaauaaaaucacuuauaauagacauauuuccaauauuuacauucucuguaguccucuaguccuuuaucuagacauauauacuauauuuuucaaauacuggaauuauaguauacaucauuuuguaacuugcuuuuuuguuugacaauauuauaggagcacuuucaauauucauagucuucgaaaacaugauuuuugaauggcuguaugaauauuccaucauuuguaaauauuguaguugauuuugcuaacccaccacuauuggacaguuacuaccauaauaaugcaguagcgaacaucccuuuaucuuugcucuggucucugauuuaugucuuggaaaaaaauucuaaaaguugaaaguaccaaguaaagacauguaaauacugucaagccuuuugaugccuaccaccaaacuguucuuucuccaauaucuauaaaaguacaguuuaaagaaaccaucaauauuguguugcugguaugauggaugaaaaaguaugucucauuuaauuucaugccauuucauuuacaaguaagauuaaucacuuuaauaaauucauuuuucauuuucuuuuuugaacuaucuguucaugaccuuugccuauuauccuucggauguauuugcuuuuuauuacuauuuuguggcuguuuuuuauacaggagugauauguuugauguugcaaauacuuuuccagguucucauucacuuuaucauuucauguuuuuuugacauauaagagacuuucauuuugcauaaucaaauuuguuaaacuuuuccuucauuauaugucccuuugguuuuauaucgaggaaggccuuucugggccuacuaugaaauaauucauuuauacuuucuucuaaguauuuuaugacuuacauuuaauauuauuucuauauuuaacccaucugaaaugcauuuuguauacagaauuggagagagcuaaucauguuuuuuucagacaaaaguauuuuaacacgucaaguuuaaaccauaaacacuuuucggauuaauuuuuuuccauaaguuuuugggguggaggugguauuugguuacaugaguaaaagaaaacuacugacugauauccuugaucaacacagaugcuaaacuccuuaacaaaacacuagcuaaccuaauccaacaacauaucaaaaagauaguccaccaugaucaaguggguuucauaccagggaugcaggaguaguuuaacauacacaagucaauaacugugauacaccauauaaacagaauuaaaaauaaaaaucacaugaucaucucaguagguaagaaguauucgacaaaauccagcauccguuuaugauuaaaacuuucagcaaaaaucgacauacaagggacauaccucaauguaauaaaagccauuuaugacaaacccacagccaacauaauacuaaauggggaaaaguugaaagcauuccuucugaguacuggaacaagacaaggaugcccccucccaccacuucucuucagcauaguacuggaaguccuagacagagcaaacagacaagagacagaaauaaagggcauccaaaucgguaaagaggaauucaaacugucacuguuugcugaaaacaugaucauuuaccuugaaaacccuaaagacuccuacagaaagcuccuagaacugauaaaagaauucagcaaaauuuccagauauaagauuaauguacacaaaucaguaguucuucuauacaccaacagugaccaagcagagaaucaaauaaagaacucaaccccuuuuacaauagcugcaaaaaaaaaaaaaaaauacuuaggaauacagcuaaacaaggaguugaaagaccucuacaaggaaaacuacaaaaugcugcugaaagaaaucacagaugacacaaacaaauagaaacacaucccaugcucauggauggguagaaucaauauugugaaaaugaccauacugccaaaagcagucuacaaauucaaagcaaucuccaccaaaauaccaccauuauucuucuucacagaauuagaaaaaacaauucuaaaauucauauggaaccaaaaaagagccugcauagccaaagcaagacuaagcaaaaagaacaaaucuggaggcaucacacuaccugauuucaaacuauacuguaaggccauagucaucaaaacagcgugguacugguuuaaaaauaggcacauagaccaauggaacacaauagagaacccagaaauaaacccaaauacauacagccaauuggucuucaacaaagcaaacagauuaauuuuuuuuugacccaguaucucuuucuguugcccaggcugcagugcaauggcauaaucucagcucacugcaaccuccaccucccagauucaagugugcuucagccaccugaaugccugggauuacaggcaugcaccaccaugccugccuaauuuuuuuauuuuuauuagagacaggguuucaucauauugcccaggcugaucuccaacuccuggucucaaguuauccaucagccucagccucccaaagugcugggauuacaggcaugagccucugcacccggccuagauguauuauuaaugcauuauuauuaauguauccuuucauacuaacaacaccuaaguuguuuuuaacauguacuaacauuuccuaccuuuuaaacauguaguaguauauccuaucauuuaaacauguacuagcauauccuaucuuuaggcuccuuuaauauagagucaagguucuccuucuccuugcuucccaugcuaccagcacuauaaaguaagagaaucaacaaaacauccuauauuauaaagaguaguuugacguuuuggcucuauguagaacacaucaauuauaucuauaauauauuaauuuaaaaagugaacucaauuccucuagcuauugaaaaagauuugccccagaagucuuuucugaguccuuagucccacucuccaucugaaugugauaccucuccuguguguuuuccaagaccucucaacguaucugaucacagcccuuaucaccuuauauuucugacuuacuagucagucccccaacuaaaccaaaagaauuucagaagaacuaugucucagauauuuuaucacuaucaccuagcucauaguaagcagucuguaaauauuuguuaaauaaaugaaugaguacaagacuacaagacuuuuaauuccuuucaggccugccagugacuaacgauugcaacagugaauaagucacuuaacauuuuagacuguggugaacaauucagaaaucaguaauuucuuagcacaaagaucucuuaagauuuuucaaucucaaaauucuaugaugacaugaccuguauccccagaaaccaauuuuacacacccugcugcuacaucucuugcuugguaauauuccccuauccccaccagucugacccuuccagacuuccuugaccuucuccagccuaccccacuguccauuuaaaauguucucaccuugugcuccuuaaggcuuuucuauggaucagccaucuauaucuguagucugaacaacagugcauuuuacuguaccuuccccauguuaaauuuguguguagauauacugcauggcuuauucagaagauaucggugaugugaaaugcuuaggugugagguuaaaaaggagcucucaaucucuugcuuaccccauagacuuaucuuuggaaaugcguaugacauuagaucaaugacugcauccuacucuaaaacaaaaugccucaagaguauuaguauuauuuuauaauuuuacaacuuuucuuguuuccauaaugaucaacagaagugacaugauuuugcagucaugccaaaaaagaaaaaaaaaaggauuauacugauaaucucuucccaaauauauucuggugaggaaagguuuauuuuguugcuuuuugcuuuuugucauuuccuugcucuaguuuaguuguuuuuaauauuuccauaaauguugggaguaaguuuacuuuggacagaacagauuugcuucuauuuuuaagaauuugagagcauguggugagauuguuuaucuuguugaaauaccccaaaaacucagccucuugaucuaaaaugcaauccaauaaguuauaacaugaguuaagguuaaucuguaaauaaaauacaauuccaauuugcuagugaauacuuaccuguaaauacuaaagacaguauuuuaacucaaacauuuucugauugccaaccuauucuaaguguuaugggggagcaaaggcaauuaaagucaauuuucugccuccaaggaguguauucugauuaagacagaccugugcuuaacuaacaauaacacaaggcagaauaugguucuuuaaagaaaaacaaauccuguaguagcaaaagaauuuuagcauuaaaauaauauauagauaaguaggauuaaaacugcaguucuaauaccuuuccaaauuucaauguacuucuuugaauaagagaaaaauuaaccagucauguccuuuccaaagaaacacuacagauuacacauccuguagcacucuggaauuaugggcucugacugguaguagacuacuacuucuguucaagagguucuuuaaauauucacgaagucugauugagaaaaauguuaagcaagucauggucauacugagcaauucaacugguaaaccacggacugcauagcuacguucaacaucagauggaaggaauaacuugagaggcuauuaaggaauagaauuaggaagacuauaggcucauuauuaaaccauuauuuauuuagcacugccaacauuccaaacacagugguaaaugcaagacuggugaauacaauccauaaaaauauucucugagagacuguuuaucauguuauaaauucaagguuuuaaaaaaauaauagaagccagguaggguggcaugcaucucuagucccaucuacucaggagguugaggcaagaggacugcuugagcccaggaguucaaggcuguagugagcuacgacugugcuugugaauugccacugcacuccaggcuggaccacauagcaagaccccaucucaaaaauaauaauaauaauaauaauaauaauaauaauaauaauaauaauaauauuaaguuaggaaaaagcaauccuccauucauucacaauguacauguccuauauauucaaauuaaaaccaagcaaaagccuucuguucugaaacuaacuuucuaugaaacgcccaacuuguauucccagcaauaucaaguuuccuuauucaucucuauagauuaccucauauaaugaaauggaaucauccuuuuccagaauuaagaugcugcuuuuaucacuuuacuugcucaaaaaccuuaaaagcuuucauuuacagaugggcacgguggcucacgcaugcaaucccagcacuuugggaggcugaggcaggcagaucaccugaagucaagaguucaagaccagcccaggcaacacagugaaaccccgucucuaauaaaaauacgaaaauuagccaggcgcaguagcaugcaccagaagucccagcuacucgagaggcuaaggcaggagaauuacuugaauuaccaggaggcagagguuacagugagccaagaucgcaccacugcaauccagccugggugacagagugagauucugucucaaaacaaaacaaaaaaagcuucaauuuacuauaaaaucaaauuaaaaauccucaagguggcauucaagaaucugcauaucuguauauuaaaacuauuuccuaauaccuucacaauggaaauuuucuguuccagacacauugccuucauaguccacgaacacauuauauauauuuaugucuauuuacaucuauucuuucuuuucuuucucugagacaggguuucacucugucacccagucuggagugcuguggugcaaucucggcucacugcagccuugaccccccccccccaccccgccaggcucaggugauccucccaccucagccucccaggcagcugggacuacaggugcaagcuaccacgaccgugauaugguuuggcucuguguccccacccaaaucucaucucaaauuguaauccccacauguugaggaagggaccuggugggaggugacuguaucacagggcgguuuccccaugcuauucucgugauagugaguacucacgagaucucaugguuuaaaauuguuuaauagguccuccccccucacucucucucucucucuccugccaccacauaagacauccacuuugccuuccaccaugauuguaaguuuccugaggcauuuccagccauguagaacuguaagucaauugaaccucuuuucuuuauaaauuacccagucucagguaguucuuuauagcaguguaaaaacagaauaauacagcccagguauauauauauauauauauuuuuaaacagggucucacuuugucacccagguuggugcaaucacaccugcaauguuggugcaauguaccagguugguacaaucacugcagccucaaguaguaaguauucaaaauauauguuuuguuuaaagggggucaauaaaauaaucuaagucaacuauuuuauuuauuacacaugaagaaucacaggaaaaaaguuaagcagcuauuccaaauuacauaguuugaaagcuacaucccaaacacaaaacccaauauuuuuuggguuguaaagaauccugcagaggauugugaaaggguagaagugaggaucccuuucuguguaauauuguuaaaguugggauccuuugauuacaugauagcuugaauucuaaauacagagaugccaucaguuaaauauaaaauaauauuggggcaaaauuagccaugccacuuggaagucuuuugaaagguuuguguuuauuuuucuaaccuauauauuacuguaagaggcauacuuggaacaacccccccacaaacacauauacuaauuaacuaauccagcagcggcauaacacacagggaguuuuauccuuuaugaaggccuggcauaugcaucacauuuaacacagcccuagcucacaguacuuuaucuacuuggcuagaaaacaaauggccacagaaauucaugcuagucaauccauuuuuuauauauuuuggaguaaaaaggauguaaauucaucugaguagauaacuagcauacaaagaauucagguugagugugcuacaauuaaaaauggucaccacaagaagcugaaauauuaggaguguucaggggcauuacugagagucuucaagcaaaaaggguuuucccagcugucacuguaauuacaaugaaaaaauuuuacuuccuaaggauuucaucuagaacacauuauacauaacagaauauacaugcauucaaauguaauagacacauaaggaauaccaauuuugacuaccuucuucccacaaaucacaagcgaccucugagcacaacucucaagacuuuuaaaugcuuucuggaacucuuuuuccauuuagaaauaaguaacuacauacaacaguucacggaaaacucaaccacuuaacuauuucagugaaaacagguagaaagaaagucuauaaacuauacuuuuuauccauuugaaaaaauuuaaauuuggaaaggaaucacuucauucuuaaggucccaacacccuaaaaauaaaguuuauucuaaauuuucacauuugucaaagacaauaauaucaagcaguagcccacaauucccuaaaggaaugaugucaauugguauuucuuaaauuaauucagugaccuacaguaaugugaguucuugguacauaaugucugucaguaggcaauacaaaaauuucagaaucacuucuggugucugaacuccaaaaugcaacccaaaaaaugugucuaaaguaguuccuuaauuccuacuucaccuugcaucuguuacuuauagcaacgucagaaaaauaaaaauuacaccagguguagauugcuagaacuacaguucuacaaauuaaauacaguacaaauuuaaccaagacuucugguaacauacaaucaguuaucuuucugagcuaagacauuacaagucuguaacuccuuuuaccgacuaugguuuagugaguuucacaugugcuuacacagcucauuuuuaguuacuuacuagacaaugugcaaugguguacuuuuauaaaaauuucaaaggucucaagaaauggaaauacucaaauuuaaaggauuuaucuguuaucucugaacucucuuucucugcuuuuacugcucccaaguauacaggcaccacgaacacagagaccagcuaaaaguucaggaacagaaaauuccaacuacaucaucuuaacaaauaaccccacacauuauaguuuaaaaauagcauauuugaaaaaaaugcacuaaaaauuauuauuagaacuucacacucaaaucucuaaaaaguuaugaacauuuuauauuguaauacacauaaauucuaaagaauaucaaaguauaauaucagagaaacaauauguguaagauuauaaaagauuagaguauuaucuguuuggauuuuuacaugaauuauuuaugcacuuaaaaacauaguugaagugaggagaaacauaaaugauaaccuaaucacauucucugaguuucccuccuaggucacuggcugcuccuucucauuuuccugacucccauuauuccuaaccucuaaguguuggacuacccuaggagggguauaggacuuuugucuuucucuauucacugucuaggucacaggucaguaaacucuaccugcagaccaaauguagcuuaccaccuauuaauuuuuauaaauaaaguuuuauuggaacgcagccacacccauuuucuuaauuauugucuacagcuccuuucacaauacaagguaaaaauugaauagcugcaacaaggacuagauagugcuucugauccuuuacagaagaaaaauugccaaucucugucuaggugaucucacuaaggugcauagcuuuaaauauaauguauauccugaaaauuacccaaauucuaucuucaguccugacucagauaugaaugacaacuucucuacauuauauuuggaugucuuauaggcauacaaauuuaacaugucuaaaagguaaaauuugcuuucuaccaccccugccacuccuuugccucuuguaucucaauacacaauuuccauucauccaauugcuuaggccaaaaacuucagaauccuccuugauuccucuauuucucucauacuccauaucccagccaucaaaaaaguacaucuuuaaaauauauccagaaucuggccacuucucagccacuccaaugcuaccacccuaacucaagucacaaccauuuucaccuggacuauuguaguagccuccuuacugggucccuauuucuguucuuggucccuuacacucaauuuuuacagagcaucuagagugaucauggaauuccauuacugaaaacacuucaaaagccaugcaagguguggccucuuguuauauucuaccuuuccucccucuuacugacucuggucacuccccacauggucuuuuacugucaagcaugguccugccuuagaucuuugcauuugcucuucugucuggaaaaguuucccccaacuuaucuaggugguuuaauuccucauuuuauucaggucucugaucaaagauuaccucaaguuagaggucuuccuuaaucacucucucuaaauuagugacuccuaucaauucuauaucccuguuaauagguggauucccuagaaaacaggcucuaagauucugggauuugcaugcauuuuggggagugcccuuaggaacaacaucugaaagggagugaaggaagcaggacaggcagagaaagaagcugaauugcagugugguucuaacagagguuuaagccacaggaaccucugcaguggguauaguuuuugaaaauuaucccacaugaggaaaagagacagggucuuugagccgacauauacauaaugaaauucccaguauccccagaguugggguguaaccuugaguaagacacauaaauauguguuuuagggaaaugcaaauuaaauccaaaauaagauacuacuuuacacacacuaggauagcuaaaaucaaaaaagauaaaaaauaacaaauguuggugagguuguggggaaaauagaacccucauacacugcucaugggaauguaacaugguacacacagcagcuccggaaaacagguuuggcagucucuucaaaaguuaaacauaaauauaucacacaacucagcaauaccauaccuagaaaucugccuaagagacaugaaaacauauaucuacggaaagaauuauaaaagcauauucaugguauuauucauaauaccuaaaagcaacacaacauaaaagucuagcaaaugguguguggauuaacaaaaugaggugcaucuaaacaaaaaauaauauucagcaaaaaaaagaacaaaauacagauacauacuguaacauggaugaaccucagaaacauuacacucagggaaagaagccaacacaaaagaccauuuauugugugauucuuuuuaaaugaaauauccagaaggggaaaaucaauagaaauacaaaauagauuacugguugccuggagguagggguaagaaauaacaguaagugcaaauggccauggggaguauuuucaggaugauuaaaacauuccaaaauuggauuacagugauggcuguacaacccuauacauucacuauaucaucaauuucuauacuuagcaugagugaauuuuaugaaauguaaauuacauauaaauaaagacauaaaaaagaaaaauaaauauuacuggcugauucuuaaauugacuaauaauaauggugacaauaacuacuacucacugaaaauuugcuuagguucaagaauuguucugagugcuucauuuguauuaacucauuuaaucuucaacacaauccuacgaagcaggaacuauuuuauuccuauuucagagaugagauaacucaggcaugggaaaauuaaauagcaugcucaaggucauagaacuaaauauauauuaauuaacuuauaaaaauaaaacauucuaccuuaaaugcuaagcaacagcacuuaucuaaaacaaaccaaaaaaguagaagauaauaccauauguguacauacaugguaaguucccuguaaguagcguauuuaagauuuuccaauaagugaccaacuugcaacacuucugauuaucuguauagccauugaaacaaguaauaaguauaauauuuauuauaagacagcuuggccaguacuuggugcauauucagugagagacuuaauuacuguagacaaauauaaagaaugcucaugaucuaaucuacugaaucacuauguucauacagacacagaaauaucacuauggguacacauaaauacaacuuuauucugcaacagucacgcauaaacacacacacaaacucuaagucacacaaucucuauaauaaagauuuuucuagugcaucauaucacagaacugcaagcauaucauuuuguuccuguaacugaaauguacaaugggacaagaugagaugacaguguguuuuaucuuuuucauaugaaaguucaguaauaaauuucacauggcaguaagccaauaugaaugaaauacuuggagauacuaacuucucauguaucuaccaauaaaacacucucaaauuuacagauaccccuagaaaagacagcugauaaccacauuguauguaguuaauauuuuuuuuaaauaugaaggcauauaaaugaucagcaagccugacauuuagauauuugacaacaauguauuuuaagcagucuaauaaaacacaaagcacagauguagaggaaggaagauauguaacuaaaaccacauucaccuucaauuccuuugcagacuagcacugaaaaaccuacaucagcacuuucugucuagaugauauauugauacaaagcuagaauaaaaauggugauaaaaaguaccauuuguaauugaaaauaaauguugcuaagugcugacaagcuucugucaguuaaauuguuuuuauuuagaaauauuuugcauuuccucuauuauucuuaagaaacuuuguaauuaauuuuuguuccaaauaauguuuuuguguauugauuacacaaacuaguaauauuuacauuuaagacauccauuuaaaguugaagaaaccauuucauaauagaaagccaauuccuacccuuaauucucuuaaaauuuaacguccaccuagaaagcaaugcaucaguaauaaauuuaugauucaauaugguuaucagcccacagcuaaaaauuugcagaucuguauaaccaagcauauuaaaaguccccauggauaacauauaaccaugaguaacucucauaauucaacaugcacuacaguaagaaccauuacaacugcauguuuucauuguuaggucccaauccauuuuuaaaagaagcuguacauguacaucaccaacuugcacauacaugcaaguaaaauuaaauuaccuaaaggguaucuucugaaaaaccugagaguuuuuuuuaagacaucaguauaaccuugguuaaauaaucuuauggucucuauauaaagauuugaaauuucugaaaauaaaaacauacaguaacauaaagcuugcuucuaagaguagccagauucaauauucagauuuagaaaaauuacauucauuaaauuuaagugaaacaaauaauuaugcugaacuucuacaggauugcccucaaaauccuauacauaacuagaaaaguggacaaaauauauaaagcuauuucagauaguggaccaauggcagaagaggcaugugauuauuaacaaaagggaaacaaaucaggugauaucuaagacugccccuauuccaaccuagaugcaaaguccaaacugugguauaagaauggggaacucagagccucaugguccaaauaaguugagaaacagauuagaguuugaagacacugggauggcuggaauuugugggacauauuaaagauaaaaagaacgcuaugcagagauuggcauaagaauacucaugaggcuuugaauaggaaucugugcugcauagggugaaacuccaagcagccaagugaaaaauagcaggaaaagaucaauuucaggggaguuauaaagugaacaauuccaagaaugaagagcccuuguuguugaauacccagaguauucuguagagacuccagaaagcucaugccuuaguagugagucuaaacuagcucuaaagauuacccuagaucauccuugaaaagcacaaaaauagccuugaaaugagcaggcugaucugcaaauaauuuaaaugccuaccaaaaaaguggagggugguggggagagagaccauuuaaaagaaaaaccaaaauguaauuaguacuacauuaguaaccaaaaagaaaaaccaauguaaauuaguauguacauuguucaaauucagcugaacaauguaaauacuaauauucaaugccuaacagugaaaaaaaaaauuagagacagacaaauaaaagggaggaaaauguugcccacaacuaggagaaaaaucagucaauaaaaacagauccaauuaacaaagauaacaaaauuaacauuaaaaggccuuaaaacagcuauuaaaauaaguucaauaagauuaaagacuuaaaggaaauaugaacauaacgagaagacaaagagaacauauugagaaucaccaaauuaagugucuaaauauuuaaaaauauuuuugauacgaaaauguugcagauaagacacuacagaaaauaucagugaagcuggaaacauagcaacauaaauuauuuuaaacaaaguaugaaggaagaaaauauuuuaaaaauaaacagucuugguaacaugugagggcaacaacaaucuaacauuuuuauaauucaagcacuaaaauaagaggaaagaggucaagaaaauauuuaaagaaaacaugcccccaauuuuucugaauuuaauaaacaauaucagccuacaaauccaagaaguucaacaaagcccaggaagaauaaagaaaaaccaugacaugauauaaucaaauugcuaaaaaaaaaaaaaaaaaguaacaaagaaaaaaaucuuaaaaguacccagaaaaaaaggcacauaauauaggaguaaauauaauaacacaugucuugucagaaauuaugcaagcuggaaggaaauggaaugacauucuuagagugcuguuagaaaaaaacugugagacuaaaaaucauacagccagaucaaauauuuuucaaaaaugaacacaaaggcaaagaugucauuaccgauauacccaggaccuagccaaagcccacaacaccccugaaauucucaagaucaaguucaaaaaaagggguccccgugaaagugaccaucaagauggcaccaccucaccagaccuccuuggagcucuucguguaccugaacgaagucacgggcaagcacggcaugggcuguauugacauuauggagaacugcuucauuagaauaaaguccagagguaucuacaagaccccagcaggcaccauccuucaacaggcugauuuagacaucgaggacuucacuauggaucgggaagugcacaaaaucaacccugaguguaaaucuguccaccauugcaucaccaagucccaggagcaaauggaaggaaaagugcaggugcccaucuucaagggccaggugcacauccucagccaggagucucuacucucucucuacaaggaggagcuggugagcgucaacgugcaggggaauuaugagccaaucgaugccaccgguuucaucaacaucaauuaccucagacugaaggaauaucauuauuuccagaguaaggucacugucaaauagacccauguacaauggagaccuggggccuccucacuuugcagcucucccaacuacaggugcuaauuguugugacgauuuguaauugugacuuguucuccccagcuggcagaauaguggggcugccaggccccaacuuuguucccugaucucccugaagccugcaaaauuggucaucaaagggaaggguggaggacaaaugcaggaguaagcuauaaaaugacaauuaaaaaauaacaauucuaaauauuuaugcaccuaauaaugaagcuucaaaacacaugaaguaaaaacuagaacugaaaggaaaaaaaagaaacccauaauaauagcuggagauuucaacacuacucucuagguaauugacagaacaaagagaccagaaacaguaaggauauaaaauacuucaguggcaccaucaacaaguugaccuauuugauauuuacagaacacucacccaacaauagcagaauacacauaauuugcuaaugcacguaaaaaaauuaacuaaaauagggcauauuccaggccuuaaaaaaauggauugaaaucacucaaaguacuuucuuugaucacaaaggaguuaaaacggaaaucaauuaaggaacaaguccugaaauaucuggaagucaaacaauauaauucuaaauaaucaauggaaaaaagaaaccacaagggaaauuuaaaaacaucuugaauaaaaugaaaacauaauauaccaaaauuugugggagaaaacuaaaguacugcucagaacaguguuuccccaaaugugcuacacacuaaaaaucacauagggaguuuuuaaaaaucccauuguaccucauaucaauuuaaucaauuaaauaaaaauaucuggggaugggagacagaauuauuaauuuuuaaggauuccccagacaauuccaauuggcaacaaaauuugagagccacugguuuagaagaaauuuuuuuuuuaaauaaacuucuacguuaacaagguagaaaaagaaaagcaaauuaaaaucaaaguacauagaagggaagaaauaauaacaagcaaauaaucgaagaaauaaaaaacaaacccaaagcugcuuuuuggaaaacauuuuuaaaugauaaauagcuagaugaccaugggaauaaaauagaaaagacacaaauuaacaaauaucagaaauaaaaaaggagauauuauccagauacuucagacaucgaaacaaaaacagaggacuauugugaacaauuuuauaccauaacuuggauaaauuaaaugaaccaauugauuaaaagacacaaauuauaaaacugaaucaaaauaaaccccucaucaaucucaaaaguuuaacucauaauuaacaaucuucccaaaaagaaaauuccuggaccagaugguuucacuggucaauucuaucaaauauuuaaggaagaauuaaacccuauacaaacuuuuuuuagaaaagaaaaaaagaagaaauacuucccagcuuguuuaugaagccaccaagccuccaaauccagauagagauuacaaaaaaaaaauaaaagacagaccaauguaucucauacauauagacauaaagaaagaucuuuaacaaaauauuaccaaaucaaacccagcaauauaaaaaaaaaauacaucaugaugagguuuggcuuauccaggaaugugagauggguuuagcauccaaaaauccaaucaauguaauuuaccauauuaacagauuaaaaaacaaaacuauaugacaauaucaauaguuacagaaaagcauguggcaauaaucccucaguccuaauuuaagaaaaaaaaaaaaucucagcaaaguugaaacagaaagugugccaguuaucaaccucuugccugucagcuccaaauuuacccuucccuguccugcuuugugaugugggagcuagacccuguaucuuuucuuugccagcugcuguaacacuaaauuuuguuagcagagggugcuggagagaacaaugcaagaugaaggagcuucucuuucugcuuccgauaugcuuuguucuccuguuuuucuuauggcaaucagcaucacaaagauacccagugauacucacaucccagcaaguugcagcagcaccuccauaagcaacuucccagccaguuccacuagcaucccaagugguuuccuggcaagucgcaagauguuccaaccagcaguuucccggaaaguuucaaaaacacccccaugagaaucuuugcagugaacuugacccccuccucaggggcuggcucacuuccaccacauaccacagaagcaagaagagaauaaaguacacuagaaccagaaagagaagccccuuccuccuguuccccugcaggaagauuccgagugaauuucaaugucaccucugcaggcaauuucccagcaagucucaaaaagacccagaggguagcuuccugaaucaacaaacuagggugcauccauguaaucaaauauuagugagugauuuaaaaaaucauaaccuauaaagccauggaaagacaugaaagagucuuagccagcauacugcugaaagaagccaguaugaaaaagcuacauauuguaugaucccaauuaaaugacauucuaaaaaagacaaaauuguauaaacaguaaaaagaacaguaguaggaguaaugggcaggaggaagauagagaugaauagguaggagcaugggauuuuuagggaagugaaacuauucuguaugauaucacaaugauggaagcaugacaugcauuugucaaaauccauagagcuguacaacacaaagaaugaacccuaauguauagacuuuaguuaauaauauuguaucaauauugguucaucaguuuuaacaaauguacauuaauguaagacuaucauaauaggugaaacuguguacagggaaaaagggauuauaugagagcucucuacaaaaauauaaaacugcacuaaaaaauacagucuauuaauuuuuaaaaaaacacauuuucaaauuuucccauagcuuccuguagugggcagaauucuaagguggcaucccagauuccugcccacuggugcacacacucugaagauucccuuccccuuggggguggguagggcuuuaaguaugauaguuuucacucccaguaugauguuacauuauaugacaagcaugaaaagauuguauuaacguaauuaaagucccaaagcaguugucuucgaguuugucaaaacagagaugauucugggaguccuuaaaagggaguggguccuccuugaaggauaagccucaaagcuugagagagcuuuuccuguuggucuuaaagaagggggccuguauaggagccauguagcaaggacuuacaggaggggaccucuagagaccgagagcagucuccagacaagagcuagcaagaaaauguggacuucagucacacaauccccaaaaacuggauuaugccaacaaccacaugaacaugaaaaaggauccuaugagaucccagaugagauuauagcccaggggagaccuugacuuuaguauauaagaacuugagcacaaaauucagcuaugcccagacuuuugcccuacaaaaagucugagauaauuaauuuauauuuuuacaagccacuaaguuuguggcuuauuaaacagcaauagaaaacuaauacagucuguuaccuucagguugacaaaucaccaacgucaacaaaauaggcuaaaagaagacauuuuggaauuuuguacauuuugacaauugaagugaauuucauagucauaaaaauuuacuuauuuugcauauaguuggcauuugauauuuugaaaagccaaauuauaacuaguauauaugacacaaccacagccuauagaaaaaaauuacacaccugagaauaaaaugcaacaacaaaucuaucaggaaguaauuuaggaauaaaauucucaauuucaaagaaauuucacauaacaacuuaaaauucuacuuaggauuuuacaaauugcuaccaagugauaauuaaauguuuuuaauuuuuaaacauauacagguuuuaaacaacaacaacaacaaaaaaacagaaaaaaaauuuugaaaccugcaaauaaaacauaucaugaguccuaaauuucugaaaagagauuugcauaauuuuccuuaauuguacacuuuaaaaugguucauaauauuaugugaacuucaucucaguuuuaaaaaguuaaucugagcauucuaaauauuaauuauaauuauuacauguagaucuacggagaacaucuauucccaguuuuugucaacacccaacuacgcaaauaaaaucaacagcacauaaacagaaaaucaucagcuaucccauuaaaguacauauugaaacuuuauauacgaugcuugaaaggucaccuguucacugcauuaaaaauuucuuccccgugcuaggcauacaaugaauaaaauaugcagucuuucagaaaacuguauguaaugauaugucauagcaguucacacaauuguacuaaacaauaugcaugcuuucuguuuuucuaucaauuaaauauucaggaauuacugucaaaugccaugucauagcaugacagagauuuagcccagauuuugaaaucugguuugaaccacuagaauuagcaaacuaagcagcaacauaaaauauuaagcaugucaaccaaauaauccacuuucccucugucuuuggagaugccuuauuaaauuuccuaagagaaaaauaaaaguacuucauguaaaaaguuuuaaccccugcuuugaaaacacauauuuuagcccaucauauaagguuuuuuaauaugauugguucuaauaaucauauuuuuaaaaucccaaccagaagaagcacuuuaaaaguauuuuuucaguuuaauaugcacaggucugccagcauaauauuuguccauaauuaagaaaauugcuuacuugcucaguaggcaauacaugaaucauauguaguauaaaauuagaccacaauugagaguuuaaucccuaaacaacauccaaaguuaagcagaauaugguaugauacauaauaccuuuaauauaauuaaaugagccuuaauuuuacauaaauauauuaauaaauuagauauauacuauccaauacaguaaccauaaacuacauguaucuauuuaaacugaaaauaauuuaaaguacauaaaauuaaagauucacuuucuuaguugcacucaccacaucucaaguauucaacaaacuaccauauuagguagcacagauauagaagauuucuaucauugaagaaacaguacuuauuugacagaguugaguuuaccauaaaacucaucauaaagcuuaagcuucaggccuccucauuugaaaaugucccugcagguacccuagcaauguguccaugauuauauauuuuaguaaaauuuguaaaaguaagauacuuugccaaugaaauaucuuucuccacuuccucuucuucuccaccaaucuccuguugucggguggagggcgucacagugagcaaccuggggaucaugcaaagggugauauauucaguuugggugauacauucagaauugguagcacauuguuuuuagugggauauauguaagugguucuuggucauuucuauguguaauuaguuuaccaucuguuccaguauaggaauggcuucuaggaauacaucccuuucccaacugugcuaacucacaugggguccugauaugaagguucguagucagaggucuaugaagaccccucaauguguaaccucugucacgaaugugucccauggcaacgagaacuaaagauuuguggcaaaugggagagaagcagagacugaaauuuauacagccagaagcuacucuguggaaaauucuuccaauaaggagacaugaaauagaauaagcagauaauuccauuuguaaucaaugccuagucaaguuuucucuuauuaggaauagaguugauagugcauauacaauuauaaauguagcagacauuucuuuuuucuuuuugaugggacucacaaugaaauagaacuuuucagacacugcguuugcaaagcccaaaucugcagcuguucuauaaauacuaugucugugagugaagcugcacaguuuauacagcucaauuaucaauaauaaaaacaaaaucuuccuaaccauaguacaggaaaguccaauuuaucuuucuaaaucuauaaaaaauuauauuauaaagucauugucaucugagaggggcucaaacauuauguauccuauagauguggaaaagguaguuuaaaagugugaucagcagcuauuuuuccaaauauuauuaugauaaugucacugaccaucuuuuacgaaauuguaaucaguugugauuucuuuucucauucuaaauacauauugacuuguauauaaauuugcaucuguaauuuuguauuuuuuuuaggagggcugccuccaaauggucugccuccuuucagguccccaauaaaaccuugaucugacccugaugcuagaaaauuaugucuugauuaaaauauauauucacuaauuaguaaucucuauguauuccuuucuucauccuagauguacugcaauaucaauaacccagucacaucauugucacugaauucuaggauuuaaaaggguaaauuugaaauacgucccuucugcucacucuggaccuaaucugauaucuuuucagccuucgguacaaaaagcucacaccucacuagcacuaauacaaaugucauuccuaguaauuagguuacacugagugccuuugagcuuugcagugcuacugccagugaaguucuuaauacauuuacagucaugguuauuuaaaccacuaaggcuuuucuuugaguaaacaauauauugaucaaaucaaaugcuagccugacaauaccaauuaauuuaagaaaauaaaaaauacacaaaaauuucuguuaucuaauuauauugaagagauugcuccuaaaacaaacauuuguaaaaccaccuuuuuguacuaugaaaauuauauuuguacacauacaaauauaaaaaugcccaauagcuaaaugccacuuaugcaaauagucccuaaguuuucuuugauuuacaguuuauuucauacucuuuauauuucauuaagccauccuucaauaaacuauuuuuucaauauuguguugcgaagauauucucagccugaaauuacaucaaauaaauuacaaaucaaauuucugaaagccacugccauagguggaaaucaaaucaaaugccuagcuucacauaaaugguuaaagcuuuaaauaaauugcauuuauauaauugccuuacuugcugcugccuccuacagcuguagaauaauguuauuccaauauaugaagaauauauuggcagacaagacuaaaaaauuuugaauuauuaauuaaaaaugggaaguuuuauuaaauacauuaaagaacugaauuuagacuuggaauacauauauuccuguagcucuguuucucugauuaggcccugacuguuacacuuuuacuaaagauuuuuuuuaaaaggaagaaaaaauuucuuaccuaagaggauuuggagcugugaaaggaaaugggccccaaaaucacuaagcuaaagggaaaagucgaucugggaacugcuuaggacaaaccugucucccgugcuauucaaagucacuccucugcucacugaaauaaauguguaucugauugccuccuuuggagaggcuaaucagaaacucaaaagaaggcaaucauuugucucuuaucuaccuaugaccuggaaguccccucccugcuuugaguuguccugccuuucuggacagaaccaauguuuaucuuacauauguuuauuaugucucaugucucccuaaaaugcaugaaaccaaacuguguucugaccaccaugggcacauaucgucaggaccaccggagaccuugucacaggcacguguccucagccuuggcaaaauaaacuuucuaaauuaacugagaccugucucagauuuucaggguucacagaacaaaaugauaauuuacugcccuuacucaaaaaauauuguccuauucauagaaaaagaaaaugauaaggugguuuccagacacuggaaguaguggagaaguguuacauaguuauugcuuaauggauacacggcuucaguuugagacuaugaaaacauucuggaaauggauagugaggauggcugcaccugcaccacaauaagaauguauuuaaugucauugaacuguacacuuaaagaugguuaaaaugguacauuacauguuauauauauucuaucacaauaaaaauguuucaauuguucuaauuauauuuacauuuuuauauucauuuuuucugagauucagccugaauugaaaagugcuucauuauaaauaauagaaauuaaauacuuaaguuggucauucaaacucacaauaaaauggagaaaagaaaucaaguuuucuaaguugugacucugugagcacuuuacuaccacacaaauugagagaucacaaaagaaauuccgaacuucucugaccaaggacaguuguuuugaaacaaauaaaaaaacuaucuguacaauaaagguacaggugaaacuuucuuuuuuuuaaacuucaaguucuaggguacaugugcacaauguuugcagguuugauacauaacuaugcaugugccaucuugguuugcugcauccaucaacucaucuuuuacauuagguauuucuccuaacgcuaucccucccccagccccccaccccccgauagucccccgugugugauguuccccgcccuguguccaggcgaucucauuguucaauucccaccuaugagugagaacaugcggugucugguuuucuguccuugugauaauuuacugagaaugaugguuuccagcuucagccacaucccugccaauaacaugaaaucauccuuuuuuaugacuacauaguauuccaugguguauaagugccacauuuucuuaauccagucuaucaaugauggacauuuggguugguuccaagucuuugcuauugugaauagugcugcaauaaacauacgugugcaugugccuuuauaguagcaugauuuauaauccuuuggguauauacccaguaaugggaccgcugggucaaaugguaauucuaguucuagauccuugaggaaucaccacacugucuuccacaauggcagaacuaauuuacagucccaccaacaguguaaaagcauuccuauuucuccacauccucuccagcaucuguuguucccugaguuuuuaaugauugccauucuaacuggcaugagaugguuaucucauugugguuuugauuugcauuucucugaugaccagugaugaugaccauuuuuucaugugucuguuggcugcauagaugucuucuuuugagaagugucuguuuauauccuuugcccacuuuuugaugggguuguuuguuuuuuucuuuuuuuuuuuuuuuuuuuugagacggagucucgcucuguggcccaggugggagugcaguggcgcaaucucggcucacugcaagcuccgccucccggguucacgccauucuccugccucagccucccgaguagcugggacuacaggcgcccgccaucaugcccggcuaauuuuuuuuuguauuuuuaguagagacgggguuucaccguguuagccaggauggucucgaucuccugaccuugauccacccgccucggccucccaaagugcugggauuacaagcgugagccaccgcgcccggccuguuuuuuucuuguaaauugguuugaguacuuuguagauucuggauauuagcccuuugucagacggguagauugcaaaaauuuucucccauucuguagauugccuguucacucugaugguaguuucuuuugccaugcagaagcucuuuaguuuaauuagaucccauuugucuauuuuggcuuuuguugccauugcuuaugguguuuuagucaugaaguccuuguccaugccuauguccugaaugguauugccuagguuuccuucuaggguuuuuaugguuuuaggucuagcauagaagucuuuaauccaucuugaauuaauuuuuguauaagggguuaggaagggauccaguuucagcuuucuacauacagcuagccaguuuucccagcaccauuuauuaaacagagaauccuuuccccauuucuuguuguuuuugucacguuugucaaagaacagauggcuguagaugugugguguuauuucugagcccucuguucuguuccauuggucuauaucucuguuuugguaccaguaccaugcuguuuugguuacuguagcauuguagucuaguuugaaaucagguagcaugaugccuccagcuuuguucuuuuggcuuaggagugucuuggcaaugagggcucuuuuuugguuccauagaacuuuaagguaccuuuuccaauucuguaaagaaagucauugguagcuugauggggauggcauugaaucaauaaauuacuuugggcaguauggccauuuucaugauauugauucuuccuauccaugagcaagggauauucuuccacuuguuucuguccucuucuauuucauugagcagugguuuguaguucuccuugaagaggucaccacaucccuuggaaguuggauuccuagguauuuuacucucuuuguagcaauugugaaugggagaucauucaugauuuggcucucuguuuguuaaugggguauagaaaugcuugugauuuuugcacauugguuuugcauccugagacuuugcugaaguugcuuaucagcuuaaggagauuuuggguugagacgauagucuuuucuacaaauacaaucaugucaucugcaaacaggaaaaauuugacuuccucuuuuccuaacugaauacccuuuauuucuuucucuugccugauugcccuggccagaacuuccaacacuacguugaauaggaguggugagagagggcauccuugucuugugucgguuuucaaagggaaugcuuccaguuuuugcccauucagugugauauuggcuguggguuugucauagauagcucuuuuaauuuugagauauguuucaucaauaccuaguuuauugaaaguuuuuagcaugaagggguguugaauuuugucaaaggccuuuucugcaucuauugagauaaucaugugguuuuugucauugguucuguuuaagugauggauuacguuuauugauuugcauauauugaaccagccuugcaucccagggaugaagcccacuugaucaugguggauaagcuucuugaugugcugcuggauuugguuugccaguauuuuauugaggauuucugcaucgauuuucaucagggauauuggucuaaaauucuuuuuuguugugucucugccaggcuuugguaucaggaugaugcuggccucauaaaaugaguuaaggaggauucccucuuuuucuauugaauggaauaguuucagaaggaaugguaccagcuaaucuuuguaccucugguagaauucggcugugaauccaucugguccuggacuuuuuuuguuugguagccuauuaauuauugccucaauuucagagccuguuauuggucuauuuagagauucaacuucuuccugguuuagucuugggaggcuguauguuuccaggaauuuauccacuucuucuagauuuucuaguuuauuugcguaaagguguuuauaguauucucugaugguaguuuguauuucugugggauaggugguuauacccccuuuaucauuuuuuauugugucuauuugauucuucucucuuuucuucuuuauuaaacuugcuagagguguaucuuugggacacauuuaaagcaguguguagagggaaauuuauagcacuaaaugcccacaagagaaagcaggaaagaucuaaaaucgacacucuaacaucacaauuaaaagaacuagagaagcaaaagcaaacaaauucaaaagccagcagaaggcaagaaauaacuaagaucagugcagaagugaaagacacaaaaaauccuucaaaaaaaucaaugaauccaggaacugguuuuuugaaaacaucaacaaaauugacagugaaacuuuuuuaaguaaaaagauaguuaacuauacuaauggcuacacugagcaugauaauuauugcagauggucaaugguaaagcaaguguaguuguuucagcuguagagauaacguaauuaaaugaacaguauagacaucugaucaacuuugaauaaucaaucuuaucacguauaccaacaugcccuguucuucacaaaauccauucacaaauucuaggauguaugauuuuuuaagugaauucugauucguuagagguuaauguuuacgaaugcaaacagcaucuguagaaccugauuuacgguaagguacuuucuacucaucacaguaucuccaccguuuaacacuguuacaacgcaagugcacaacaaauaucuguuuaaguagccaggaaggaaggagagaaggaagaagagaaugagggagagaaggaagauagaugggugguuucgguagauucuuaaaacccauccguuaauacucaguguuuggcugugguaugaauaaaagagagaggcuagagacuacaaguaauuaacagacugcgagggccagugucccagacuaagccaugcuaauuuuuagauauuacucgugacuuuuuucucuacugacaaaagcucagcauuuaaauauauuaggugacacauauaucacaagguaccugaauaacagcugggauucauuacaucuguauaaucaucuaugcaugauguauagccaugcuacuuaaaacuauaucuuaaauaugaagacucuuaacagaguaauuucauacauuccaaaauauuucucuucauuguacauuaauuaaaacuauauuuucaacauuuuauaauaaaucauucuaaaagccaaauauuaagcaauucuaccacaaaaccaaaacauuugaaacaaucaccauauuuugacuuugcaacuuuuguaaaauaugugguuauuugggucacagaauuguaucacauuuguugacuaccaggcaaaauucuuugacaagugacuuucagguuuacacagucugcugccauuauagcaauuauauggcauaauggaaugcuagccauguguacuucugacauuccucuaaauccaggucauuagucauuacaugaagucauuuuaaguuuccuucaucaauugcccucuguaguuuuccagcugucauuucauuuguuaguuucaacugaaauguaaauguaauagauguaaauguuuauuuagggauugcuuccccuuucuguuuuucacauaaacacuuacauacuucgauuccuuaaacacaacauguuuuggcaaaacuaaucuauaguaaagggggaaaagugagaaaugugguucccugugaggugugggagcagaaggugacugagaaggaccaugagaggacuuucugggaugauguuaauguucuguaucuugauagagauuaggguuacacaacauaggcauauguuaaaacuagcaaauguucacuuaagauuuauauacacuauuguauuuaaauuuuaccucaaaagaaaaaaaaacuguaaacuauucuugaacucuaguuaacaauacgcauguugaaaguauuuagggggaagugccuauaguuuacuuugaaaugcauuauaaauaaauaagauggacugauggaugaauagagggauuaaaauauagauagauaagauaacagaaaagugauaagauaugaguggugaguauacugguguucacuguaauugucuuuugacuucucuguauguuugaaaauuuccauaauaaaauacauuuucaaauuuaaaaagucauuucuccaaaauccuuuuaauuuucaaauucacucaguaaagaaagaggaaucagcaaguguucccaaacauuuugaaccauaaucuuaguuacccaccugcuggaucauucuuagaucauuucuuaguagucagaaaaacugguccaaauaauuaagacucgauaaaaaucuugcuaaauuaaucaaacauauaauuuauucaucuacuccuucauuuauuccacaaauacaugucaaagaccucuaagaagcagaugucucuucuaaaugcuacagaaaaagagaacugaauuguaauacaacgugauauacauuaacugcuauaaaaacacgacagggagggcauuuucgggaccaugaagggugaguaaaauuuugccagauuggguacagggagcagaaaguucaucccaggguauggacuaucauguagguaaccuuauaauacauaaacuuuguuuuacagcuaaaaaagguaaauuauauauuucugguaguugcuucucaaauaugucaaaauaauuuaaaauaaauauauguacauuaaucccuccuuuuuguaucuuacauacugauuuuagaagauucugcaaucuuuucaaucaccaguauaauuuagguuuugcuuauucaccacuaaaucacagcaacauguauuucauuuauaauaauuaaagguauguucguucacauuugaugguauuaccacugagagguuuuuugcaauaacauguuuucccuggaacucacuuugggaaacaauucucuaaagucuugaaaucccaagagugcauacucagggauuagaaagguuucccuagaccaggaugcaaauaaaaaugcaaaucuuucacacagcaacucugcccccaaaaaacugacaaaggacaaauaucaaaguacuguguaaauugucuacaaucuauuuagagacuuuaaauauguuauguuguccuuuuuaaggcauguggcuggucacauuuccuuugaugaguaguuugccuuucuaagcaaccuaaccaaaauucuggcauaugugaguuuacugcaauauuauuucuuuaugaucugcaagauguggauaucacugucuaucucacaugcuuaacgugaagguuauaugagauuuuuuuaaauaaugaaagucaguguuugguguuuaauaaauaguaguaauuaacaauaaaaaauauuuacccauauaccuauucaggcaauuguacaaccaugcuuuuaaauuugagccaggaacugaggugagccagaauucaucuuauuuuaugaguauaguuacaaaguccuaacucauagucucauugcauuacugaucacuuuaaugucaugauaauuuuucauuugcucccuuucagauccaaacuccuuacuucacugaucacccaagacugguacucuuuacggaguucgcuagcgaagaccuuagaauucuuuuaucauuuaucuguuaguggcugaggauagaaauaucaguggaccuucaccucaaauaauccucuaaaaaaauucccagcgacugaguugggccagaaguucagacucaagauacuuuguaauuuguuucaaauuauuuucuguagguacuaucaaaugaucccuaagccaaaugaaaugcuuuguucuaaugacugaaaaaaucaguuaagaaaggcaggauuaauauuagggcacuucuuaggacuggacagugcauuauaaaagaaaaugaagaacauucagagauccaagagaaaagagacuucuagaacaaaaaauaaauagaaaaccugauuucauuuguuaguacaaauaauaaugacugucacuauuuaacagaaaacuacauuaccauauugaaauagaaagaagugagaauucgaagcuauaacuuugagaugcaauuaagugauccaacucaauaaaccuuaaacagaagacuguuucuauucagagugccagaacagugugaaucugggaacaaccuuggaaaaggaucuugacuauggaucagauauuaaucuccaugcuauguuuccauuaugccaaaaaauuaagcacucuuaauauuuacgacaguauuaaauuauaaaucuagccccacauaucaaaaaauuuuaaaauaguuacaucuuuaaugucauuaagagcaaauacagagccucaggcucaguucuauuagguaaguucauaucacugacauuuucuucccaugaaacacauuggacuuaagauauagcuaugaauauaauuuugcuggaauacuaaugauauucauuuuaaaaucugagugcuauuaguacccacuuucaauuuuucaucuuucaugauacgcuccugguacaaguguagucuguguagcaacacacucaugcuguacaccucauuggcucaguccugucagcagauugagugcauuugaaucuuuauguuccuuuuuuuagaauuugcaauauucuaggagagugauuuucuuuauuguucccuuauauuguauuucacccuuacagaaaaugauagaguaauuagaaucuuauuuuccaaauaagucacucugucuucuuugucuaaaaaauauauuuucuguuucacauauagaugauaaagacuaaagcaguagaaaaaugaauaccaaaaaugucaagagaaauaggggguuucaauuguaauuuuuuaaaguaauaaggacuggaaaaaaauucuauauaaaaauugaaugauuaaaaauacuaaaaugguuccuuacugcccuaaauaaaaccuuuacaagaugcuucauaugugaaauaaauuaagaaucaauucaaaagaagagaaacuuuuuucaguaaaauggguaaaaucuuuuaaaaaccuuuuaaaauuuucuuugauacaguaacuuucuaaagaaauguucaagugucuaucaauuuuacuuucacgaaagaaaucuaacucugcuuuacugacaaugcaguuuauuuuaaaacuagagcaguacaaaaaggucacaaaaagacuuucugaaauauaaaaucagucuaagauaagcaaagcugaaaugacuaucuauaccaccuuuccaaaccuauuaaugcuucaaacuauauuauuauacaaccacaaacaaauauguacauacucucuacuagaacaucuccauaguugccgugaaucauucuuucauuuuccauaaguacuuacaaagcuccauaaguacuuacaaagcaguauaguauucaauuuuaaaaguguaaaaauaaaauacacagaguuuugacaaauagaaaguaucagauaaaacgcgaaugaaggcuagauggcuagguggaugggagguggguggauggacagauacauaaguaguuggaugaauaggugcucaggacauaugaauggaugaauauggugcuuucuaucaaauaaaagaacaugcaauccuuuuuucuucuuucauuaaguaacacuuguauauuaaucuagguguugcccaugagcuucaagagcagcuucaugaaucucugggaacugcauguagggaaaugcauguugauauagguacacacauguggggccuggggaaggggguaagcaugccuauaggcaucaacacaaaaaaaggccccuucuucuaaucuccagaaacaauuaaccuacucuuuucaaaaacucuacuuugccagucuuucaucuuucagcagaagaggcaaggccugagugaaaaguaugaugccuccucuggcuuggcagccuaaacaaacaagcuuuccacacauagaccagggaagcuuccacacccacaucuggugcuaggcaugguuccugaauucaacagcaggauaauaccuguccacuauguaauaaaggcacuaaaaguuagcuuuaaaaaaaaaaaucaacauagaauuccugauuucauauuuaugaaauagcauccuuucacaauagcacagaagaauuaaguaaacaauuuaaagauucacaucuaauugagcuccaacucagauaaaauagccuguguuucuuaaauugagacucccacaacuaaauuuugccuuucaaaggcaaaagaauuuugaagaaaugguaucuuccuagagaucccuuuggggaacauuuuuacaaacacuuuucaugugggcaaaauaauuucacuaguuuguuuauuggacauauuggccuguacuuucacaaaugcagacccaaaaaucaaaaucagagauggaaaagggcaaacaguauuauauagcaaguaugcuuggauaagaaucaaaguagaaggcuuaggguuuggcucuaaaauuagccaacuagacaugaguuucugagcaagaaugaucauaauguaguuuaguucccuuucaguggcuauugccacauguauacaaaacaaacauaaggaaaugcaucauauucuuaagauacucauccucucauccaucugguuuuaucucauaaauuacaaaguccuauuugaaauucuuauuauaauauuaaaauugggaaaagagcaaaauuagagaauacauaagguaaggaauauugaaaauuaauaacaaaguaaagaaauacguuugaauuuuuucacaauuucuacaauaugccuccugaauaaccuaacugaaauaugucugacaacuacagcuauggaaucuaaaaguaacagaauauuauuauuuuccuuccugguaaaaaaauaaaaagcauauaaauuuauacauuuuuaggaaaagcuaaaaaugucaucaaguaugccuuuuagccuucuuuaacuucuuuucaaaaaucuaaauuuauaauagaucuauaguucugagacuauauaauccuguuagccuaaaaagagauaaauaauuauaaauaaaauuauuguauuuccuugauuuaucagacucuccauccucaaaccaaaauccuuacuuaauuaagcagggcaaauauaagcaaucacuuagaaaaguggugugauaacuauuuuaaacuauuaaucuuuuuaaaaguaagccuuuuuaggagaucuaaguaguacacucaaauauugucuuggaugcugggugcacaaaauaagaaccuauaccaguucaugaauauuuuuauuguuuucucuuuuacccagggagagaaauagacaaaagacacuauuaaaguuaaauauaggcugggcaugguggcugacaucuguaaucccauaacuuuggaagcccaagggagguggaucacuugaggucagcaguucgagaccagccuggacaacauggcaaaaccccauuucuacuaaaaauacaaaaauuagucagacgugguggugagugccuguagggccagcuacucgggaggcugaggcaugagaaucgcuugaaccuaggagacagagauugcagugagccaagaucacgccacugcacuccagccuaggcaaaagagugagacucugucucacaaaaaaguuaaauacacugugcccuuuuuuaucuugaccacaaaaggucuccaucucaguaauagguaucauacuugcaguaccuccguggcauaugcccaggauuuauagaucuuuuguuagauaacaaaauccagauaaauuaagagagaaaaugcaaccugugguacaauaauacccaucauuaaugaacuucggacuuucccaguauuucacuagucaguguaaagagaaauuguuguacgcucaugagcaagucaguuugcuuggucucaguuuucucauacauaauaaaguauuuuacacauuccuuuuauuaaucuauaaacucuauaagcaaggaucaugguacccuaacacccgcccaacauaggcagccaaaaaauaugcaugugcagaaugcaagaucacacagguuuuuuccagccaacuuuaucuucaauuauauaauuuuuuaagucuaauauuuggguggauagguccauaaugcauauuaaaacaaaaaagagggugguuagggccacaaaaaugugguagaaauaauugaagaucacaaaagaagaaacaauuuccuagaguucaaguggccuccaucaaacuuuaccaaaacccuaccaaaagcucuaauucuaaacuuuauaaaaaagucauagaaguauaauuucucuuucagaaguaauggcuuuuguuguuguugcuguuguuguuguuucuaguugagaccuuugcugaaugucuaagaauuggaaaaacaaugaagucaaaccuuuccuaauuucuauuuuaagauauuuauacuuuuuccaaacuuuccucagauuuaaaaaaaaaauuguauucuuuggaaaacaaaaaguuaguacucagaaauucauauuugguaaaccacuccaguaaauuaauugaacccaaagagggggucaugggaacugcaacuugaagccaguucaucagaaguuccagagaccuagacuugagacugguagaggaggaauagggaaaggugcagucuugggaacuaugcccuaaaccugugggaucugacacuaucuccagguagguagugucaggacugaauuagaggacacccagcuggugucugcugcuuggagugugggggaaaaaaaaccccacacauauggucacagcagucuucuguguugaugauuguugugguguuagaguagaggaaaaacacaguuagagagaguuuuccuuaaacaaauggugucagugaagcaagauuagcuggaacaccaugaucaggugggauuuauccuagggaagcaaggaugguucaaaagacacaaauuaauaaaugugauacauugcauaaacagaauuaaggacaaaacccauaugaucaucucaacagaugcagaaaaugccuucaguaaaauucagcauggcuucgugauaaaaauccucaacaaacuagguauagaaggaacauacuucaacauaauaaaggccauauaugacaaacccacagccaacauuuuacuuaauauggaaaaguugaaagcauuuccucugagaacuggaaaaggacaagaauucccacuuucaccacucuuacucaauaucauacuggaaguucucacuagagcaaucaggcaagagaaaauauucaaaggcauccaaauuggaugccucuucacugaugauaagaucuaguaucuagagaacccuaaagauuccaccaaaaaaaccuuagauuugauaaaugaauucaguaaaguuucaggauacaaaauuaauauacagaaaucaguagcauuucuauacaccaguaacgaccuagccaagaaccaaaucaaggaggcaaucccacuuccaacagcuacaaaaaaaaagaaaaaaaaaaacacaccugggaauauauuuaacaaagaaggugaacuaucuguuguauuagucaauucucaugcugcuaugaagaaaccugacacuggguaauuuauaaagaaaagagguucaauuggcucacaguucugcaugucuggggaggccucaggauacuuacaaucauggcagaagacaccucuucacauggcagcaggagacagaaugagugccagaaggggaaaugccagaugcuuaucucaugagaacucacucacuaucacgagaacagcaugggggaaaccaccccaguauuaguccguuuucacacugcugauaaagacauacccuagacugggcaauuuacaaaagaaagagauuuaauuggacuuacaggucaacauggcuggggaagccucacaaucaugguggaaggcaaggaagaacaagucccaucuuacacggauggcagcaggcaaggagagaaaugaugaggaagacaugaaagcagaaaccccuuaucaaaccaucagauccugugagaguuauucacuacaaugagaacugaaucaugagugaaacugcucccauaauucaauugucucccaccauguccuuccuacaacacaugggaauuaugggaguacaauucaagaugagauuuggguggggacacagagccaaaccauaucagaccccacgauucaauuagcuccaccugucuugcccuugaaacgugaggauauuauaauucaaggugagauuuggguggggacacagaacaaaaccauaucaucucuuuaagaagaacuacaaaauacugaugaaagaaaguguagaugacacaaccaaauuuuuaaaaaucccauaaccauagaauggaagaaauaauauuguuaaaaaugaccauacuacauggagcaaucuacagguucaacacaaucccuauuaaauuacuaacaucauuuuucacagaauuagagaaaacaauccuaaaauucauauggaaacaaaaaagaccccaaauagccacagcaauccuaagcagaaagaacaauguuggaggcaucacauuaccugacuuuaaauuauacuacgaggcuacaggaaccaaaacagcaugguacagguauaaaaguagacagguccaugguauagaauagagaacccagaaacaaugccacauacauauaacuaacuaaucuucaacaaagucaacaaaaauauacacugaaaaaguucuauccuauuuaauacauagugcugugaaaacugaauagccuagccauaugcagaagaaugaaaguggacccauaccugucacaaagucuuauguucuggucuuuggauuaggcaaugauuuuaugaccaaguccucaaaagccaaugcaacaaaaacaaaaauagacaaaugaggauuaaauacaguaaaaagcuucugcacagcaaaagaaucacaaucagcagaguaaacagacaaacuacagaauguuuuccacaagaaaaaaaaaaaauaaccccauuaaaaagugggcaaaggacaugaacagucauuuuucuuuuuguuuuuuugucuuguuuguuuuuuguuuuuuuguuuuauuguuuuugagacagacucucacucuguugcacaggauggagugcaguggcgcaaucuuggcucacugcaaccuccaccucuuggauucaagagauucuccugccucagccucccacccaggauuacagcugggauuacaggcgccuuccaccaugcccagcuaauuuuuguauuuuuaguagagacaggguuuuaacauguuggucaggcuggucucaaacucuugaccuccggugauccacccgccucggccucccaaagugcugggauuuacaagcaugagccacugugccuggcugaacagccauuuuucaaaagaagacaaacaagcagccaacaagcagccagucaugacacaaggugaaaaaugcucaccaucacuauucaucagagaaauucaaauuagaagcacaaucauacauuucucauaccaucuuucaccagucagaauggcuacuauuaaaaauccuaaaaacaauagauguuggcaaggaugcagauaagugaacacuuauaaacuauugguaaaaauguaaauuaguacaagcucuauagaaaacuguauggagauuucucaaagaauuaaaagugaaacuaccauuagauauacugaucacacuucuggguaucuauccaaagggaagaaaucaucauauuaaaaagaugcuugaaauuauaucuuuaucacugcacuagucacaauagcaaagguauggaaucaaccuaaauguccaucaauggaggauuucauaaagaaaaugugguauauauacaacuuagaauacuaugcagucauaaaaaagaaugaaauaauguccuuggcagcaacauggauagaacuggaggccauuaccuuaguaaaauaacucacaaagucaaauacuucauauucucacuuauaaauggaggcuaaacaaugaguacacauggacauacagaguggaacaauggacacugcagacuccaaaaggugggagggugggagguggguaaggguuuaaaaauuaccuauugggugcaauguucacuauucaggugaugggcacacuaaaugccaagacuacaccacuauguaauauacacauguaagaaaccugcacuuguccccacuaaauauauuuuuaaagaaauucacaauuggacaagcgauuuuaauaucccaaaauacaggaaaaaaaacuaugagcuacaaauuauagaagcagccagccaaucacagcugccacagcuugggcaucucacuuucauuuaguuagauccaccccgggcaacaguucuuccagacccuucaguguuuugggggcaucccuauacuccugcagugggccccauucaucaaggauagcagcuaucagacccccuauagauguagacagccagccuagaauuuccuccgcauacuuccucucucccaaucccaucaucuuggcacucaugggauuuucuucaacuuauugccaugcauaccagguguccugccagaccucuguggacuucaauuagauggcacuauguuugagaggccaaagaagagacccagaauuaguaaaagagacaacagaguuuauuaagggaacauauguacugggcaguccaauggcggaggcuggacaggagaaccuguccaguaagacuccagaaaaagcaaaaaauauuaaaauaaaggauuuauuacauaaauuaugucauauccacuuggcccucuauuuaaaauccauuaggauauuaaacauaaaaaccaacaggcaacauggaaaagcuuuguuuacaaaaaaaaaugacauugggcuggaaggaaauacacuacacucuaaaaagguauacuuuuaaccaaacaauguauaaauacaaaaacaaaauuucucagcauaauauuucauaaacuagaaaacuuacauaaaaauguauucuuaaguaagacaguacggacuugucucccaagucuuuuuuucuuacacacacacauacacacacacacacacaccccacacauauaugaauacuuuuuaaacauuuuuucucauuauguaaaaaaucaaaauaaaguaacccaaaaauuuuuaagcccuaaauauuuuauuauacuuguaauacugucacuaaguuaaacucaaagaaucuaacauuaggucauuagacaaaacugcacuguguuaaucuguuugcacugcuauaaagcaauaccucagacuggguaauuuauaaagaagagguuuauuuuggcuuacaguucuacaggcuguacaggaagcagauugcuagcaucugcuccuggugagggccugaggaaguuuccagucauggcagaaggugaagggggugcagguauggcaagagagcaagcaagaguggagaggugccacacucuuuuagacaaacagauuuugcaugaacuuagagcaagaacucacucauuaucaugaggaacgcaauaagcuuuucauuagggauccgcccccaugacccaaccaccuccccuaccuucaucauuggggguuauauuucaacaugagauuuggagcagacaaacauccaaacuguauauaacgcacuuauucuuuuuuaaugaaaaucagucaaaauauaucuuuaaaaaaauacauccacagccagacacgguggcucgugccuguaaucccagcacuuugggaggccaaggcggguggaucaccugaggucaugaguucgagaccagccugaccaacguggaaaaaccccaucucuacuaaaaauacaaaauuaaccaggcaacaugccacaugccuguaaucccagcuacucaggaggcugaggcaagagaaucgcuugaacccgggagacagagguugcacugagccgagaucacgcccauugccccacagacugggcaacaagagcgaaacuacaucucaaaaaaaauaaauuaaugcaucccacugcuaucacaguuuuuaaaaacccaaagugaaaacaaauaacugugucagacuaucuuuagcaacaaaacgcaaaaacgauaacgucuagaaauauauguaaaauaauuuuaauuauaccauuuauaaaagauuuuauuuuuuaaauuaccaguucuuuucauuuuacuauuucuucuaaaccagccaucuggccgcuuucaccuuacaauguaugguaucuauuuuuaucugauauauuccuaucuuauuuauugauuaucugucuggcccacuggaauguaaacuccuuaagaaauuuuuuuaucuuguucaaaacccagagucacuacauacaaauguguagguuuuacacaugugaauaucauuacaguuaugcagugcacaaccugcagaacugaauaugguaggucuggcugugaacaaauaauuaucagacauguaauaaaacgccagagaucuuaacaguucuguguccucccuaguggugaugcaaacccucucuaggcaugcaugccaggaaaagcuguuccucaacauuuucaauuccuaaauauucuuuaacauuauguuacacaagcauguacaaauuauuugcucuuugcuauuccaugaaaucuauaacagcaaaauauuucugaggcagaaaccaacucaacggaguuaccuauuaaaggccaauaugaaugaauuauaauagcaguaaauuuuuaaaguauuuuucaccaaaaauacuaaauuguuuacuauuagacacauaucaauuauuuuuaaaauaacaugcugacagucucaaagaauacuguaaaucuauauaucauuaauguaauccauuuuuauguucuuaaacaucuaaaauuauagaacuacauuuuuuuauaaacugucaucucuuuuuuauuaaaaaaagaagauuuuuaugaaaaaccucugaguuuaaauuacuauuauauucaggagucccacacccacuguuuccaaacauagcucuuuuuauaacaacuucugacaauccucuagagaacaaaaauucacuuuuaaucaaaguuaaaugcuagaacuguuuccugggaaauuuaauucaagguaaacaaucuacuugauauugucuuauucacacaaagcuguguuguuagaagaaaugauaaugaaauauaaaaccuuucucuucuagguuauuguuuacaaucuggacaaagcugauaggcaaaagaaagcagagaaagccaaugugaaaggaauguguaggauuagucacgcuucuucccagaagauagauguugaccaguaagacuaucaguuacuaaacacagcccucucauucuacaccccuaacacaaucucuuaaaaaagaaauuacaacuuccaaucuccauuugucaaguaucuugaauuuaaauauacaggucuucacaaauaugaacuaaaauucaacaaaguuuugucuacuaugugcuggacacuaauaggauaaaaaugacuaggaaacacuucuugccucagaggaacuuugcaugcaaaugacaacauuacuuggcaacaaaagaauguggacacaaugugaaaucaagccgggguccagcaguuagaaucagcccuuccuugacuacaccagggacauacuacuacaaaucauucugucuuauaccccagcauccagcuauccucuggaaaugcuucucccugaaguuuacauccuugcuuagcuauuucacucaucuacuccacggcuaaucccuucaucucugcuucucagaaauggcucuuuccaauccucccuuccaaucucuacuccacaauucuaguggcccagucucaagcuuccccuccagugcucucauaccuucucaaagcugcaauucuaguccugaagaucuaggcaggggaaacugguacucacacauuacaucaaggaaagaccucagagguacacacaccaguggagauaccauagguucaguuccagaucaccucaauaaagugagucacacgaauuuuuugguuucacaguguauauaaaaguuacauuuacacugaacuguaaucuauuagaugugcaauugcauuauggaaaaaaaaguacacacuuuauuuuuaaaauacuucauugcuaaaaaaaugcuaaugaucaucugagccuuuggcaaguuguaaucuuuuagcuguggaagugucuugccucaauguugauggcugcugacugaccaggguggugguugcugaagagugagguaguuguggcaauuucuuaaaacaagacaaugaagcuugcugcaucaauuggcucuucucuucaugaaagauuucucuguagcaugcauugcuguuugauugcauuuuacccacaguaaaacuucuuucaaaauuagggucaguccuuuaaaacccugucacugcuuuaccaccuaaguuuaugggauauuccaaauccuuugugguuguuucaacaauguucauagcaucuucaccaggcauagauuccaucucaagaaacuacuuucuuugcugauccauaagaagcaccuccucauccguucaagauuuaucacaagauuguagcaauucaaucaaaucuucugacuccacuucuaauucaaacuguuuuacuguuuccaccacaucugcaguuacuucuuccccugaagucuuaaaacccucaaaggaucaacuucuuccaaacugcuguucauguugguauuuugaccuccucccaugaaucaugaaucacaaaucccaugaaucaguucuuaauggcaucuagaauggugaauccuuuucaggaaauuuucaacuuaauuugacuagauccaucagaggaaucguuaucuauggcagcuauagccuaacaaauguacuucuuaaguaauaagacuagaaagccaaaauuauuccgugauccuugagcaacaggauggauauuguuagcaagcaggaaaacacugaucgccuuguacaucuccaucagagcucuugggugaccaggugcauuaucaaugagcaguaauauuuuggaaggauucuuugcuucugagcaguaggucucaagaaugagccuaaaauauuccacaaucuaugcuaugaacagaugugcuaucaucuaggcuuuguuguuccauuuauagagcacagucagagcauauucagcauaaugcuuaaggggccuaggauuuucagaguggucaaggaccauuggcuucaacuuaaagugaacagcuacauuagccccuaacaacaaagucagacuguccuucaaaacuuugaagccaugcacugaccucuccucuguagcuagagaacuccuagaugguaucuucuuccuauauaaagcuguuucgucuagcuuaaaaaucugcuguguaguguaggcgccuuugucaauuaucuuagcuggaucuucuagguaacuugcugcagcuucuacaucagcacuugcugcuucacuuuguacuuacauguuaugaaagugguuucuuuccuuaagccucaugaacucagcucugcuagcuucaaacuuuucuucugaagcuuccucaccuuucucaaccuucauagaauugaaggaagucaggcccuugcucuacauuaagcuuuggcuuaagagaauuuuguggcuuaaucuucuguccaaccacuaaaacuuucuccauaacagcaauaaggcuauuucacuuucucaucauccauuuauucacuggaguagcauuuuucacuucauucaaauacuuuugcuuugcauucacaaccuggcuaacuguucagcacaagaggccuaccuuucagccuaucuaggcuuucaacacgcccuccucacuaagcugaauaauuucuagcuuuugauuuaaagugagagacaugcaacucuuccuuuuacuugcacacuugccauuguaggguuauuaauuggccgaauuucaauauuguugugucucagggaauagguaagcccaaggggagggagagagauggaggaacugcaggucgguggaggugaagucaagucagaaccuagcacuuacugauuaggucgggcauguuauaugagugugggucauggugccucaaaacaguuacaauggugacaucaaaaaucacugauuaugauaaucauagcagauauaauaacaaaaaaguuugaaauauugugaaaauuaccaauguaacacagagacaugaagugagcacaugguguugaaaaaauggucccaacggacuuccuugacacagagcuggcacaaaccuucaacuuguuaaaaaaaaaaaaaaaagaaaacacaguaucugcaaagugcaaugagaugaaacacaauuuuuuaaaaaaguguucuuguauacaacuaacuggaaaauaagacaguguaaaacucacaugaaaagcucugcaaguaguccgggcacuguggcucacaccuguaaucccagcacuuugggaggccaaggcgggcagaucacaaggucaguagaucgagaccacccuggccaacauggugaaacccugucucuacuaaaaauacaaaaauuagcugggugugguggugcgugccuguuaucccagcuucucaggaggcugaggcaagagaaucgcuugaacccaggaagcggagauugcagugagcagagaucaugccagugguacuccagccugcugacagagcgagacuccaucucaaaaaaaaaagcucugcagguaauauagucugaaauauuuaucagaggaauguccaaagccauacaguuaagcguucacugcaaaguagggauuccuuuuugggagccacuuaccaugcuccacaaaucaaucucacaauagucucaguguaacuacacuaaguauaguucuacuuccuuaguggaacuguaggaaguuauagccaaaaacuauuccagguuauuugccauuucaaucauuggaaguagcuauagagacauguacuugagaacuucaucauuuacaguugaaugauuuucuagaccuuccaaauacuggauuuuaccccuuucaugacccuuugcucccuauauaaacuuucaucaaugccagaauauugaaugaaaucacccugaaaucagccaucauaucaaagauggcuacaagauacaucucaaaccuucagaaaauggucugugcuaaugagaaggccgaagugucaaccgcaauaugucuguauagguaccucaaaugugacaacaacuaacaaaaaaaacacucugguacaaauaaacuaguacuggaugcagcuaauaaagcacaugauacuauaauguuaaauacauacacuaauagaauuuucuacaauucucuguuacgagguccuuuguaaaucacaggagaguaagugguuuuaagauuaaauuugcccauauaguuaauugccacuucacagcaaguacugugaauaaaaaauccaaauugagcugguuuggaccuaguuacaaauaccauuuaaacagaacagaaaaaaagccucuauguugacagggauaacaccaaaguggaacacaggccucauacaaccaucuagaaucucucaguuucaccuucgcuucagacauacugaggauuuuucauuugaguuuuucuuuccagagcauguaucacaaacuucaaagauaaauuaguaaaaauacacacacauaauagcauagguugauuuuauguuuuuuaagaugaagguuuuaagguuaucucauucaauccccuucauuuuaaaaaugagaaaauaaagcuccaaaaagguaauucacacauggcuacaugauauaucagagacaauaauuucucuguuaauuacuuauaccucuguucaauacaguaauccaaauuuucaaaugcaauaaguuauuuuacaagccuaucaaaggaacuugcuacuuuaaagacaacuggaguacuacgaccacugucuuaagagaaggaaaacugagugggcugguuaaggaugcagaggaggauaaaaucacagucacucuuugacccaaaaucaacuuaauuuccagaaugccuaguaagcuugaagcagcuuggugcagcuaagcacaaagagcucaaacauuuaucaagucuccucugaagaguucuaaauauggggacauccuagugugcugcuuuacauuucuucccaguccagacugcacagaacagaacucuccucaaaauaucccagaaggacuucagaauccauuuuuucaaauguuuugacacaacacugaaaaggugcaauuauuaaaauaucggaaacuauuauauuaauucaaauauguucagcuaccacucauucuucuuccuauuuuuaaauguggggaucacuaaguaucuuuaaacuuaguguauuuucaauuuuuuuucucuacagccacagugaaagggguggaaaguuaaaaaagaaggaauuugauuuuuuaucuauuagaaggaaggaaaaguuuagguggcauuauuauaugugaaaacugaacuguaaagcauacaguaugugcaucuucacaggguauauaauuucaaaaggugaaaaauguuuaaauagauuuuaaaauuauuucucugcaaauaucacaaaauauuaaaaguauaggcuugcuaugaaaguaucuuuaaauguuguguuucuauuuuuaaaaaaucacuuugucacuugagagaaauaagguuguuacuuuuuuucuauuuuccccauucucauauccuucauguuuuucuucauuaauuacauuguccuuuuucugaggguuuaaaauauugugcauauucauguauccgcugauacauauauuuauggucuagcucagcuaaugcauuggugaauauguucacauagauguauauguauaugcacacacaugcacauaacaagaaagauggcacaguggcuaaggcucuuucuagaguaagacugcuugguucaaauucugcuuccaccacuuacaagcuuggacaaguuucuuaaccucucagugccauaauuuucuuaucuauaaaauggggauaauaacaguaagugccucuagggguacaaauaggacuaaauaaagauuuaauauuuauagugauuauaacagcgucuagcauuguuaagugccugcaaauaaguguugaauuuuuuuaaauuauuuuuuacuuuucuucauucuccuucucuucauuuuccucaucgcuucuacugcuacaucuuuaucaaguauuuaaccaucaaauccagccauacagacaaaauuuauauacuuccuacacucagaaaauaaacaacaggacacuguuaacccugaugauaaugaauauaccuaaaacaaagaaguaagagagcaaaaaugauaagcaagaacagaaacuauauggcauaaugcaguggucuucaaauuggaguagauaugccccucuaauuacaguaggaaggucugucccuuccuacuguccuucagcauaauaucuauuggagacauuacauuauucagugauacaugaaauacuuuagacuuacguuuuucuuguaacaguuauauauuaaucaagaugcagguuuauagucuaauguugagccuuagaagauuuuucuaagaaacagcuaggcauauaaauauauuuaaggaaaucaauugcuagaucuaaacguccauaaaaauuuuuccuaaaaaugaccuaugugagaaagugccucucaaguaugauauccuuucccaucucucuucucacaauuauccuucucuagauuuauagggaaaaaaaagucgugcucuuacacauccccaagaacacugcaggacauuguuuugggcagacaaacuguggggagccaaaaaaaaaugaaaucucauauauuuuuccacuacaggugcucucagcuuaagugaggaccagcuccccaagucagaaaacaucuuaccaucuuuacuccuuccuagcaauuuauucccccuuuccuagaagaaugaaaaaaaaauagacacaaacauacauacauacauacauacauacauaaguuuaaacugguuuggccuucaaaggaacaaaaucauacaagaucaugaugaauaauaaagaaguauaaaugugaagacugagaauaacgaaacuuuaaaggacuaauggagaauuagaauucaagcacguucucuaagacaugggcauucucaaauauauucuaacguucuagguuucagauuacaugaucccuuuuauggagugcuaaaagggcggagauugggaaaugggauuaauuaaagaacagggaagaggaggagccaagauggccgaauaggaacagcuccggucuacagcucccagcgugagugacgcagaagacgggugauuucugcauuuccaucugagguaccggguucaucucacuagggagugccagacagugggcgcaggccagugggugcgcgcaccgugcgugagccgaagcagggcgaggcauugccucaccugggaagcgcaaggggucagggaguucccuuuccuagucaaagaaaggggugauggacgcaccuggaaaaucgggucacucccacccgaauauugcgcuuuucagaccggcuuaagaaacggcgcaccacgagacuguaucccacaccuggcucggaggguccuacgcccacggaaucucgcugauugcuagcacagcagucugagaucaaacugcaaggcggcagcaaggcugggggaggggcgcccgccauugcccaggcuugcuuagguaaacaaagcagccuggaagcucaaacuggguggagcccgccacagcucaaggaggccugccugccucuguaggcuccaccucugggggcagggcacagacaaacaaaaagacagcaguaaccucugcagacuuaaaugucccugucugacagcuuugaagagagcagugguucucccagcacacagcuggagaucugagaacaggcagacugccuccucaagugggucccugaccccugacccccgagcagccuaacugggaggcagcccccagcaggggcacacugacaccucacacggcaggguauuccaacagaccugcagcugaggguccugucuguuagaagaaaaacuaacaaacagaaaggacauccacaccgaaaacccaucuguacaucaccaucaucaaagaccaaaaguagauaaaaccacaaagauggagaaaaaacagaacagaaaaacuggaaacucuaaaacacagagcgccucuccuccuccaaaggaacgcaguuccucaccagcaacggaacaaaacuggauggagaaugauuucgaugagcuaagagaggaacgcuucagacgaucaaauuacucugagcuacgggaggacauucaaagcaaaggcaaagaaguugaaaacuuugaaaaaaauuuagaagaauguauaacuagaauaaccaauacagagaaaugcuuaaaggagcugauggagcugaaaaccaaggcucgagaacuacgugaagaaugcagaagccucaggagccgaugcgaucaacuggaagaaaggguaucagcaauggaagaugaaacgaaugaaaugaagcgagaagggaaguuuagagaaaaaagaauaaaaagaaaugagcaaagccuccaagaaauaugggacuaugugaaaagaccaaaucuacgucugauugguguaccugaaagugaugcggagaauggaaccaaguuggaaaacacucugcaggauauuauccaggagaacuuccccaaucuagcaaggcaggccgacguucagauucaggaaauacagagaacgccacaaagauacuccucgagaagagcaacuccaagacacauaauugucagauucaccaaaguugaaaugaaggaaaaaauguuaagggcagccagagagaaaggucggauuacccucaaagggaagcccaucagacuaacagcggaucucucgacagaaacccuacaagccagaagagagugggggccaauauucaacauucuuaaagaaaagaauuuucaacucagaauuucauauccagccaaacuaagcuucauaagugaaggagaaauaaaauacuuuacagacaagcaaaugcugagagauuuugucaccaccaggccugcccuaaaagagcuccugaaggaagcgcuaaacauggaaaggaacaaccgguaccagccgcugcaaaaucaugccaaaauguaaagaccaucgagacuaggaagaaacugcaucaacuaaggaacgaaaucaccagcuaacaucauaaugacaggaucaaauucacacauaacaauauuaacuuuaaauguaaauggacuaaauucuccaauuaaaagacacagacuggcaaguuggauaaagagucaagacccaucagugugcugcauucaggaaacccaucucacgugcagagacacacauaggcucaaaauaaaaggauggaagaagaucuaccaagcaaauggaaaacaaaaaaaggcagggguugcaauccuagucucugauaaaacagacuuuaaaccaacaaagaucaaaagagacaaagaaggccauuacauaaugguaaagggaucaauucaacaagaagagcuaacuauccuaaauauauaugcacccaauacaggagcacccagauucauaaagcaagucgugagugaccuacaaagagacuuagacucccacacauuaauaaugggagacuuuaacaccccacugucaacauuagacagaugaacgagacagaaagucaacaaggauacccaggaauugaacucagcucugcaccaagcggaccuaauagacaucuacagaacucuccaccccaaaucaacagaauauacauuuuuuucagcaccacaccacaccuauuccaaaauugaccacauaguuggaaguaaagcucuccucagcaaauguaaaagaacagaaauuauaacaaacuaucucucagaccacagugcaaucaaacuagaacucaggauuaagaaccucacuaaaagccgcucaacuacauggaaacugaacaaccugcuccugaaugacuacuggguacauaacgaaaugaaggcagaaauaaagauguucuuugaaaccaacgagaacaaagacacaacauaccagaaucucugggacacauucaaagcaguguguagagggaaauuuauagcacuaaaugcccacaagagaaagcaggaaagauccaaaauugacacccuaacaucacaauuaaaagaacuagaaaagcaagagcaaacacauucaaaagcuagcagaaggcaagaaauaacuaaaaucagagcagaacucaaggaaauagagacacaaaaaacccuucaaaaaaucaaugaauccaggagcugguuuuuugaaaggaucaacaaaauugauagaccgcuagcaagacuaauaaagaaaaaaagagagaagaaucaaauagacacaauaaaaaaugauaaaggggauaucaccaccgaucccacagaaauacaaacuaccaucagagaauacuacagacaccucuacgcaaauaaacuagaaaaucuagaagaaauggauacauuccucgacacauacacucucccaagacuaaaccaggaagaaguugaaucucugaauagaccaauaacaggagcuaaaauuguggcaauaaucaauaguuuaccaaccaaaaagaguccaggaccagauggauucacagccgaauucuaccagagguacaaggaggaacugguaccauuccuucugaaacuaucccaaucaauagaaaaagagggaauccucccuaacucauuuuaugaggccagcaucauucugauaccaaagccgggcagagacacaacaaaaaaagagaauuuuagaccaauauccuugaugaacauugaugcaaaaauccucaauaaaauacuggcaaaccgaauucagcagcacaucaaaaagcuuauccaccaugaucaagugggcuucaucccugggaugcaaggcugguucaauauacgcaaaucaauaaauguaauccagcauauaaacagagccaaagacaaaaaccacaugauuaucucaauagaugcagaaaaagccuuugacaaaauucaacaacccuucaugcuaaaaacucucaauaaauuagguauugaugggacguauuucaaaauaauaagagcuaucuaugacaaacccacagccaauaucauacugaaugggcaaaaacuggaagcauucccuuugaaaacuggcacaacacagggaugcccucucucaccacuccuauucaacauaguguuggaaguucuggccagggcaaucaggcaggagaaggaaauaaaggguauucaauuaggaaaagaggaagucaaauugucccuguuugcagacgacaugauuguuuaucuagaaaaccccaucgucucagcccaaaaucuccuuaagcugauaagcaacuucagcaaagucucaggauacaaaaucaauguacaagaaucacaagcauuccuauacaccaacaacagacaaacagagagccaaaucaugagugaacucccauucacaauugcuucaaagagaauaaaauaccuaggaauccaacuuacaagggaugugaagcaccucuucaaggagaacuacaaaccacugcucaaggaaauaaaggaggauacaaacaaauggaagaacauuccaugcucauggguaggaagaaucaauauugugaaaauggccauacugcccaagguaauuuacagauucaaugccacccccaucaagcuaccaaugacuuucuucacagaauuggaaaaaacuacuuuaaaguucauauggaaccaaaaaagagcccgcaucgccaggucaauccuaagccaaaagaacaaagcuggaggcaucacacuacaugacuucaaacuauacuacaaggcuacaguaaccaaaacagcaugguacugguaccaaaacagagauauagaucaauggaacagaacagagcccucaaauaacgccgcauaccuacaacuaucugaucuuugacaaaccugacaaaaacaagcaauggggaaaggauucccuauuuaauaaacggugcugggaaaacuggcuagccauauguagaaagcugaaacuggaucccuuccuuacaccuuauacaaaaaucaauucaagauggauuaaagauuuaaacguuagaccuaaaaccauaaaaacccuagaagaaaaccuaggcauuaccauucaggacauaggcgugggcaaggacuucauguccaaaacaccaaaagcaauggcaaccaaagccaaaauugacaaaugggaucuaauuaaacuaaagagcuucugcacagcaaaagaaacuaccaucagacugaacaggcaaccuacaacaugggagaaaauuuucacaaccuacucaucugacaaagggcuaauauccagaaucuacaaugaacucaaacaaauuuacaagaaaaaaacaaacaaccccaucaaaaagugggcgagggacaugaacaggcacuucucaaaagaagacauuuaugcagccaaaaaacacaugaaaaaaugcucaucaucacuggccaucagagaaaugcaaaucaaaaccaccaugagauaucaucucacaccaguuagaauggcgaucauuaaaaagucaggaaacaacaggugcuggagaggauguggagaaauaggaacacuuuuacacuguuggugggacuguaaacuaguucaaccauuguggaagucaguguggcgauuucucagggaucuagaacuagaaauaccauuugacccagccaucccauuacuggguauauacccccaaaugacuauaaaucaugcugcuauaaagacacaugcacacguauguuuauugcggcauuauucacaauagcaaagacuuggaaccaacccaaauguccaagaaugauagacuagauuaagaaaauguggcacauauacaccauggaauacuaugcagccauaaaaaaugaugaguucauguccuuuguagggacauggaugaaauuggaaaccaucauucucaguaaacuaucgcaagaacaaaaaaccaaacacugcauauucucacucauaggugggaauugaacaaugagaucacauggacacaggaaggggaauaucacacucuggggacugugguggggaggggggaggggggagggauagcauugggagauauaccuaaugcuagaugacgaguuagggggugcagcgcaccagcauggcacauguauacauauguaacuaaccugcacaaugugcacauguacccuaaaacuuaaaguauaauuaaaaaaaaaaaaaaagaacagggaagaacaagagaauaaaggaaaaaagcagagagaaggcaaggcaaaaugauuuauuaggaaaggaagaaacccuuucaaacaaagaaauccuacguuuucucucgauauaucacuagaagcauaugcaagaaaucaauauauacuuuuuuaaaagaaaggauuaaguagaagauaagagaagauacacaggucauagggaauaaaaaauuaauagugccuuuccacacagacuugaaacaauucuggucacugaagggcaguaaggcuggggaagguaucucccuuccuacuguccuucaguguaguaucuauuggagacauuacauuauucagugauacaugaaauacuuuagacuuauguuuuucuaguaacaguuacauauuaaucaagaugcagguuuauagucuaauuuugagccuuacuuuaguuuuuaucagcaacaaucuuguauaaucuaccaugacuauacauaugcaucagguuuaguaaagcaauuuaugauacagucuccauaugugaaauugaaagccagaagcuaacuauuauuuuaacaagcugucaagauauauagaguuuugccaaagaaacauugauuacacuggucuuuugaaaaguagauaaaacuuagaauucccuaagcaaaccauaguuacacaaaauuguccugagauuccuaugaagcacaugacucaaaugcuaccaaaauccuucauaaguaagauuuauuuccaauaaauuauauaucucuguuuuagaacucugauaauuugcagcccauuuuccaguaacauguuuuuaucauuuucuacugcugaauaaaaaagaaauuaaaggacaaagagaagaucaugagugaacuauccaaauuuuauuacaaucuugaaaaauacacauccguugacuuccuguuccucugccacuaaaucucuguggggagguccaacuuccaauucucugaagucgcaagguagaggaaauaaaacuaaggagcagguugcuauagcucuccaauucaaaagcaaauuauuacucuauuuaauacagcaaucuacuauaaucuccuccaacacuccugauccucuuuacaguacucuuuucuauaguacuuaucuccuaacaaaaaaauguacauauuuacuauaccuauuaugucacuuguugcuagaaaguaagcuucaaaagggcagggaucuacaucauuuuguucacuggccaaucucaaauaccuagaacagugucugacacauaguaggagcucuacugaauaaauaaacuauuacuuuaccaguaucaaacuccccaccugagguagcacuaccuaaacuacauguuguuccgauucuaauugcaugugauuuuucuaaucuucgugucauuaucauagauaaguguccauugcuacaacuggaaguaaucugugcacacugcagccuucauugaaacccagauaauacuucuguucguagcugaccucauuuuuauggcaucccacuguauagcuugcuucuucacucuuauuuaggcagugucuucgcaguuuccugccuugaauaccucuuguauacauuuaccaccuuaauuauuugcuguguacauuuuccuugaugccuucuccccacuaugacagcagauucccucuucugauuuuccacugaucagcacggcccuucaaaaaccuucacaaaagcccguuagaaacagauugagagacgcauuugugaagcuauuuaacaaauuuaagugucauuuuuaaaguauucauuguaaauuggagcauuguuucauaucgguaucauuggagcauuguuugauaucgguaacuugcuuuaaacugauuaagcacauguaaagauacaugcuaccaauagaagaggaugaaaccgagagaucaucuuuaugguuaauagggagucagugacaggaaaguaaaaagacugaaggaugauuuugggaaguccagguaauugucugguuaucccucaccaaugucuugauccaacccaagaaucacucuaacacggcaaaacucaauccuuccuguuauuuuauuuguggcaagagaaagaucccuaaaauaaaaugcauuuauaaaaugauugccuuauaauaagcacucaauaaauauuugcugaauaaguuaauggaucaaugaguauuucccuaugguuugggaaguuuagccaaauuaaauaccagacuuucaaauguaaaggguuacgucucaaaaauauaccucacccagcugauacacauaacacuuaaauaacuguaucugcaugcucaguaagaacuucaugcauucauauauuuaauacaucaucaaagcauugugagacaacuuucuaacagugaauugaaaccauauaaaaaacuuuggacuuuuugaggguuuuugguuuuuguuuuuuauuagagauggggucuugcuuugucagcuaggcuggagugcagugaugcgaucgcaacuaacugaagccucaacuugaaggucucaaguaauccuccaucucugccuccagaauagcugggaccacaggugcaggccaccacacguggcucaucaagugacaacuuauucucagucaaaauucauggguaaaaauaaaguuaaaauuuuuuauuuuaauuuugaaaaaguauauauuuugugaucauagcuuugauucugcucuccaucaaauacauuuaauuuuccauuucuccauauuuaagcgauuaaccccauuaaaaaaugggaaacuauucauucucaacucacuaaaggaaguauaaaaggaauuaaauacaaagacccacucaaauauagcuaauuucauuaauauuuccuguguaucauuucaaaaaaaauuacuaaaaaauauuccuaagauucuucuuauaauuuuuauaguuucauuauuaagaauuauugagauaauuuauuuuaauuagaugggcuuuuauaaaguauauaaucaauaaguguuuguagaucccuuaguuuuaaagcuuuuuuuuaaguuucucuuuacccaaaaauauaaucuggauuaaauucaauuuacugacccaaagauauaaaugagaaauucaaaaccauuaacacucuaacacagcuagauggaaugaugaaugauuaagggagaaaccauaagaaaacaucagguaaucaucuuucuagcauggucugaaugaaauccuucccaugaaauuaaaauuugauacaaagucuaucaggaaaacuucuaaacuuuaagauuugucaggaaaauugugaaacacugaaauaugcaaaauauuaguggauguccuaucuaguauacccuuccagauuaucugagucagucagaauaugagccucacauugucuuucugcuacuuuacaaccaugcaguuguaagacacagaauaauacaaacaauucuuuuccauaaaaaugcaaauaaauuguguccagugaaaugaaauggauaauuggccuguggcuauuaaccaguuuugcgucuguuucacauucauuucagcauccuugauugcccauauaugugugcucuuaaaauucuccuuugaauuauuuguaacaucuuacugauccccucauuaauuaaugagcuuaauaaagucuuugauacccauucuuuuuacauuugaauaaaagacaugauuuuaaccuuucuuuaaaaguaucccuugacagaaucuaucacuaaaaguaugacuuuugauccaccuuccauaaacaggcuuucuuaaaauuuccauuaagucauaagucaucccauucaaauuacucaaaauaaaauacugcagcaucaauauuuugaauccaaauaugaaugaauccaaagcaccaucauuauaugauauaaguuuacuauuuauauaucccuagaagcaaaaaggcugccaauuaaacuaagacauaaugcuuuuuuaucaauuagauuucauuuuuuggauaucuguaucauauauuccacuguucugccccaugccucucauguagauagaugaguauauauuacuuauccuucuaagccuaaaucauaggauuugggaaucaucagaauaccugaagugcauauaacucaauuaaacuuugacauuaugaccacauucacacaugcacagauaacaacuccaucaaaaccaccaccuacccaacauggauuuugaguccaucaauucaaagaagcaucccaguuucagguauguucaaauaugaaaaaauagacaucuuagaaugcauaaaacaccacaaauauaagugcaaaaacauauagcaggauuauaaauggcaaauagcuuacaaucagaaaaccugucacuagagggucaucauuuccuuaaauaguaacacuagaauaauccacacagacugcuagaaauuuaugaaucuuaaaacugauagucaaaaucucaaugaagccaaauaacucuuuagggcaagaaaaggugagauccuugacugaacuaagguuauucaaucucuuguuuacuaaaacagugguaggggugguuuggucucuagcagaagggcaaacaagaugguaucacauaauggagcuggcuuaaagcaaaauaauaaaaaugaaaaaacacucauuccucuacuucuaagaaaauuauauucuuccuuuuugauguacugcugacauuccuuuccucucuucaauccuagauuaguuaacagcuuguaaaacugcuguuauuauaaugacaaucucaaucaacuacaucauaaggcuuuuugccuaaaggaucaucucuccaaguuguaaucucuuugaagacuaaggagacaaaagucucucuugaacacuaaggucuuuuccaaauuaaaaacaaaauauucuaaauauuuaugaacgauaucaaucagacuuccugcuaaauauuacuucuuaguuuuuagccuuuuguaauauguuauaaaaguuuccauugucuuuguauuguugaaggcuacaauauugccuagcacauaguaacagcaaauaaauguugguaaacuagaaacugacucucacaguggccuugauucucacaguuaaccuagaaguaaguaccgcaacaauguuuauucccauuucauauauaaagaaacugaagguuggagaauuuaggguuuugcucuaaaaucacaguuaauaaguggcauugucaaaacugaaucccaggcccuuugucuccaagaccagagcaauucuuacaguaacagacugaacaucccaugccuagauuuccuucccucucucuucucuuaccuacuacaugauacuugacucaggauucugguuugcugaauuacugaaaccacaucaacagugagucaaugguaauucucuaccugguuacauuuacauuuuagcacagauauuguaagauaaggugcagcagagauuauuggaaauacacauauugacagucagauagcucacuucuaguggaacuagaauauuuaauuuuccugugucucaaguccuuuaucugcaaaagcaggugaaaugcagaugaucaauaaggucuuuuccuaacuaaaaaccuaacauucuaaauauuuaucaauuauacaaaaucagaucaccugcuacauuuuacuuaauacuggccuugaaaaaaaaaagaaaacuauaaaaaccugucuguuagauucugcagugggccaaaaacagaauauauaaacaaaaauuuaaauauauuccaaccauacuacuugacuaaggacacugucuguaccaauuuaaaacuagaagguuuuaaggauaaaugagaucuauacaggcacaauugucacagcaguccuucuagguauacaagauacugaaacauuuuacugaccuauaacuuacuuuuucauacauggcaaaacuauauuuuucucauuacaaaugcccuagcucuccccacaaaguuauugugaagucuccaaauauugcuaauuugucccuuaaagcaaaaauauaaaacacuuugugacauaugaaaaauguucaccauguccuuuaguugcuucaagauauagcauauaaaucuuugaguuucuaaacagaaccauacuaucuagauauuuuugucuaaaagauuuaaagcuuaaaugugcuaccuuuuuuucucucuugcagcuuucaagucacuuagccugcuccagucuccaagauauacauuauuuuuccaauaaaucaauaaauaaaauugguauuuuugacuacuucuuaguauaaaucuugucuuuguaucaacaaauguucgagugcauuuucauuguaugacuaaauuucuauuaaaaauguaaauaauuucugcuuacucuaucgagucuuuaauuaaaagugguuuuuaaagagucaaaagacuuugaucaauuuuuauagaaugcaccagggcacggugguucacgccuguaaucccagcacucugggaggcugaggcaggugggucacuggaggucaggaguuugugacuagccugggcaacauggugaaaccccaucuccaccaaaaaauacaauuuagcugggcgugauggcgugcgccuguacuccccagcuacucaggaggcugaggcaggagaaucacuugaacuugggaggcagagguugcagugagccaagaucaugccacugcacuccagcuugggcaucagaacaagacaccaucucaagaaaaaaaaaaacuuauggaaugcuaucauucugucaaaaauaaacauaauaugcuuucuguuuuaacaaaugaauaacuuaccauuguaccacccuaaguuaccaggaaaacuacccuaaauuaccaauaaaauuguuccuccuaucuuucuccucugccucugcucuacuucccuucaaaaaguucuuuacuccacaauuuccccaaacagaaaauuuuccugauucuccuaucccucuguucuuucugucacucucuucaagauccuuuuccucuucuaucccaccagcaucccccuuugauucucugccuauauucuccuucaucuugauucacuccuucacagcucaucugcuuccacaagaucaacuaacauuuccauacugaugaauccccaaagaacauuuuuagccuuuauuuuuaaccagucucugauucuguauuuccaguuuccuucaggauaugucuccuugaaugacuggauacacuauuagaauucaaaacuucuaguuucucuacauccuccuaaucuccuuguauauaaacucaauacuuggggacauauaauuauccuauguaauccuaacaaucuaaaaucuucaccauuugcuaguccuuacacccagaaugaacuauguuaucugcuuuaugucaccacaggaugcuaaaauguuauugaaaauagccacuaaaaaauguagcaaauguuucuaauacaaacugaugaguucacaauauucuaugaguaaauauaauagaguucccucuauuuuccuacuagacaucuguuucugauuuuucaauauuacaaagaaaacuguuaucuuaucauuauacauauuuucauauuuaauaauaucuccuuaguguagcaguccagaagugaaauuaauggggaaaaaagauaaaagaauuguuaagguucuugauaaauacugacaagcuuauuuccaaaacaauauuaucacaacguuagcuccaugagugcaggaaucuugucccuugugcauaugauaggcacuaguaauacaacaaugauaaacaguaagcauucaauaaauuuuauuuaaauaaacuaaucaaucaaccaaucagaucuaugaaaguacuuacaaaugauaaacaaacauuccuuuauaucuuuauuauaucauuauacuauauuuacuuacucccccuuuaagaguaaacaugucacugcuuugagcaaugaaauacaagcaaaagugguaugugauacuucuagucaaaaguuucaagugccauuuaucauguccuuucccucugucacagcaaccuaaaugacaggcaaaaguuucuguuacuauuauauaucaucgauaauuucuuauaguaaaauauagcuuuucccuuaaaacauauccuuuuuacugaucagaaauucaccgggaacucccucuucagugcagggggauccuaugguaggaggauuacaagugugcacugucauuccuaagaaagaauauggagcaauaaaggaaauugcuaaagucuggaaagcauucuuggcuuucugcuuugaaaugaagcugacuuggaaaaucagagaauuugaauaaaguuaucuuagauuucaaugaaagaaaaaugcuucauggaguagcucuuuguauuacugcaccucuagaggccccagaagacaacuaaaaaccaggcaauaugcuuuauuuugaaauucagcugugugggcugagaugucaccuuagcaugagggucaaaggaguacagggagagaggguagccagagccucagucacaaauuguaacucacacuuaaacucauuugaaaugcaauaaacaaacuaaacagaauaagcacacaacuacuugggcacucgaauugaguuuuuuaagaaauuuuaacuguuauuaucuaaaugcuauuagauaaggaauauuucuuucacaaauacagcugaacacauugauguuuaagaguuuuagugcaaauuccaagaacuaaaagaaaauagaggaagacaaauuagaaaugagaagcuaacuuaaugccaacaaauuaaccuuucagaaaguuagaaagaaagaacaaaagagucaggcuauuuuauuauuguuuuguuuauacuucauaagcaaagguauucgugggagauuuuuuaauaaauguuuuccuugucuuuuuuuuuaagugguuaaagaagaaaaguuaacuaggagaagauaggaaugacagcaguuauuugcaaauuuuuccacaaggaaaauccuaucaaaauccuucuuugauauuauuuguccuuauaauuuguucccacaauugccaaaaaaaaagauuacagucagguugcaugauuaucuaaagcccaacaugauguucuauguuuuuaucacaauucaagauuacugcauuuuuccuaccauaauauuaauuaauggucaauauaaaaauauggacuauauugaaccccaggcaaaaggaaaaaauacacccacaaaacuguaagacuaugacacuaguaaaucauuauucagcauuuuaguauaguuccuucucauauuuuuccaagccauguuuuugcuugcuuauuugauucuauauacaugcuuaaccaucuuauucauuuauuuauuuaacagcauaaucuuuuuccauguuaccauaaacucuucacaggcuucacuuuagguaugguauuccaucaaguguacauuccacaauuuauauuuugacuuagugcuggauaguugcuuucaauuuuuguaccauuacaaauaauucuguuaggaacuuauuaaacauaagccuuuccaauauuucaaauucuuuuccuaaaauacguuccucacaacugaauuacuauauaucaaaaacaauaaucaaaauuaaaagccaauaugguaucugggauuugguacaaaauaauacagauuggggaagcagaugggaguuccaagugaagcacauuuaauuuuuuucaaaauaaaacauucaaacaaaaaauuaaaagcaaaaaaaaucauccugaaauacacacacacauacacgcacacgcacaggaacacacauucuagcaaagaugaaaguauuuuuauggcucuugcuacacauugccaaguugcuucccuaaagaguuguaaucauuuuuauucccaauauauagcuuaagguuuauagugaaggcuuuuuuaacuccucuuuucuuugaagucuuuguuuguacauugacuuuggcaugucucugcaaccuacugcaaauuuuuccuauugagauauguuccugaguuuucacuuuauucuggagacuggaaaucgcucuuaugaugcucuuugcucaucaugcaaacuugauuccauguagaauaauaguuggauaacaguacaaugauuuaccuacaggaauguuuuucauauuguuuacaaggcaaaaauacauuuaacauaauguuuaguaaaaacuggaaacaacuguuucuguaucacuugcaacgucacagcauuccuucaaaauguauuuacugucauggaaaaaaauaauuugccacuauaauguugaguuuuuaaaaguaggcuauaagauuguuuguaugaacaauuccauuuuauauagaucauacacacacacgugcacaaacacagagauaaaaaaaaccuggauguguauguacuauaguaucuucuuggggaguugauaagugauuuuuacaaacaucuuuauacuuauuuauauauuuuuauuuuaauaauaaauauucuaaauguauaauuuuuaaaucaucaaccaaaguaagacucaaaguauaaccaguaauuguuugagcaacuuauuauguacacaugucaauuuccagcuugcuuacauaaauagucucccaauuggauacaucuuagugaauuuauaaucauuaaacaaaguaaugaauaacaugaucaucaccugaauaagauuauuuuucuucuaaauuuucaaaacacagcuuugugcccaaugguuuuccaaaacugccucauauuaacaagaaaauuuugguucaaaguagagauuaggaaauuaaugaaccaaugaaacacaguuaauuacauccagaaauuaaugaucaggauauuaaaacuuggaaaauauagaaauaaugguuuuccuuuauuaaaaauuuuuuuugaauuauugugaauacauaauaguuguauuuaugagguacgggugacaauacaagcauacaaugugcaaucaucaaaucaggguaacugggauauccaucaucucaaacauuuaucauuucuuugugugauagagcuuuucuuaacuagaaguucaacgauaaaaugugcuuacagaccuaacuaaaacccuaucauguccaccucuaagaauucuaauacaguucgucuauagggcccuagcucugccccugccauuaaguuugugugaccgauggcaaggucugcaucuccaaaaucaguauuuuacaucaguugauuucuaaggucuucguggcucuguggcuauauauacacuuaaaaagaaacugaaaacaaaucugaucaauaaagaacuuuuucaugacauaugguauguuauucugcaggguugccauaacauaauaccaaacacgagguggcuuacaacaacauaaagguauucucacaguuccggaggccagaaaucugaaauugaggugccaggaaggcuaugucccucugaaggcaguaaggaaggaucuguuccaugccuuucuccuaguuucuggcagccucagguguuccuugacuugcacauggccaucuucugccuauaucucuucacaucaucuuccgugugugugugugugugugugucccaauuuccccuguuuauaaagauaccauucauauuggauuaggacccauacaaaugacaccucauuuuaacuugauuacuucuguaaagacccagaucuucaacuuuucugggggggauccaacucaacccauaacaugugacaugcugguuaaucucuguugcccucuaaauccauucccugcuccuuucugcuccacaucccagaggcuaaccucugugaacugcaucauccaugcuucuuuaauuucuagcuucaaguuggcaaaugggaggcaccuguucaagaucacaagacaacagaagagagaagggaggguauuuguugccacuccauacccccaccaggccacuuuuuugguagcaacuacauucagcuauccacaguccuauuucccuguccacuagccccgcucccauaauucuagcucucaccagaauggguaauuccauucccaccucuuuuuccuucugccaucaggcuaugaugacaucccacuguugcuagucccugggcacuucacuauuguucaaugguugcauucugcacuaccacccaucccucuauaaugaaguccauucauuaaacucucuucauuguccccauugaauguaccgucuguuucucaccaaggcccuaucugguacacagggauaagucaauucuuuagaguauuuacauaauuuguuuaucaaaauucuaaaaaguaguuuagccucagcauggcugccacaaauugagauuugaaauaauugguaguaaagacaucacuuucugucauauauacauuugcuacuguuuugcuccuuuccuccuucacacuuauaucuuaaucuagaaggauauggcagaggucaggagcauggauugugaaggcagacugcuucacuuugaaucuagccucuaccacguacuagauuacauaaguccaguuaauuuaccucucuguacacuaauaaaaugggcauaaagguaauaauauacaaggccaggauuacagguauagcuuacaccuguaaucccaauacuuugggaagccgaggugggagaaucguuugaagucaggaauucaagaccagccugagaaaaauagcaauuaccuugccucugcaaaauauuuaaaaaugaaaacauuagccaugcaugguaguguugaccugcagucacagcuacuugggaagcuaaggcaggaggauuacuugagcccaggagcugaauauuacagugagcuaugaccaugccacugcacucugccugggcaacacggcaaaaccaugccucauaaguaaauaaauaaguaaaguuuacaagucacaggacagcuaugugaaauauaugccaaauuacuuacauuaauuuuuuaacuauuaaaucaauuaaucuauauaaagugcuuagaacaauaccuggcuuguaguaaguguucuaugagcauuagcugcuauuauuaugauuaauuuuuccucugauguuuuucccuugaccuacacauuaagucacucuagccucaaucauuuuuacacggacccuacccaaccaaucaaauguaugcugggaauauacaaaaaacacagccaacucuuuuuuauuuuauuuuauuuuuucccgaaacggagccuagcuugucacccaggcuggagugcaguggugcgaccucgccucacugcaagcuccgccucccggguucacgccauucucucgccucagccucccaaguagcugggacuacaggcgcccgccaccaggcccggcuaauuuuguucuuguauuuuuaguagagacaagguuucaccguguuagccaggauggucucaaucaucuucugaccuugugauccacccgccuuggccucccaaagugcugggauuacaggugugagccaccgcguccggccaacacagccaacucuuuaaauuuuccuauguaaacuacccauuguccaaaagaucaguaacaccugucacuccugccauaaugggcucucugaccccuauaugguguacauccuaaguccucaaguguuuuauuugcuuacgacguauuuuugauaauucugcucucagucaagauucugauaaaucaucaauccccuaccugggcuauuucagcuauaugucaaacacuacacucccacucacuuccuggggucuauuccggcuuuuaaaagacaguuuucaaaccccuacuucagccaaagaaaugguccuuaauagugauuuuccucccaaaauauguguacuuaguuuuguuuaauuguuuggggauggggagggguaguaguguuugagaccaggugucacuaaaaaaaaaaaaaaaaaaaaaaaauuaaaaauuaaaagaagacauuuaugcagccaaaagacacaugaaaaaaugcucaucaucacuggccaucagagaaaugcaaaucaaaaccacaaugagauaccaucucacaccaguuaaaauggcaaucauuaaaaagucaggaaacaacaggugcuggagaggauguggagaaauaggaacacuuuuacacuguuggugggacuguaaacuaguucaaccauuguggaagucaguguggugauuucucagggaucuagaacuagaaauaccauuugacccagcaaucccauuacuggguauauacccaaaggauuauaaaucaugcugcuauaaagacacaugcacacguauguuuauugcggcacuauucacaauagcaaagacuuggaaccaggccaaauguccaagaaugauagacuggauuaagaaaauguggcacauauacaccauggaauacuaugcagccauaaaaaugaugaggucauguccuuuguagggacauggaugaagcuggaaaccaucauucucagcaaacuaucgcaaggacaaaaaaaccaaacaccacuuguucucacucacagaugggaauugaacaaugagaacacauggacacaggaaggggaacaucacacacuguggccuguugugggguggagggagcggggagggauagcauuaggagauacaccuaauguuaaaugacaaguuaacguuaaaugacaaguuaaugggugcagcacaccaacauggcacauguauacauauguaacuaaccugcacauugugcacauguacccuaaaacuuaaaguauaauaaaaaaaauuaucaaauuuagucgcuuuuuaggaaaggguaaggaguuggggagagaacaugggaaaagaaauccucauugaucuuugcaaauuauaaaccaucuuuuuaaaguaaaaauaaacacacacaaaacuuauuuaaaaaauucccuuacuuggcuuagcagaaauauaccucaguuacgauaacuauaaugaacaaaaagugauuacuguuacuguauaaaauggcccugagauguaguuauguacuauaucuguguauuuauauaaguacauuuaucaauacaucagaaauaacuagaucucaagaaagguucaacuuagaaauaagaguacaguaggccauccauaucuguggguuccacauccauggauucagccaaaagcagaucaaacauauuugggaaaaaacugucuguacuaaacauguacagacauuuuuucccucuuauuauucccuaaaaaauacaguguaacaacuauuuacauagcauuuacauuguauuagguguccuaaguaaucuggagauaauuuaaaguauacaaaaugauguccauagguuauaugcaaauacuacaccauucacaucagggacuugagcaucuuuggauuuugguacaauugagagguccuggaaccaauuccccauggauaugaagggacaacuguacuaaguaugagcuaagaguaguagcaggaaaguucauaaguaaaaaaccagauugaccaaauagcagauuaaaucacugaucagcagaagacccaaguggucaaaagcacagccccugaggcgagaaggcccugguguaaauccucaccccagcaccuacugggugaccuugggcaagucacccaaucucuaugugccucaguuuccucacuguaaaauuacaguucuuaccucacagugcuauuggaaagauuaaaugagguaauauauguaaaguauuuagaacaauuccugacacauaguaagcucuuaaaaacuuuuaguucuaaaauuuccaauucuauauacaguccagaaauauauucaguucuguaaagaugguauucauuuuaaagggaauauuuuguugcaguuuuuggcuucuuuucuccuacuuaugugagucacacugcucauacucacuuaagcauaauacaagucauuuuacagaauaaauguucaaagauggcugguauguauauugaaaacaauaugccaacuccugaguucaugucuagacuuccucgggauuacagagacgguaagguuaauuacccuuuuaacuaugaucauuguuuauuaccuugcuuuaguuuugagaaaaggacaaaacauucugaguauaugcaaaaauauucuaguugacaauauauucauuacuguuuaugaccucuaguauucuuucaaauuaaguaauuaaguauuuaaacaaacacucccgaaguagaagcaaaaaucacuuucucagacuauuuagcacuucuuaaaggucuccaagaaguaguacacuccaauuaauauuuauccucuuccucagagcaucgaugcuuacacugccuaagggaaaccuguugucagcuaaggcaaaugagguuaauaacaggauuuggcuaagaagaaaaauauguugcacuuuagagaacuaacaucucaucucaucucaaauacgcuaggagaauaaagaggccaggaaacaaccaauuguaaaaauauuaguaaauagguaacaauuaaagucauucuuucucaucccaacuagauauacuaauggccauaauuacuuuuuacuuacauuaguauuaccucaggggaucuauuguuuucuuauaaaagucagcugagcuguacagcuuaaccaagauaaucugcuauauuaguuuccaaguauagaaagcauauguguaaauaaaacauacaucccucauuguuaccuggauguuauuaacccuugcuucccaacaacuaaaauauccacacagggauuuacuuacaaaaaaaaagaaauaugcuuauuaaccuaauuauggguaucacauaaauacauuguauuugcccauuuauuauuauuauagcaaggcuguaggggccauacuauccauauuggauggcuaguuucucccaguagccaucaagaagccuaaaauuucaucauuugaaauauuuuuaagucuugacuuuuagaggagagagaacuauaaaagagaaugucuagaguuaaagauagaacagcagucuaggacucauaugcaauauaagaagaaaauggaaucagcagaaguucuaagcaggaaagugauauuauccaaaucauguuggaaauaaaucugcuagcaauguggaaaauguacuagagaaaacauaucauagucaaagaaggagagaucuauguggcaccuggacuuaguaaauggagaaaagaaaaauauucaauagauauuuuucagguagacccaaaaagacucugugucuaacuggauacagaugauaagaaaaaccuagaaguuaaagauggaagugacucuaacuuugacuugugacuaaauaugauggcaauaaucaaaauaguaaccagaagaagaaaaaaaguuugguaugggcuagguuggguuugagaagucugaggaauaucaucauacacauauauccaauggagagcuaaaauuacagguaugaugcuucaaaaagaaaucagguaggcaagaaguuaagagcaguggacaaagggaaaagagaagagggccauuucugagggcucuguucuguuccacugaucuauaucucuguuuugguaccaguaccaugcuguuuugguuacuguagccuuguaguauaguuugaagucagguagcgugaugccuccagcuuuguucuuuugauuuaggauugacuuggcgaugcgggcucuuuuuugguuccauaugaacuuuaaaguaguuuuuuccaauucugugaagaaagucauugguagcuugauggggauggcacugaaucuauaaauuaccuugggcaguauggccauuuucaugauauugauucuuccuacccaugagcauggaauguucuuccauucguuuguauccucuuuuauuucauugagcagugguuuguaguucuccuugaacagguccuucaugucccuuguaaguuggauuccuagguauuuuauucucuuugaagcaauugugaaugggaguucacucaugauuuggcucucuguuugucuguuauuguguauaucuacaacuaucugaucuuugacaaaccugacaaaaacaagcaacggggaaaggauuccuuauuuaauaaauggugcugggaaaacuggcuagccauauguacaaagcugaaacuggaucccugccuuacaucuuauacaaaaauuaauucaacauggauuaaagacuuaaacgucagaccuaaaaccauaaaaacccuagaagaaaaccuaggcaauaccauucaggacauaggcaugggcaaggacuucaugucuaaaacaccaaaagcaauggcaacaaaagccaaaauugacaaaugggaucuaauuaaacuaaagagcuucugcacagcaaaagaaacuaccaucagagucaacaggcaaccuacaaaaugggagaaaauuuucgcaagcuacucaucugacaaagggcuaauauccagaaucuacaaugaacucaaacaaauuuacaagaaaaaaauaaacaaccccaucaaaaagugggugaaggacaugaacagacacuucucaaaagaagacauuaaugcagucaaaagacacaugaaaaaaugcucaucaucacuggccaucagagaaaugcaaaucaaaaccacaaugagauaccaucucacaccaguuaaaauggcaaucauuaaaaagucagggaacaacaggugcuggagaggauguggagaaauaggaacacuuuuacacuguuggugggacuguaaacuaguucaacccuuguggaagucacuguggugauuccucagggaucuagaacuagaaauaccauuugacccagcaaucccauuacuggguauauacccaaaggacuauaaaucaugcugcuauagacacaugcacacguauguuuauuguggcacuauucacaauagcaaagacuuggaaccaacccaaauguccaacagugauagacuagauuaagaaaauguggcacauauacaccauggaauacuaugcagccauaaaaaaugaugaguucauguccuuuguagggacauggaugaaauuggaaaucaucauucucaguaaacuaucccaaggacaaaaaaaccaaacaccgcauguucucacucauaggugggaauugaacaaugagaacacauggacacaggaaggggaacaucacacucuggggacuguuguggggugggggggaggggggagggauagcauuaggagauauaccuaaugcuaaaugacgaguuaaugggugcagcacaccagcauggcacauguauacauauguaacuaaccugcacauugugcucauguacccuaaaacuuaaaguauaauaauaauaaaauaaauaaauaaauaaauaaagagaagagggccaaaaaaggaaccagcaaagcauacaaagcuaaaacagaaccaagaaaaaaggauguaauauacaacaaagggccagaaaacuucaaggaggaagaauucauacuguccauuucugcuaagagaugaagaaacauuuguaucguggccauuggauuuagcaaugagaagauuugagaauuuuuccaaagaguuuuuguagaauauuagagauagaagucugauuuuacuaaacuaaggcaguaagugacuuaaggaauugaagaggacucacagauauuucuucccagaaauaucucuuuccagauguuuggaaauaaacaucaguacucuuuccagaugcuuggaaauaagagcaaaauguacugauuuacccgcaaaucuugacagauucuagggaaugcaagucucugucauuauuguauagaagagaggagaaaacaaaagguaauuaaagcugacucuaaagucucuaaauuugauucauggguauagauauaaagauuccauaacuuuagcagcaagguccaauacaguagccaaaagccacaugugguuacugaacacuugaaaugcaacuaguccaaacugagaugugccaaaugaaaccaacaccagauuuuuaagaccuuauuucgaaaaauguaaaauaucucauuaauauuuuaauauuaauuacauguggaaauauuuuagaucuauuggguuagaaaauauuaaaauuaaaauuacacuuguuucuuuucucacuuguuucaaaguguuaguagacaauuuaaaaucacauauauggcucacguuauauuucuuuugaacgucccugaacauucaaaauguuauccucuagaauaaauacuaaacuggaagaacaggauucagaaagguuccaucacagccagccuauauauauaucauauuagugugaaaguuaaugaaggggacacccaggacaacaucaugacuuuaagaaaauaaaguccuaacuaauuaaguggcuuacucaggucaccuagcuacuggaaacaaaacccagacuagaaccuaguccguggguauuuccucuauuauuccaccucuugaaaugucagugaaaauuuaacuguuauauacgaucuuauucuguaccacauucaauaaaaugacuuguaaaaaaaucuuaaaaucauaaucuccauaagaguauccuuuguucaccagucaacuuguaauuuaacuaauauuguuaacguaugucaacucacgauucaguuuuguuguguuuuacuuugggcauguauauauauacucugaauuuauuucaaccaauuccacaugaauuuuaaagagaauauccuccuuucaaguacacaucucuuuaaaaaaaaguucuaagaaaacauaucuggaaaaguucagagaaacuacucucaaccauuauuaucugccauuugauagugguaacuuacuaaggcaucauguugcucauuaauguaauauucauacaaaauuaaaaguuauauucaaaauauagcuauaguauaugaugauauacuguauuucaaauucuggcaagauuuaaaauccugcuuugcccaauaaaaucuucaaagacacucaaccauuauguuguagguaaaccacaguuccagaaucaccaauaauuguaaccaaccaaaauauuuagcuguaauuucuucaauauacuccaacaacuauaaauguauuuaugcuuuucauuaagaaaagacacaauuauuuaaaaaauuagucuuuucaugcuaacuuuccaugugaaauugaaaaguaaacaucacuugaaacuuuaaaacuuaauuuuaugagacaucuuaauaagcuaauaacuguuguagucaugguaguuauuuccuuuguagaaauacugcuccaaaaauagugcuaugcugagugcaguggcucaugccuguaaucccagcacuuugggaggcugagguggguggaucacuugaggccaggauuucaagaccagccuggccaacauggcgaaaccaagucucuacuaaaagaaaaaaaagaaagaaaaaagaaaaaaaaugcaaaauagugcugauaaaaaugaaugaagauuauuugauuaagcaacaugcuuaauuuuguacguauacccuauauuuauuuuaacaaauaaaacuauuauugucauuccaaaaugacauuauuaaaaauaauaaaaauaaagaauaucagcuccacuucuugaauauuugcuguuauuucaauguuaucacauagauaaaaggauggugaaaaucuagcuaauagaguuagcuaugcacagggugacuaugcuuccaaagaggagcuuuccauggcgaucugcaugucuucuuuucuuugccuggcuguuuguggccccucuucacauaacuggaguuaguguauucaucuauuccaaaguuauuccaucuggacuccuauguggcagccucccccaaaauacaaaauacaaaaaaauacaaaaguacagagccagaugucacuaagaccugagcuuuaccacauccuuaaaaguuuucaaguuuuccuugguuguauaugucccuuuuuggcuuacuauauagcagaugcuaagugucccacuguugacuguucuuagcaaggcguaauccagcauggagcuacagagaaucacugcuccuucaauacuggcagacugaaugacauuguugguguuuaugucaaccuacuucauguuaagaauaacugacaguugauagucaugacauugcauaaacaucugugguagauucaauaucaauauucuagagaauauuugcaauaagcagcauuuaacagcauuuguucagccacuauggaaagaaguuuggagauuucuuaaagaacuuaaaacagaacuaucauuugacccaccaaacccauuacugggcauauaucaaaaggaaaauaaaucauucuaccaaaaagaugcacacacucauauguucaucacagcacuaugcacaauggcuaagacauggaaucaaccuaggugcccaucaacaguggacugaauaaagaaagugugguacaaauacaccauggaguacuacacagccauaagaaaggaugaaaccauguccuuugcaacaacaugaacgcagauggaggccauuauccuaagaauaaauuaaugcaggaacagagaaccaaauauugcaaguacucacuuaaaagugggagcuaaacauuggucacucaugaacauaaagauggcaauaauagacacuggggacuacuugaguggggagggaaaaagggggaaaaagguugauaaacuaacuauuggcuauuauacucacuaccuggaugacgggaucaaucauacccuaaaccucagcaucacacaauauacccaaguaacaaagugcacaugugccccagaaucuaaaauaaaaguugaaauuacuuuuuuuaaaguccacaauaugauaaagugugcuaaggaaucauaccuccuugaaaauaacuaaaaacaucacuucucccauuuauaaagcaaaagugaauauucaaagauaacugcaggagguuaaguucauuagccaauauuccccuagcaccuaaggcaguuuuccgcuuuuuuuuuucaguaugcucuuauuacugccuaauuauccauauugcuuuucuuccuuuuuguuaaacugaaauucacccaagcaguuuaaccuuucauuuagaaucauuaaauacacuccccuccccucacugauaauuggccucuuucuuuauuaacugauuuccccccuugauuuauuacaaaccuuuuuugccaaauuuggauccauucuguuaauacauucuuuaccuucuugcaacucaauuaacacagugucauuguuaccaaagcuuuccuauuauuucuucaaguucuuauugcucuuuaaagaucaucuaguagaauaaugaauuuuuaauaaacccggaauauuuuaaugauucuuacuuaauucuaugguaaaauuuaugugagacauacuauucuucacacugaaauguuuccuacuguacugucauaauacuauacgguaacuuucuagcaauccaaauacacaaauccuugcaauauaacuuaugacuucuaaaaguacagaaagccauauuauaauuaucauauccauagcuaaaucaaaccaagccagcuucuucaacagcaguuccaacauccauacaauuuuuaauaaagugaaacuuauacuugugccaucaguaaguauuaauguaaccucugaguaugaguaaaccugucacuagauuaugcaaaggaauaaccuuucaugggcccuugagguuucuccuuaauggaaauaaacaauuuuuuuaaaaggcauuccuguucucuucuuggaaagaaauacuuuccugagcuccaaggcacugauaaaauuuggugggugucguuuuaaggccuuucccuuucuuaucagcuaccgacacauuucccagccuugccaccucuacucaccaaaacagugccuuuuuuuuuucuaaaaggaaaagaaaaaugaaagguaucuacugaccuuggaucaaauaagguuauguuuaaguuuaguuuagagauuucuuccacuuuuccaagaccuaaaauaugaagcagaauauagacuaugguaucuuuauuuagcaagaaccagcggacacuguguuuaccagugggaaacacaucuuaaguugacaagagauauggagauaaccagaacaaaauuaaccauuagaauauuaaaaacucuacucccagaauaaauuacaaggaacaaagaaacaaagauuucuaccacuaucuuauuuugaguaauuuuaaauaaauaggaaaggauuuugaucucauccuucuguaaaacgucuaccugccaacauuuauguuugcaauuuucaauaauugcaacuacagacauaaucuuuauaaguauauauucauuugaugucuuucaccaauaaagaccugguguuccaagucuccuaucuguuccagaauuucuauuucaugugccaauauagcucuucuuuaaaaaauuucaagucaguuuugacuccaacuuuaaaacuaugcaacauaguuuucugauauccugagggauuaauucuuauguugaacuuccuaacaauuccauuuugaucccuaaagcuauuuucaugcauuuuuuaaaugaaagagaccuuaaagaucaacuagucuguaccucuuauucugcagaugaugcaauugauccaaggaacaguuaaaguaaccugugcagggucacucagccaauuaaaaaugaugcaacucaaaguagaaacaagaugucccaaagccuagacccauagucuugcacugaagaacuggcaaauagaggcuuucagauuuguuucacagaaaagaaaauaauacuuuuuaaauuagucaauuauguaaauaaaaucgguguuuucaaacacuuaauaaucuuuuguaaaaguacauuuccuuguacauaguaaacgugguuuuagaacuguuuguauuuuuuauugcuuaagaugauuuucuauuggcacuguaacaaauuacagcaaauuuggcgguuuaaaauaacauuuguuuauuaucuaacagcucucaaagacagaagccuaguagguuuggcuagauccucuucuuaagaucuuucaaggccaaaaucaaggugucagugggacuagguccuucuauagaaaucccaggauaaucuauuuccaggcucauuaaguuguuggcaaaauucuguguaguuguaagaccgagguacuuguuuccuugcugaucuuugauugaagguuauucuuaccuucuagaggcagccugcuuuccucugcccauggccccugaaucuucaaaggcuguaacaauguguugcauccuucuuguccuuuggaucucucacuucauaugcugcacuucccuaacuacuacuucugccucuguuucuaagggcucaugugauugcacuggaccuacauggauaauccaggauaaccuuuauuuuaaggucaacugauuaguagccuuauuuacaucugucccuuuggcaauguaaaguaacuuauucauggauauaucaucuuauuauauucacuauccagggaauuagagcauggaaucugcuuggaaaccaaaguucuaauuauuacauuuagcucauauuuauugaugcauccuuaaggaaaugugacugguuuucuacagaucacguuguucaaacucuaacaaaauaaauaacuuugcauuccuaauauuuauauauccauuuccaggaauggcucugauuggcccugcuuagguccagugcccaccccucuaccaaccaccagggcuggcuucauggcaaugugaccagugcagucacacauaauccugggcucagaagggaccccacauuuggggcuuaaugcucugaagcuaccaacuugaaauucuuaacccuuugaauuuguuuuguacaugaaguccaauagaacaauugagcaugugccaggggcuuguuugucugaaaaagaaugcauuucucuuucauuuuuuaagaauauuuccaacagguacaacauucuagauugacauuuuuuuuccuuuuaccacuuuauagagaugucauucaguuaucuccugucuucuaucaguugaaaaguaggcuauauuuuugcuucuuugaaggaaaugucuuuuuuccuuugaagacuuuuaucggccggacacaguggcucaugccuguaaucucagcacuaugggaggccgaggcaggcagaucaccugaggucaggaguucaagaccagccugaccaacacagagaaaccccaucucuacuaaaaauaaaaaauuaaccaagugugguggugcaugccuauaaucccagcuacucaggaggcugaggcaggagaaucgcuugaacacuggagguggagguuguggugagccaagaucaugcuauugcacuccagccugggcaacaagagugaauuucugccucaaaaaaaaaaauagacuuuuaucuucuuugguuuucagugguuugacugccaugugcccuaaaugugcuuucauuguauuuauuccaauagugcuuuuucauucuguggauugaugucuuucauugauuuuagaaaacucuuggccugaaucuauuaagauaaugcuucuuccucaauuccuacucuccuauucuccugggacuccaauuagaugguagucagccuuuuccacuauuauauuauuuacacuauugauuguguguuccauucuuuuauuccucccaugcacuauucuauauauuuucuaauugacccaucauccaguucacuaauucuuuccucagcugucuaauuuucuaauaaacuaaucuauugaguucuucauuucagucacaguuuuuauuucuagaauuucuuuaaauuauuuuuauggauucuuauucugugcugaaauuauccaccuuuucaucacuuuaaaaaaauauugaucauaauuuuuuucuguuuuuggagagagggucuuacucugucacccaggcuggaaugcagugguuagaccauagcucacugcagccaugaucucccaggcucacauuauccuuccucccaucucagccucuguaguagcuagacuacaggcaugcaacaccaugcccagcuuuuguuuguuuguuuguuuguuuguuuguuuguuuuugguuaaguagagaccagggaagucuugcuaugucacccaggcuggucucaaacuccugagcucaagugauccucccaccucggccucccaaagugcuaggauuacagacaugacucaccacaccuggccaauuacaguuauuuaauaguccaugucuaaucauuccaauaucuagauuacugugagacuguuucuauccuuucuuguuuuauauuguuuuucuugguccuggcuucuaauaugcaugguauaauuuuuuauuaaaugccaaguguugcguauaaaaaaauuauagaaacucugcaugaugucucuugcuuccagcaaugacagacaguugaaguaaaggcagaccaccuuaaaaucaagauuggguuuaucaaagaauacauuuugauuuuuguaaguaguggccuauuuauaguucuuccuaacuccuaggauauagccccacaagaauuccaaugaaaagcuuagaguguuuuaccaggguccuucuuccuccuuccugaauuuuagcuugcaggcacugugaaacugccaaaaguucugcucauccugucaccaucuuagcuauugcugcuugguuucucagcuuggccuguguugcuugcaaauugacagaacccaaggugaaaaaugacaccaaauacagggcucacuucaguguguuuccuuucauucuuagaucuuuagcucuugguagugcuccaaugccuuuagauauauauauuuuucuaauccaguuuuuuucauuauucacaguguaggccuuaguuugaaauaaacuaguccauuuacagccagaaauagaaaucagccacugacugaucuguggccuaucuuuauguaugccucuauaucuuauuaauuccaaaaguauuuaagauaaguugacacccuuauaugacgguugauuugccuuguguucuauuuccugcuugaaaccuaaacuguucacuacucuaauauccuaauuaauuuuguuguaauuauuauguaaacuuacauucaaaaugcuucuccucgauagcuaaaucugacuccuuacauauaauauuuaacguguauuugggagguccuuugcaaaugccgucuuguacuuacucauuuuuuuaaauauaagaaacagcauucucagagacuagauuauuucagaguaaaaaugaaaacauuuauaaacauaagcacuaguauuuaauagaauguugccuguauaauuuuguucuuugaaaacuuauaguuaccucucaaaggauauaaaauuuauaaaacaggaugagcagaagcuauguauaacuccuaugguuacauuaacacaaaaucucgguaauucaaaauugaaauuuauuaaacauuucuaagauguaauuugucucugaacuaagaaaaugucuuauuacauaauuaaguguauaagcauugugaaggcaguuuauccuacuuuaaaaaauaaauugcuguuaaggacugucuuaaggauaccaacuuuuuuuuuuuuuuuugagauggagucucacuuuguugcccaggcuggagugcaguggcgcaaucucggcucacugcaagcuccgccucccagguucacgccauucuccugccucagccucccgaguagcugggacuacaggcgcccaccaccacgcccagcuaauuuuuuguauuuuuaguagagaugggguuucaccguagccaggauggucuccaucuccugaccucgugauccaccugccucagccucccaaagugcugagauuacaggcgugagccacuguucccggccaaggauaucaacuuuuuguauggcuaugaacagcauuuaaaaaucaguuuaaucuauaucaaauaauaagaauaauaauaccuauacuaucucauuuuauuuauuuuaaaaaugucacuuguacauauacuuaguaaugacugcaaauuacuauggauaauugaaaguaccaaaaauaaacugcaacacaggauuucccuccccagcauuuuacugucaaaaaaaaaaaaaaaaaaaaaaaaacuggaaaccuagguacuucauccucccuaaagaaucuuucauaaaagucauggucuuucuacauuugguuccuaaauguacuacauuaacuacaaacucagaaaaauguuuggccauagauuuuaaaaauugggaaugaguacagauagaacagauaaguauacacaauuauauuuucccagcucaauugauaacuggcuuuuaauacaauuaugggucauuauucaguauuauuauuacuguggccaaaacaugaaauuccauuuuuagcagguuccaauuaauuuccuugguuggucaaggaaccuuucaagauuuacaagcacucaagacacaaagcaucuuucguuuuucuuuuuucaaaugcucuauucuauuucaucuauuucccuugcucaaaucuuuaugacucuuuguucauacuuaucgauagagaagcagccaccacacuggccaucuaucagaaagugguaaugaguuuagcaugacaaaaaccagcuguugaaacugcuguauuaugcacacuguauguucauaauacaguaauauugcuauuaaugaagagacugcuauguauuucaggaaccacuguaucagaaauucaacuacagaaaugggaguaaaauaagagauguagacauaccagggccagaaugacuucuuuggugagaaucaauguuauucaaccauagcaucguaccacauuauauggagacauuauaggaugaugguuaagacacagcuuugaugugaggcacuucaagccuuugcucugccacuuauuaauauuuacuauguccuuaagcagguuauuuagccucucuaugcuuuaguguucucaucuauaaaaccggggauaacaauaccuacuuuacugguuuuucuuaauaagaaucaaauaaaagugaaguuagaacuccuaacccaguggcuaacaaaaaaauaagcagucaauaaacacuuuaaaaauauuauguuuuuuuuuuuucucuccauagauuaugugucuuuuucucucugccuuuggaccugaucacuccgacacucuuaccaacaccagguguuuauuaccuaucuuuagaagucuaccuuugcuucauaggaacuaccuuaguguuuuccaucucagacuuugggauuuuaucuuaguucacuucagacauacuccagggauacagcaguguacaaugggaaaagauuuagacguaguguuaucaaauagaaauaaaauguaugucacauguguaauuuuacauuuucuacuaggcauauuuaaaaaggaagaaucagccagaugcacugcuuaugccuguagucccagccacucaggaggcugaggcaggaggaucacuuaggcccaggaguucaugcccagcaugggcagcauagcaagacccaaucucauaaacuaaaacuggaagaaaaagaggaaaaagaaacagguagcauuuuaguaauauauuuauuugcaugaauauauccaaauuauuaugauuuuaacaagcagcaaucaccacauuucaaguguucaguaacuauaggugcuugcuauauuagacaguacaggcuuagagucaaaugaauguggauucaaauucuggccuugcuuuuuacuugccaugcacuugcuguaaaucuguuucauuauguuaaaaauuacuaucuccagauauugugagaauuaaauaaaaacagcauacucaaagcacuuagcacaaugcuuacuuacaggcaugcucauucaaugagaauucccucacaccaaccuucuacuauagaacugaacacuggcucaauacagugaaaucugugauccagauuaagaggaaaggaagagaaaggaagccccccaucguccuuccuuucuagcucucuauaaacuguggccauuucucccacucacacagcucuccuucuuugcuuccuagcagcuauaaauuugacucgguagacuuauuucuagaaucccugaacccuuguagucaugacccaaguaugugguuccaagaaacuaaaaaaaaacccaugccugaaagagaaauccuaccaucucuuucuucucugccccugugguauccaccuccccagcuggcccuacugccuagucagacagaguuucuccuuuauucagggguucucacugcugcagcuuccucagccucagcaacugccauuaacguuagugcuucucuauugaaagagagucuggcaucaaacauuaaagaggcugagcagcauucugcaaaauaacuggacaguacccuucaaaagugucaauggcauaaaagacaaagaucaaggaacuggcauauacugaaggugacuaaagagacauaaaaaauaaaaaaugaaaauaugggaucuugaguaggaucuuggcccaaaaaaaggacauuagugggaaaacaggugaaaucugaauaaggucuagaccuauucgucuaauaagauuagaucuaauaauauucuacugaugucaauuuccugguuucaauacuugaacuaugguucuauauaauguuaauauuaggggauuugugggaacucucuacacuauuuuugcaacuuuucuucaaaacaaauaaaaguaaaauuaaguuaaaacacuuuuaaaugugauuauuuaggacuuuauuaugaaagaaccucugucccgauggacuuguuaagugauauauuauugugaaauagugcaacuuauguuaagccaggaaggccaucacacagguuaacgaaaagucaauuccaagguauagaaaauucaccuuacucaccacuaugaguuuguaaaucacuaagagaguaugaugccaccuacauauacuauagugaggacuugaugacagcaaaucauauuuugugcaaccaauaauguuauuaaauaaauguagcuacugaauaacauacuuaaacaauaacuccacugugaccaacuuuuuacagaaagaaagagacagugaaaaauaagaaagauaugcaaaaaaauaauaugcacccaccucccucugccagaucucccaugcuuuaggaaacaacacuggucaaccaacucugaacaaaaccccuugcaauagaaaggacagucugcuuugcuauauauguguuucuguaacaugaauuaacauagacaauugguaaguggagaaaagauuucaguguaaugcagaaguuacauugguuccuauguaauuuuuuucccagaugauuaauguuuugccuuauuaguacaggcaacugaaggcuacguauacuaauggcagcaaaccaggaaggaaucaguauuauacauucagccuuucucugagaagugcuacugcaaaguuaacccugaucuuuguuuauaaauaacuaaauaaauaaaacaaaguaacacaaaacaaugaggagagcauacaacucugguaucaguacauuuuguacaaagcuuacaagcuuuucucuauuuaugacuuguaaugauaaugucuuucugcccuugcauccacagacagccucaacccuuccuuauaccaccuaccaccaagcuaucuucaccuuuuauguuuuaaguaaaacacuacuuuuacugcaguuuaauuauuagaaacuucaugucuuuuaaacuguguuaguauuuuuauugacauuguuauuguuuucaucagugcucugguuauaaaguugaauaagcccuacugauuuaaguaagaauuuggaaacugcaaauuuuccagaaaagcacacauaauauuauaguagaaaugguguauuaccacacauucugaauacauugucucaagauuuuuuuaauauaaaaagguuauacugguuuguuuucaaagauuacuuauuuaucaaugaaguauacuguuaauaucaauuucuaaacaaaauuacgaaguguauuuuaucaucagcuuuaaaucgaacauuuuaauauacacuucuguaugugucacacauuucuuaaauaaauaggauguuccaauguaguaacaaaaauuaucaucuauguuaaaaacaaacugaugcauuguauaagaaaagcaaauauucaauauuugauauaaauuaaauguauauuaugaacugcaaucaaaccaacaucaaucuucuaaaaugaagcaguuucuaaauuguaugaaaauacauggauauggucuagaaagcauguuucaucauaagacuaaaaagauacuuuuuauuaggcagggucucacugucacccaggcuggagugcaguggcacaaucacagauuacugcagucucgaccucccaggcucaaucgaucuuccuaccucagccucccagguagcuaagaacuacaggcacgcaucaccaaacccggcuaauuuuuguauuuuuuguagagacaggguuucaccguguugcccaggcuggucucaaacuccugggcuuaagggauccacacaccuugcccucccaaagugccaggauuacaggccugagccaccuggcccugaccuaaaaaaauacuuuaaauaaugcuaaagaagaauuuagcaucagauuuuuuguuucuuucucaaagcaacaauauugcuucacgaucaucuguuguuaaauauauaauacuaguaacuaagcacucuuuuauguaaauggcuccuccuaagaacaagcacaugaaaguuuguguuauuuguacaugacaaagauauagcacauaacugagucauuaaaaacacaguucaggccgggcgcaguggcucacgccuguaaucccagcacuuugggaggccgagguggauagauuaugaggucaggagaucaagaccaucguggcuaacacggugaaacccgucucuacuaaaaauacaaaaaauuagcugggcgugguggugggccccuguagucccaacuacucaggaggcugaagcaggagaauggccugaacccaggaggcggggcuugcagugagccgagaucccgccacugcacuccagccugcgcaacagagcgagacucuguuucaaaaaaaaaaaaaaaaaaaaaaaaaaaacacaguucaacuggaauagcuauaauuuauauaucaaucccaauuugaauagaauauuuuugaaguuaauguauauaauaaauaucaaucacuaugaauauuuauauaaaauaguagugugcucuuuuuaauauacuccaugauaugguaggauacuuuuauggacccaugcaacccugaauaucaagcagcccuguuuuauuuuucaauuaucuauuuaaguccacuugguuagagauagucagcauguuucucacgggaaaaaaaaaauacugcacaauugucugcguauagugugaccucuuucacuuggguggguauccuuuccaucaccaacuaagugaggauauaaccuugucaaaccaaaggcaaaagaauaauaagcauaugacaggcuaacccagcauggaaaagguuguuuaggagguugcaaaaauaguacucggaaugacaaaauaaaaguacacuucaaagagcagguuaauauuuuuaaaagcacucaaaaccugagaagcauuuaaucccccuccuuggaugucugccauacaaaacuccacuugaauuuauuucauuagucacuaacgagauuugguuaauauguuuucaaaugaauacugguagaauagucugaaagaaacacauuuauagaauaucuauuuccacaaagcacuagccaaagguaaguacaaauaagcagaugaugucuugcuuuuaccaauuauaaauuaccauccaacaagaaaaaaauccuuccaauucaagaaucagaaauacaaaugggaaaaguauuuacccaguagcagguuuuuacugucuccaaaucaaauggcaguaacacugcuaccuuaauugcuaccccuaacuggcauaacagggaaucauacuacaacauuuuuauaaguauuugaaaccagaagaaauuagacaaguuuggcuacagucuuccuaguguaaauuuacuuuuaaagcaaacaaacaaaaaucuccaaaccauuuaggccuguccuaggacuauguauuauaucauugugucaguuauacacacuuugacauuccuuuucuacauuaagacuggaaugaaauuuuugauccugaccagucaucauauuauaacagugaaacagugccaccuuuuggacccaaacagaagcauccagugcuagucuuucaaacuuccuuuuucaguuaaacuccugauguacauaaaugucaaugauuuucaugucauaauuaucaccuucuaggaauacuuuuuaaucuauacaaaccaagaaaacauugggguaacaaaaaaguugcuuaccaagaugcaaaauuucaaaauauuccaaaguaguaccaaaugcauguauuuuuaauaauuucuaaucaacauuucauuaaauacauuucaccaaauccaaauauguuagucaacuaacauauuuuaaaugcaaaaaauucuuuuuauagcauuguuacacugcaaaauugauuuuuuaaaaaugcauuguauuuaacauguauucaauuuaauaauuggcaauaugauauuaacaguggauuaccaguuaaaucagcauaaguauaaauaauuuuauauacaaauauaguaugcuucugaguuacuuacaccaaugauacaaugucaccacgguguacuucaaaauuccucacuuuccagugguucaaaagcaccacaucagaugacuggcuccccccaggauucaaagaaggcuagaaaauaaggagaaagagacacuucuaucauuuguauuuuucaaucuucaugguucuugcacuucacagcucgaguggacugaaauaaaacauuucuaauacaguaccuuucuauaaauugcuguucuaaaguaacugcaaaugaugaguuuucaaaaaggcucacugggauucuucacagaugaaccagaaaaaaauaaauuaccaaugcuuauuugaaaggaacgugugcuagacauuaaaaucuuuaguaaacuccaauaaagagguaugaaaagccuuaagaauaauauaaaaacaugaggaagaagugagucaaaccuccuaacaaaauauccagauaggaucuaauuccacaguaguacacaucauuguuccaucuggggaaaagaagaaauaaucccaaaucacagucauguccacaaaucuucacagucauaugaaaaacugaagggggcaaaagaaagaugugauaggauuaccauuauaaaauguauggauuucccacuuugaccucucuuuucucaaaagagcacauauccuaaggguccuggucccaguuugagccuaauaaggggcuuucauccuaggauucagagaagucuaacugugccugaggguuaauggaucaagaacugagaaacauuuuguguaagaauuuuucuaaaggucaggaaccauacaggcacaaaaauuugacuggggaacuaugaaaccagcauaccugucauuuggacagggguacagacaaagccaaugaauaacaagcuugaggcaagaacagggggacaaaauaauuagaaaagcuaagauagccuuuucacuguuuuuuaaauuuuuuuucauuuuuuauuucaauagguuuuguaagaaaagacaguguucgguuacaugaguuaaguucuucagcagugauuucugagauucuggugcacccaucacccgagcaacguacacuguacccaguguguaggcuuuuaucccucaccaccacccacauuuucccccaaguccccaaaguccaaugugucauucuuaugccuuugugcccucauagcuuagcucccacauaucagugagaacauacaaugucugguuuuccauucaugacuuacuucacuuagauuaauagucuccaauuccuuucagauugcugugaauaacauuauuucguuccuuuuuauggcugaguaauauauauacacaccacauuuucuuuauccacucguugacugaugggcauuugggcugguuccauauuuuugcaacuguaaauugugcugcuauaaacgugcgugcaaguacacaucuuuuucauauaaugaguuauuuuuucauauaaugaguuuauuuuccucuggguagauaccuaguauugcuagggacugcuggaucaaacgguugaucgacuuuaguuauuuaaggaaccucgaugcuguuuuucauagugguuguacuaguuuacauugccaccagcagcguaaaaguguuuccuuuucaccacauacacaucaacaucuauuauucuuugauuuuuugauuauggccacucuugcaggagugagguaguauugcauugugguuuugauuugcacuucccugauaauuaaagauguugaagauuuuuucauaugcuuauuggccauuuguguaucuucucuugagaauugucuauucauguccucaauccacuuuuuuuuuuuuuuuuuuuuuuuuugagauggagucucacaccgucgcccaggcuggagugcaguggcaucaucuccgcucacugcaaucuccgccucccggguucaugccauucuccugccucagccucccgaguagcugggacuagaggcgccugccaucacgcccagcuaauuuuuuuuauuuuuaguagagacgggguuucaccauguuagccaggauggucucaaucuccugaccuugugaucugcccgccucggccucccaaagugcugggauuacaggcgugagccaccgcgccuggccucagcccacuuuuugcugcgguuguccuuucuugcugauuugaguucugacucuccaauaaugcuaccaugggaaguggccauuucuguggugacaggaaaggugccaagcuuccucuccgccuucacugaggggcugaugacagcagccaguggagacacaacaacaaccagggcagaagcaaggaaaauagugaacgcagggcaacagccagucccuggagcaguaaugacgugccuuuuguuaaagauuccugggauuauuugcagauuuucuacaaagcaagaguugacaaauaugucaaaauucugcauggaggcuauuaucuugacacuauuuuugauccaggguuuugcagcugaaaaauacugguuauccuugaacaccucaaacacuuucagaacuuucaccaacuccuuuagugauaauaccuaaaucccuaacuuaaauucccugcuacucauuucacuuaacuaccugacaaaaaauucaacaggauuaaaauggaauuuguuaucauuucaacaaauaaauuuuuuuuugagacagucucuucugcuuuucugccucagccuccugaguagagcugcgacuacaggugugcgccacuaugcccagcuaauuuuuguauuuuuaguagagacgggguuucaccauauuggccaggcuggucucgaacuccugaucucgugauccgcccgccucagccucccaaagugcugucauuacacacgugagccaccacgccugcccucuuuuuuuuuuuuuuuuuuuuaagagggucucgcucugucacuuaggcuggagugcaccggcaugaucauaguucacuguagccuugaacuccugggcucagucucccaguuccaguucccagguagcuaggacuacaggucuacaagugcauaccaccacauccagcuaagucggguuuuuuuuuuccuuuuuuuuuuuuuagagaugggagggucuugcuauguugagcaggauggucuugaacuccugaccucaagcaauccuccugccuuaucaaccaaagcgcugagauuacagguaggagccaccaugcccagcccuuucuuauuuucuuacauccggguuacccuuuucccagucaaccaguuuaaaaacuuaguugucuucuuacuucucauccaaccagucagcaagcuaaagggaucuuuuuuuaaucauaaugucuucuacuucuggcacguuuucuuuccucucuaguaucaucauauuucaagcaccaaucauuauguaacucaugcuauaucuacacuaaucagucucucaccuccaacuuagaaaugauuccauuucuuucuaguuauaugaucuucagcaaguuacuuaacuucauuaugccacucauuacuaggaaaauggugaugaauaauaacuauuaucuaauuaauaauuaaauaauaauagccaauaccuacgaaguacuuaccauguguccuggucuaauaauaauagccagacauguuaagugcuuaccaugugcaagacacuguuuaacagcuuuacaaauauaguugacccuugaauaacacagguuugaacugcguggguccaacaauacacagauuuuuuucaauaaaaguuacacugagugugccugccucuccugcuucccuuucccaccucuucuacaucugccaccccugagacaguaagacuaacuccucuucuuucuccuccuccuccuuagccuacucaauaugaagacagugaggaugaaguccuuuacgaugauccucuuccacuuaagaaacaaaaauauauuuuucucuuucuuaugauguucuuaauaacauuuucuuuucccuaucuuacuuuauuguaaaaauauaguauauaauacauauagcauauaaaaauauguguuaaucucacuguuuauguuaacaguaaggcuucuggucaggagcagacuauuaguaguuaaguuguggggugugggacagucaaaaguuauaugcaaauuuuuaacugcaugggaguugggucccucacccccucguuguucaagagugaacugcgcuaccuuauuugguaagaucauucauuuaaagugcuuaugguaguucuuggcccauacuuaccucucaguaacuucuauuauugauauuucuacaucacaauuuuaauuuuaagcaggucuguacucucuacccccagguuccuccuaugucucuaucucuagugaggaacagaguugauaugguagcauaaguccaaagggcuuuacugagccauggugcugaggaauggagcuuuugucaucacaacaguaggucagauuauuaaaaggugagcuuucacaaggguaugcucucuaucucauucauauuucucauucaaauucucuaucucccucuuccucucugucuuugaccucaguauccacagguccucuucccuaauuuauuuguauucuuuuuccuauauaacugacacuguaaaggugaccuggagggagaccaucugggcucuggaccauaaagagaaaauauuccuauugaacuuucacugcauucguuuuuuuuuucuuuuuucuugccauaauagugaaggaacaaaaggugauuuaauuauuucugacuguucuccuuggucucuuuuacugguguuuuuuuugaaguuugugaccacaacucauaagaucaaaaaucccaaguucaccaucacagccuaugauuauuucuauaauaauauuuaaauaugcauuauaaucacucccuugucucucuuuccaagagucuauaagcucuuuuuuuuucuaaguuuugagaauaaauuauuuccuaugccuauauuuuugagaucgagcacuuugcagguaauuaacacauuuuaguggaaagaauuuaaaaaaaucaauuaguggaauuuccaaagauuuucaaaauuaacaaggucaaaacaaagauccuauuccagcccacuccagcccccaaauauacuuccccuccuuauuuaacaguaguaccacuuacccuaucccccauacuagaagacucauaagucagguccaguuucuaacccgcucuuuggaugccucauuaucagacuuccccucugucaagaauguuuuuuccccacuuggaaacuucuagucauuugucaaaguccuuaucugauggggacuccucuguaaagccuuuaaaaagaauaaaaaacaugcugcaguucccuuaaggaaauuggaaaauuauaucuugguguuccaacaauggggauagaaaaauccccacugacccaaauuuuaacuucgucuuucccuuauagaaucacucaaaugcccaacuuuucuaauuguaauuguuagaaccaaaagguaaagcauuauaaacaaaagauuuaugcaagggaagaaaacagaaggaagcaugucuaacuuccaauagugaaguaaguauuagaaucaacagucaacaccugaaugacauugcuugauuuuauaaaggaagcaacagaguuuucuuuuaccuuuucuuuccuccacaaguuuaaauuagcuacucccucaugugcgcucccauagcaaugcagguacuuaauagguaucugccuacagauaagacucuuccacucagguguaaguuucucaacugcugaaaccgugucuuagccauuuuuguacaccuaaucccagaacagugauuggaaaauaauauuucuauaaagucuaaaagauuaaagguuuuuaaaagcguauuuaaaucagauaguuucuagaauauacauuaucuaaauaauguauacaucucuuucaaugaaaacauauucuagauaaguauagcaauaaauuuuuugugucucaucaaguuaggcaauuuaagaguuagaaauaguugaauagggcuuuguuauucauaaugaaauaaugguaaucacaacacaauaaacuaucuuguuuauuuauuaaucuaacacuuaugaauaucaacaaaacaucauaaagaaaaaccuucuugaauugggaaguuguuccuauggcacuauaagaaccacaguuuucuguacuucacuaaaaacaaaagcuuuauuaaaaagaaaaaaaacaggccgggcgcaguggcucacgccuguaaucccagcacuuugggaggccaagguggguggaucacgaggucaggagaucgagaccauccuggcuaacacggugaaaccccgucucuaccaaaaaugcaaaaaaaaauuagccgggcgugggggcgggcgccuguagucccagcuacucgggaggcugagacaggagaacggcgugaacccgggaggcggagcuugcagugagcggagaucgcgccacugcacuccagccugggcgacagagcaagacuccgucucaaaaaaaaagaaaaaaacaguggccggucacggugguucacgccuguaaucccagcacuuugggaggccgaggcaggcagaucaugaggucaggagaucgagaucauccuggcucaacacggugaaaccccgucucugccaaaaaauuagccggguguaguggugggccgcuguagucccagcuacucgggaggcugaggcaggagaauggcgugaacccaggaggcggggcuugcagugagccgagaccacgccacugcacuccagccuggggcgacagagcaagacuccgucucuaaaaaaaauauagagcaagcaauuuuuucaaaucgaugaaguuaaacacaucaaguagaaauuaaaagucauaaauaauaauuugauauggccacagaaucuguauuuucuuguuauauuguuaauauuuaaauccuagauuccaagagacuacaucaaaauauaacuaacuuaaaauaauaaaguguuugaagaaaucucagagaauauuuaaucuaggaguuuccaccuguaucuccaaguauuugauuguaucagauauuccugcuaguagucacagugauuuccaguagcaaaaggaaaaacacuaacaaagaacaaaaaaagccaaacaucugcucuggacugaguaagaaagacccacccucacccaaggugggcagacaccauacaauuaguugagagcuuggaaacaacaacaaggaagaggaaagguaaauauucucugucugucucucucaacaacuugcauucucacacucaucuauuucucugcuucuaccauggaccacuaaaguuaaaaaucaaacuuggagaaguguuuugaauaguccuugcccuaaacacagaaaacuauguucaaaucuugucuccauuucuuauuaaccauauuacuuuaaacagauuauuuaaccugucucauuuccucaucuauaaaauggggacugacugcaggaacacugaucucauggaguugcuacaagaauuaaaugagacagucuacaaaacauuacagucaugaaacagaguagcagucaacaaauaggacacuaaugaugauggcaacaauaacaaaauaaagggaaacaauaucagguacaguauccuuuccacaagauuuaagaaaaauuaaacauuuaaauauugcccugcacauuucucauuuuacauaguaaacugaaaguauucaggcagaaaauucuaccccucauuucuaaauucuuuguugauuguuuccucacuuuuuuaaagcaaguaaaguuaggaugcuuuuauguggggccuuaauuguucugccucuauaaauuaauccaaaaaaauuuaauaugcauaauuaguuaugaauaccuauaaaauaccuaaagaauuuuacacccguuauguuuuacauucuuauuuuuaaaacauauacacacauacagauauauauaaaaacauaugcauuuaaaaaucuaacaguucuuagcucugguugaugaaaugauuuccauuuucucccucccuacugcuuaccccuccccacaccuuguuuuccucuggcucaguuguaucucacaaauuguuuuuuauaaugaacauauauuuaguuuguaugcuuugcucugaccuaaguacuauauaguucacucuaagaaauacaauauaagucagcauauuucaacagauguuaguaaguuaugcuaaagcuagaaauagccaauaucuaucaaaucugcuuuuggaacaagcauaacacaaaaguuaggcuuuaaucuuuucucugaucaaagacuaugcugaaggauuuuuauuuguccuacaaacaaauauuauugucaagguauccuaaauccucagcuugugucuaaccucaaaucauaugacagguuuggaagaauuuaucuuucgguuuacgaaaauaaaauucuccuagagaauuaagcacagucacaguacacuuccuguuuuguaagacuuaacugaagccaucaaucaauaaaugauauuauucuggcuuuuuacuauaaauuuuuuauucauuuuuuaauuuuaaagaaucuacagccuaugauucacugccuccaagauauaaagaaagccugguuuugaccuuacuucuuuggguacaaugcuuucaaccuuuucaggcuuauaaaaagcaccacucacacuggcuacauacaaucuacaacagguaaauaucaaacuuugugcuuuuaagugagauggagcccagcugcagccacaaggacccaacaguagcccucagacuucuuuugaagaaccauuacuuugaagacauaucuguggaggcgggggcaauaacagaagaaacugaaauaguacuguugauuuagacuuuuuaacacugcagcacuggccaagaagcaugaaguaaguacaguuaaaguaaauguacauucugauuaagaauuauuagaugucacaccuuugaaagaaugcggacaauauggucuacaaugccgucuuucuucccuugcuauucaggggucuccauaauuugcauggcuucuagaauucucagauuugucucacuaggugugcauaauaaaauagacuauaauguacccaggucuguacaaagcuguaaguuagaaauggaacauuccuuuuauaucauggguacuuauuacccauaccccuucugaugguuaauuuuaggugucaacuugacuagauuaaggcuacccagaaugcuaagaaagcauuauucuggguauaucugugagggaguguucccaggagagauuggccuuugaagcacuggauugaguaagaaagauccacccucacccaacaugggcaggcaccaugcaauuaguugagggcuuggauacaagaacaaggaagaggaaagguaaauauuuucauauucucucucgcucucucucuccugacgcugggacaaccuucuucucuuuccauugcaaaucuuagaacuccagguccucugacuuuuagacucugggacuugaaccagcagcccccaggucucaggcccuuggccuuggacugagaguuauaccaucagcuucugugguucugaggccuucagacuuggacugagccaagcuaccuggaccuccagcuugcacauagccuauaaugaaacuucuuagccuccaugaucacaugacccaauuccccuaauaaauucccucucauagauagauacauagauagauagauagauagauagauagacagacagacagauaaauauccuauucguucugucucuccggugagaucuaauuauaauauaauuucuuaauuuuucuuuuaaaagcaagccuguaaaacuacauuaauaaaauaaaagugaacauauaacauauugauuuaauucagaauuacacuagguuguuaauuuuucauucuccuaaucuuaacugcauguucuacuauagaacgccccaucaaagugucacaggcacgcucacauacuaccuguaggaaugaaaaucuuuauaaacuaucaacaagguaauuugccaaaauauauuuaaagucuuaaaagugaucuuguccuuagacuugaaaaugucacauuuaaaaagauuuccuaagaaacuaauuggacauaugugcaaaggaacauauacaaagauauucauaauacauuauuuacaauagugaauagcuucuuagucuuuuagcuaaaaucaagugaauaacugagccaagcucaauaccaauaauaggaaacugauuaaaccuugguuuagcaaugguuaaacuuuauggauauuaaaaaaugauuguaaaaauuacauuguggaaaaauauauauuuggauaugucuggagaauaagugaaaaaugcgacauagaaaaaacaaacugcuaugauccaauuucaggaaagacaggacggaagaaaaaagggaaaaaccuuaaaagaauaaaguaaagaaggaaauugugcagaaaagaaagagaguaacuuauaaugguuuagaaaugcaaacuucaaagucagaagcuggguuuaaaucuaugcaaucuucaguaaguuaucccaucucucugauuguauuucuucaucuguuaagugggcuaacauaguaucuucaucauacaguugugggugauauuaaauaaacuaauauauauaaagucaauacuguaaugacuugaacauagugaucauucaauaauuuuucacuauuaguauuauauaauaauauauuuaaaauaaauaauucugaaaggugguaucaauuauuuauuuuccacauuuuucuauguuuucuaaguuuuuugccaaucaauaugcagugcuuuuauauuaauguaagcacuaagcaaugaauuguuuuugaaggggaaagcaucugauuuuuauauccucuuauuacuaauauuuuuaaaguuuguguucuuuaaacaagcucuucaguauuuaagcaucucuuuaauucaggucgcuacaacuagauugcaagguucaaaucugcaaaguuucuguuucaaugcacuaauuauaaaauacuaccauuaaauacgugcauuguguuuccuagcuaauaaaacauguuuugagauagcuauucuaauuuauaguucuaauuaaccauaucagaaauagaucacauauagucaaugaaauauaaaauuuauauaaacauaucugcauauuaaccugaagacagacugcuauauauaaaauaagccagcuacacggaaaaaccccagcaagauacaugcggaaucuuuaacuuccucauaaaacugaauaaggcuuuccuauucauugcuaaguuuuucuugcucagaaccacuuuucugucuccuaaccuaauuaaaaaaaaaaaggucauaguaagguguguagcacagaaaggaagugauucaacaaauaacaaagauuuuaggaggcugcaugauucccucagaagcauguaacuccaaagaggccaaauuccccaacauauacaaugguguagcaaucuauucacauggcuuauauaauaucugugaacaaaucugugaagauaauaccauggauuuuagauccuuuaguucuucauuguugaaccugaugcugcauuauaaggaaaaaaauaaaaaagaaccagucagcauccuaacacuacaaauguguaucaacaggaauuuugguaccuggguacccuaaauuacauugaucaaagcuauaagaacaaaggagcucaaaugcauaggaaacagcuuaucaaaaggaacugaaaagcauucuggcagauaaaaagggggaaaaaaggauauauaccuuauaucauuuaucuacugcuacaaaacaaaccacuccaaaacuuaaaacaaaaaucauuuauugguucaugauuccacaauuuaggcuaugcuuagcuaugcaauuagccagcuugucuggcugugaucacucaggcagcugcagccauggaggcagcaguguuccaggagcaaaaacucccucguguaagcaucuaccaagccucuguuugcguauuugcugauauuccaccagccaaaaugagucauaaggccaagucaagaaucagcauaggugaggaugacauagagcucaguaccgaggagcaugacucaugggggaugggguagacagggaauaucaauguaauaaucuaccaaaacucugcccucuagcuccaaugaaucauaucccucacauaugcaaaauacauauaacccuuccuaagagccccaaggucuccucagauguuugcaauaggauucauauccguuaauucaugauaugcaucaggucccaggucccaguauggaagaggacucuagggugcagcucaucucaaaucagagacuuaugaagugaaaagauaaauuaucuguuccccaaacaccaaacauauaauggaaagacagaaagaagauaaccauggauuuuaaaaagcaaugaaaaaagcauagaagucacuuguccauagaaagcuuaaaauccagcagcauguguugucaaggccucccaucucauggagagaaauguccuuuaauuaagauucuuuucuguucucuggaaugguucccuaauuuauuggucugcauggcucuuagcucugcccucugggcuuugggcucuuuuuuaaaaaggaggcccgguggagccaagauggccaaauaggaacagcucuggucuacagcucccagaaugagcgacgcagaagacgggugauuucugcauuuccaucugagguaccggguucaucucacuagggagugccagacagcaggugcaggacagugggugcagagcaccaggcacaagccaaagcagggugaggcauugccucacucgggaagcacaaggggucagggaguucccuuuccuagucaaagaaagaggugacagauggcaccuggaaaaucgggucacucccacccuaauacugcgcuuuuccaacaggcuuaaaaaaacggcauaccaggagauuauaucccgcaccuggcucagaggguccuaugcccauggagucucgcugauugcuagcacagcagucugagaucaaaaugcaaggcggcagcgaggcuggggaaggggcgccugccauugccgaggcucgauuagguaaacaaagcagcccugaagcucgaacuacgcggagacuaccacagcucaaggaggccugccugccucuguaggcuccaccucugggggcagggcacagacaaacaaaaagacagcaguaaccucugcagacuuaaaugucccugucugacagcuuugaagagaguagugguucucccagcacacagcuggagaucugagaaagggcagacugccuccucaagugggucccugacucccaagcagccuaaaugggaggcauccgccaguacgggcagacugacaccucacauggccggguacuccucugagacaaaacuuccagaggaacaaucaggcaggagcauuugcggaucaccaacauccacuuuucuacagccaccgcuguucugcagccaccgcugcugauacccaggcauacagggucuggaguggacaucuagcaaacuccaacagaccugcagcugaggguccugucuguuagaaggaaaacuaacaaacagaaaggacauccacaccaaaaacccaucuguacgucaccaucaucaaagaccaaaaguagauaaaaccacaaagaugggggaaaaacagagcagaaaaacuggaaacucuaaaaagcagagugccucuccuccuccaaaggaacgcagcuccucaccagcaacggaacaaagcuggacggagaaugacuuugacgaguugagagaagaaggcuucagacgaucaaacuacuccgagcuacaggaggaaauucaaaccaauggcaaagaaguuaaaaacuuugaaaaaaaauuagacgaauggauaccuagaauaaccaaugcagagaaguccuuaaaggagcugauggagcugaaagccaaggcucgagaacuacgugaagaaugcagaagccucaggagccgaugcgaucaacuggaagaaaggguaucagugauggaagacgaaaugaaugaaaugaagcgagaagggaaguuuagagaaaaaagaauaaaaagaaacaaacaaagccuccaagaaauaugggacuaugugaaaagaccaaaucuacgucugauugguguaccugaaagugacggggagaauggaaccaacuuggaaaacacucugcaggauauuauccaggagaacuuccccagucuagcaaggcaggccaacauucaaauucaggaaauacagagaacgccacaaagauacuccucgagaagagcaacuccaagacacauaacugucacauucaccaaaguugaaaugaaggaaaaaauguuaagggcagccagagagaaaggucggguuacccacaaagggaagcccaucagacaaacagcggaucucucagcagaaacucuacaagccagaagagagugggggccaauauucaacauucuuaaagaaaagaauuuucaacccagaauuucauauccagccaaacuaagcuucauaagugaaggagaaauaaaauacuuuacagagaugcacaugcugagagauucugucaccaccaggccugcccuaaaagagcuccugaaggaagcacuaaacauagaaaggaacaaccgguaccagccacugcaaaacaugccaaaauguaaagaccaucaaggcuaggaagaaacugcaucaacuaaugagcaaaauaaccagcuaacaucauaaugacaggaccaaauucacacauaacaauauuaacuuuaaauguaaaugggcuaaaugcuccaauuaaaagacacagacuggcaaauuggauaaagagucauacaucagugugcuguauucaggaaacccaucucacgugcagagacacacauaggcucaaaauaaagggauggaggaagaucuaccaagcaaauggaaaacaaaaaaaggcagggauugcaauccuagucucugacaaaacagacuuuaaaccaacaaagaucaaaagagacaaagaaggccauuacauaaugguaaagggaucaauucaacaagaagagcuaacuauccuaaauauauaugcacccaauacaggagcacccagguucauaaagcaaguccuuagugaccuacaaagagacuuagacucccacacaauaauaaugggagacuuuaacaccccgcugucaacauuagacagaucaacgagacagaaaguuaacaaggauauccaggaauugaacucaccucugccccaagcauaccuaauagacaucuacagaacucuccaccccaaaucaacagaauauacauuuuuuuucagcaccacaccacaccuauuccaaaauugaccacauaguuggaaguaaagcacuccucagcaaauguaaaaaacagaaauuauaacaaacuaucucucagaccacagugcaaucaaacuagaacucaggauuaagaaacucacucaaaaccacucaacuacauggaaacugaacaaccugcuccugaaugacuacuggguacauaacgaaaugaaggcagaaauaaagauguucuuugaaaccaacgagaacaaagacacaacauaccagaaucucugggacacauucaaagcagugugcagagggaaauuuauagcacuaaaugcccacaagagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaauagagacacaaaaaacccuucaaaaaauuaaugaauccaggagcugguuuuuugaaaagaucaacaaaaucgauagacugcuagcaagacuaauaaagaaaaaaagagagaagaaucaaauagacacaauaaaaaaugauaaaggggauaucacaaccgaucccacagaaauacaaacuaccaucagagaauacuacaaacaccucuacgcaaauaacuagaaaaucuagaagaaauggauaaauuccucaacacauacacccucccaagacuaaaccaggaagaagcugaaucucugaauagaacaauaagaggcucugaaauuguggcaauaaucaauagcuuaccaaccaaaaaaaguccaggaccagauggauucacagccgaauucuaccagagguacaaggaggagcugguaccauuccuucugaaacuauuccaaucaauagaaaaagagggaauccucccuaacucauuuuaggaggccagcaucauccugauaccaaagccuggcagagacacaacaaaaaaagagaauuuuagaccaauauccuugaugaacauugaugcaaaaauccucaauaaaauacuggcaaaccaaauccagcagcacaucaaaaagcuuuuccaccaugaucaagugggcuucaucccugggaugaaaggcuaguucaacauacacaaaucaauaaauguaauccagcauauaaacagaaccaaagacaaaaaccacaugauuaucucaauagaugcagaaaaggccuuugacaaaauucaacaacccuucaugcuaaaaacucucaauaaauuagauauugaugggacguaucucaaaauaauaagagcuaucuaugacaaacccacagccaauaucauacugaauggacaaaaacuggaagcauucccuuugaaaacuggcacaagacagggaugcccucucucaccacuccuauucaacauaguguuggaaauucuggccagugcaaucaggcaggagaaggaaauaaaggguauucaauuaggaaaagaggaagucaaauugucccuguuugcagaugacaugauuguauaucuagaaaacccuauugucucagcccaaaaucuccuuaagcugauaagcaacuucagcaaagucucaggauacaaaaucaaugcacaaaaaucacaagcauucuuauacaccaauaacagacaaacagagagccaaaucaugagugaacuaccauucacaauugcuucaaagagaauaaaauaccuaggaauccaacuuacaagggaugugaaagaccucuucaaggagaacuacaaaccacugcucaaugaaauaaaagaggauauaaacaaauggaagggcauuccaugcucauggguaggaagaaucaauaucgugaaaauggccauacugcccaagguaauuuauagauucaaugccauccccaucaagcuaccaaugacuuucuucacagaauuggaaaaaacuacuuuaaaguucauauggaaccaaaaaagagccugcaucaccaagucaauccuaagccaaaagaacaaagcuggaggcaucaugcuaccugacuucaaacuauacuacaaggcuacaguaaccaaaacagcaugguacugguaccaaaacagagauauagauuaauggaacagaacagagcccucagaaauaaugccgcauaucuacaaccaucugaucuuugacaaaccugacaaaaacaagcaauggggaaaggauuuccuauuuaauaaauggugcugggaaaacuggcuagccauguguagaaagcugaaacuggaucccuuccuuacaccuuauacaaaaauuaauucaagauggauuaaagacuuacauguuagaccuaaaaccauaaaaacccuagaagaaaaccuaggcaauaccauucaggacauaggcaugggcaaggacuucaugucuaaaacaccaaaagcaauggcaacaaaagccaaaacugacaaaugggaucuaauuaaacuaaagagcuucugcacagcaaaagaaacuaccaucagagucaacaggcaaccuacaaaaugggaaaaaauuuucgcaaccuacucaucugacaaagggcuaauauccagaaucuacaaagaacucaaacaaauuuacaagaaaaaaaacaaacaaccccaucaaaaagugggcaaaggauaugaacagacacuucucaaaagaagacauuuaugcagccaaaaaacacaugaaaaaaugcucaucaucacuggccaucagagaaaugcaaaucaaaaccacaaugagauaccaucucacaccaguuagaauggcaaucauuaaaaagucaggaaacaacaggugcuggagaggauguggagaaauaggaacacuuuuacacuguuggugggacuguaaacuaguucaaccauuguggaagucaguguggugauuccucagggaucuagaacuagaaauaccauuugacccagccaucccauugcuggguauauacccaaaggauuguaaaucaugcugcuguaaaggcacacacacauauauauuguggcacuauucacaauagcaaagacuuggaaccaacccaaauguccaacaaugauagacuagguuaagaaaauguggcacauauacaccauggaauacuaugcagccauaaaaaaugaugaguucauguccuuuguagggacauggaugaaacuggaaaccaucauucucagcaaacuauugcaagaacaaaaaaccaaacaccacauguucucacucauaggugggaauugaacaaugagaacacauggacacaggaaggggaacaucacacaguggggacuguugugggguggggggagcggggagggauagcauuaggagauauauguaaugcuaaaugacgaguuaaugggugcagcacaccaacauggcacauguauacauauguaacaaaccugcacauugugcacauguacccuaaaacuuaaaguauaauaauaauaaaauuaaaaaagaaagaaaggaggccaggcucacaccuguaaccccagcuucuugggaggcgggaggauggcuccaggccaaaaguuugagaacaccugggcaacauagugagacugccuccacacacaaaaauuuuaaaaauuagcuguccaggacuucgaggcugauugcaccaaugcacuccagccugggcaacagagcaagacccugucucuuuaaaauaauaauaauaauaauaauaauauaaaaauaaauaauaaauuuuuaaaaagaaaugcuccuucauaauaagguggacacaccccagaggucucuuucuaaauugaccccauuuuaguacaaguuaauucaacacccuuaaaauguuguagacuucccauuaaucuaguuggggcucauuccauuccccccaaaacuacauccauaucuuccuucuuuuuucuuuuucuugcccugucccccaggcugcagugcaguggugcaaucucagcucacugcaaccuccgccucccagguucaagcgauucuccugccucagccuccagaguagcugggacuacaggcacaugccaccacaccaggcuaguuuuuguauuuuuaguagagacagguuuuaccauguuggccaggauggucucaaucuccuaaccucgugauccaccugccuuggccucccaaagugcugggauuacaggcgugagccaccacgcccgacccuuaauuuuuuucaaaccagaucuuucuuuacuuugaaagugucaggcugcuguggcacaaagcccugaagaguuuacaauauauuuugucuaauuaaaaagauauacuaaguaccaccuuauaucuuucugagguuuuuuuuguuuuugcuuuuguuuuuguuugagacagagucucacggugucacccaggcugaaaugcaguggcacagucuugguuuauugcaaccucugccuucugagcucuggugauccucccaccucagccucccaaguagcugggacuacaggcgcaugccaccaagccuagcuaaguuuucuauuuuuaguagagacagaguuucgccaguugcccagguuggucucaaacuccugggcucaaguuaucuucaagccuuggccuccccaagugcugggauuauaggcgugagccacuacacccagcccugaggucuuaauaaagagucuuccaguccugauuugaucucuacccgaggcuauuucuuauuuugaggaucuuuugccugcuagauacugggaaugaaaaauaguuuuauuuuccaacccaaaaaaguucugggcacccuauauuuccucuaauuucugcuauaaguucauuucucucuucccauaucuuauauaaagcuauacgaagccagcugacaauuucaauauuuucgccuggaaaucuccuuagccaaaucuauaagaucauuagguauaucuucuauuuuucaaguucuuacaguucacauuuuuaaaaaauguuuaaguaccauaaaacacagaucaucguaauuccaguccgcaguaacagauacuuuacuaucuuucuguuuucuauuaacaguuguuugccauuuguccagcgucugccaacacuccccucaccacauuaccagccccaaacugccacccaguccccaaaucaaugcuacauauuuuagguuuuuguuauaguaucacuucacuaauaguaccaauuuuuguuucaguuaucucuugcuucauaacaaaccacuccaaaacuauaugucuaaaaagaacaaccaaaauguaucugcuugugauccugcaauuuuggcuucccucagcuggaaaguucaagauggcuucauugacaugucaggcacucaacuggggcuggaaggccaggaugcuucauuuauucuccaaaaucuccgucaucaggauagccugaguuuuuacauguacccagcucacaaguacugaccaagcuccuacuugagcaguauuugcuuauauccuacugaccaaaacaagucacauggucagagucauugugggaggaaacuacacaaaucaaugagggaggccugauucacuauggaaucauuaccauaaaaaucuacacauaucucauacuaaaugaaugggccauccauucagcugacaaucuugugacugugcuuucuguugaucauuuuaaaagcuacagaaauaaaagauaguuuauauuuuaaaaagaaagaaaaaaauucacugacaaaaaaauaaaaauuuuaaagauaacuaaauagucuuaaaagcaaaugacaagcuaaaaaguauaaaacaggcauuuuaaaaaauaaaauuaaaaaaguuuacgaagaaauaaaaauaaaguucauaaaauagaaaaauguuuaauuaaaacuuaaaaauuaaaaaaagaacauaauuauaaaaugauauacccauugguauaauauuguuguggucuuucuacuccuuagcucagguagguccgaguucuugucgcacaaccaggaagaauuaggcaugcagacaccagagagucaguaaaguagaauuuaacaggcgaaaaaggaaagcuuucagccaagagagggcacagagggugggagggguaugguuccccuaucugaaggcagggaaguccccaguguggcuggguccagggccuuuuauauacucagaauggggagaguguguugauugguuugugaguaugcaaaaaauguuaaagcaaagacaccacucaaaggugggcacgacagaguagaaaaccaauuaggaaaggguagguauaugugaaauaggugaaugguggggaucuaucagaggaaaucaugccaaauaggcaaguucucaauccagucugaggauguaacuuguagcuuggcuuucaggcuuuaaacugucuugggcuuggaagggggguuucacuggggacccacccuaucugccuaggcauuuggcugcuuccugccacucucaauauuagaaacaauaagcuaaaauuagcacaaauauaugauaaauaauuuaacagacaaagagaugggaaauaaaacaaauuuuuuaaaaguuauaagacuaagaauucaaaaguuuaguaaacaaaggcaaucaggauuuuccaagcaaaagcaauuaccaugucuagcaaaucccccaacaauuugcccucacccaagacauggagcucuccuuaagaaaaugguucucaaacuuuaguauuuacagaguuuguuaaugcagauuccaagguccucacaaaacgauucuaauuucauaggucugaaauggggcucauuaaucuucauuaauaaguaccccagauuauguaauaaaaaaggcccaaggaccacagcagcuacaaaaggguuuucucaaacaagggacagacuauggggcuccuuauccuucguguugcacuuauugcuugaagugcuuaugacaagcccacauuuaaaauuucagaaucaaaaguuaacaugcuccacucccuuaguuauagcucaauuugagcugucucacccuuguaagcuucccuccagcaauaaagcagcauuuugcaaacuacaggucacaaccaaugagugagucagaaucaucaauuuaauagguuaugaccagaacagaaaauaucagagggcauugcacauaaugauaguaauuacaauuuaaguauuguuacaugaaacuuuuguuccaguugcauguauguguguauagugcaaaauauauuacuuaauaugagucaugagcaaaaagguuugaaaaucucugccauaaagaauaugaugaauuugucaagaagcuaaaaacuuuuuaggagaauaguucaccagaaacacccucaaagucuaagaaaaaaaaaauuuuaaugaucauaauuucauuuuaucauauuucuguaggguuuaauuauucaggcauaucaaugcuucaaagaagaaauuucauaugcauuuauuccagcaucccucugaacuagcaggugagaggauuaugguccccuuucuuuuagaaacuuacagaguagaguuauuauuaacccaugaaauuaauaauuagagggcaguacaaaaggauuuauaaucaugaguuaaacuuacaaugcuguaggauuucuaauaagugaaugacagaauuaaagaaaguuacaugaagaaaauagagcuugaguuuagacuuaaagggaacuucagaaaaagcagaggagaaaagguauaauaaugagucguguuauacagucagaauaggcuaaaugcuuguaaaaagaauuucaaaagcucagugguauaacacaauagugaguggacugacuccacacaaucauucagaaacccaguuuuuucgagcuuguacaucuaccauccccugcggcaucguguccucaacuggauccucugcuguauuguauuauauacauacauauacauaaauauagauauagauauugauacagauaucaaaaucaguauagauauccuguauauuaugauguuuugacacguuaaaaaaaacauuccuagcuggggagacacugccucugccagaccuagccaauucuuccagcuagcaagagcucaaccagaagcaugccuuucauauacaaacuaaccaauccagaaccauaccuccuccagccagcauaacccuggagacaauuuccucugccuucaucuucccaaggccagguaccaggcaaccagggaccaccccuacagcuuagaaucugccaaaauuauucaaacuagccaguccuaaacuguucauucugcccugccuugccuugccuugccugcacagaaaccccaaaaaggcuuuggccuagcugcuauugucaucugcuuccugaccacucuggugucuuucccauguggccccacauaccgugcuuuaccuuccugucucuaggaccuguaagucuaauaaacuuuguuuuccugagccucuccucugucugcucuaguggccauaccuaacuaaccaacucauaaaagaauacaaaacaucugccuucagccagcagacagaggagagagcauggaggaucacaaagauuuuucaugggccaggccuaaaaauggcacuucacuuccucccauuuuccacuggccagaccucaguaaccucugauaucaggaaagauuaaaaaacaggacaagaaaucauccauucaucauuagucaucccucuuacaacuaaaacacccugaacauaacaccacacacaaaaauauaggaggaucugcaagguggaaagaagauaaacuagaggcuaggaaccacaggacuugagaaaugacaccaucgcuccccuggacuuucuuuuugcuucucauauauccuagaucaggcacuagggaauccugcaaccuguagcuaccaacaggccaagcaaaaaaaagggccugaagacgugguggccaacaccuguaauccagcacuuugggaggcugaaacgggcagaucgcuugagcucaggaguuugagaccagccugggcaacauggugaaaccccaucucuaccaaaaauaccaaauaaaauuagccaggcaugguggugcaagccuguaaucccagcuacucagggggcugaggcacaagaaugucuugagcccaggaagcagagguugcagugagcggagaucgcgccacugcacuccagccugggcaacagagucucccucuguugaacaaaaaaaaaaaaaaaggccuuaagaaaagccuacucucucuagccaaaggaccaggaaaaggaagaccuagcagaacagaaacauuuuugcuaauaaccauccuaauccagucaaacaucaaaggaaaaacuaccccaccccaucccccaacaccauggugucagcagggcccagcaaggagcuggacuucuaaccccacucagcaauuaggagauggggcaaguaggcccuucacuuccccguaucaggugucaaagagguggaaugagagugcaaguggugccaguuagcagcccacuuuccccaccccaguuaguugagcaauuucuuuagaaguuaaacauaaauguaccaugccacucagcaaccccacuauuacguaucugcccaagagaaaugaaaucauguauauacacguaacuguacacaaauaucuauagcagcauuacucacgauaaugaaaacaucaaaacccaaacauuuaucaucuggugaguggagaaacaaaaugugguauauucauacagagaauacuuuuugcaauaaacagacacaaaaugcuaauacauaguacaacauggcuaaaccucaaaaaaaucuaguaaguaaaagagccagucaggaaaaaccacauuaguaugguucuauuuacaggaaagguucagaaaaggcaaaucuauaaaucagaucagcaguugccuaaggaaagagaugggagugaggauuaacuucaaacaagcauaagguuccuuucucaggugaugaaaauauuuuaaaaccggguuaugguaaugauugcaugacuccauaaguuuacuuuuaauacuauuuauugauauuuuauuauauaaaacauaauuuuuaauaaaaaauucaagucaucccaaagcguucuacagauucaauugcacuaucuuuaaaacucugaugucauuuuucgcagaaauacacaacacaauccuaaauucauauggaaccacaaaagacccugaauagccaaacaaucuuaagcaagaagaacaaagcuggaggcaucacacuacuuaacucaaaugcaaaauuauaguaaucaaaacaguaugguacuagcauaaaaacagacauauagaccaauguaauagaauagagaauccagaaauaaauguacacauuuaugaaaaaucaauuuucaacaaagaugccaagaacauacaaugaggaaagaauagguucuucaauaaauggugcuuggaaaacugaauauccacaugaagaagaauaaaaucagacccuuaucucacaccauauacaaaaaucaacucucaauggauuuuuaaagaugaugccugaaacuguaaaacuaccugaaacuguaaaacuacuagaagaaaacauagggagaaaagcuccaugacacugaucugagcaaugauuuguuagauacgaccccaaaagcacaagcaacaaagcaaaaauagacagcugagcuccuaucaaacugaaaaguuucugaagagagaaggaaacaaucaacaugguaaagagacaaucuauggaauggaagaaaauauuugcaaaccauauaucuaauaagggguuaauguauaaaauauaagguacacaaacaacucuauagcaagaaaacaacuugauuuuaaaauaggaaaaagaccuguauagagaauucucaagacauacaaauggcccagaagcauauaaaaaauauucaauaucacuaauuaucagggaaauggaaauuaaauuaaaugugcaaugagaugucaccucauaccuguuaggaaggcuauuaucagaaauucaagagauaaauguuggugagaauaugcagaaaagagaacccuugugcucuauugguaggaauguaaauuaguucaaccauuaugaaaaauagggauauaucucaaagaauugaaaacagaacuaccagaugaucuaccacucucacuucuggauauguauccaaaggaaaugaaaucaguaagucaaagaaauaucuucacucccauuucauugcagaauuauucaaaacagccaagauauggaaguaaccuaaaugcucauaaauggaugaagggauaaagaaaguguagucaguguggguguggguuucuguauauauaugagugcguguggauauucuucugcagguguauauauacacacacacagugguauauauacuaugaaauauuauucagcuuuuaaaaagaaggaaaucuuguuauuugugacaguguggaugaaccuagagaacauuauguuaaaugaaauaagccaggcacagaaagacaaauacugcaugaucucacuuauauggguaaucaaaaaaagcuggacucacagaagcagagaguagaauagugguugcaaagagcugagaaguagggaaaaugagaagauguuggucacaguauacaaaguuucaguuauguaggauuaauaauuucuggaagucuaauguacagcaaggugacuauagcuaauaauacuguauuauacacucgaauuuuacuaagagaguagaucuuaaauguucucaccaccaaaaagaagguaacuauaugaaguaaaggguauguuaauuaguuugugguaaucauuucauaaugucuacacauaucaaaauaucauguauacuguucucacucacaggugggaacugaacaaugagaacacuuggacacagaaugggcaacaucgcacaccggggccuguggugggguugggggaugggggagggauagcauuaggagauauaccuaauguaaaugacgaguuaauggguguggcacaccaacauggcacauguauacauauguaacaaaccugcacauugugcacauguacccuaaaacuuaaaguauaauaaaaauauauauauaucauguauacuuuaaauauauguaauuguugccaguuuaccucaguaaagcuggaaaacaucauuacaucacuuacaauggguaaauucaaugguauauaaauuauaccucaauaaaaauguguuuuaaaaaguagauggacuggcauaaugaaccaccauguaauccaucaccuagagccaacaauuauggauucauagccaaucuuguuucaucuguaacccuucuacuuuuauucuugccauauuauuuuaaaguacaucucagcuauuaugcauuucacugcaaauuuuauaauauucauacuaugaggauaaggguuuuuuuuaacauaacagcaguaaauaccauuaucaccccaaaaaacaauguaucaaagcacaagugauauaaguagugcuuugcuugaccauuuuagauaaucucuuguugcuuucugcuauuuucauucuccucucuuucuuucaacuacauuuaguaucugauagcuccaauuucuaaagccuuuaaagucuaguucggcuaaugguugcuucugacucucacuuacagagcucauuuucucaugcaauauuuuuacugggauauaauguucaucaaacuuuaucuuugggauucuauaaggccugguugcaagcugcaugugcccagggaauuuggugccugaggcugcucuaaacccaggccacuguaaauuaauaucucaguuuaggguuuuucaggugcagugaaugugaauucaaaccucaauuccacaucagggcuuucucucucagagccuagacaauuuuucuuacagaacagauuuuugcuuuagucuacccauuuccuaaagaugugucucuucuaugguccugacuuuauuaagaauuucuguuccaauuuccugccuucuaugagccuauggccuugucuucugauccccauguggccauugaaaccaaaagcucuaaaugaccaggaauugacaaauauccaugugacagcuacugacuuuaauguauacuuacugcccuggaaauguauucccccuuauuguggucucugagaauuucccuugcuucccugcaaguuaguuacacauuuuuaaaguuuuuaauguuuuguuuuuaauuuuuuaagaguuuugcacugggaauauuucaagauguuucaucugcuauauuuccagauagucuaaucccuucuuauaaacuuuaaaaucuuuagacuuuuuauaagagaaacguaucuuccaucaaccugagcggcacaguuuaaaaucuuuuucccccauuauaacauaaagcuuaauuucuauauuuaaguccuaaauguacuacagaaucauaccaaaauuaaauaacuuacuaaguacaucauuccauaaaccaaaauaaaauggaauaaaacaucacugugagaaggaauaguauaaacaggcaccaaaacagugacaaggcacaacuuuuauuaguuauuauuuagugaaauggacagcacugucagaguugguucaagccagaguuccaaaauucaaugauugucugagcuuacguaaaguaccucaacugucugagccucaguuguuucaaauguaaaauuuagaacuugagucauuucuuaauguauuuaaagcucuauacuacuaugaauaaaguguuaaauuuuaaaaucagcugaagaaaagcauuaauauaccaaucagcaagcaucgugacucaggaagaauguacaagaguaucaagaauuaaaggggcaugauguaugcaaccuacuuucagaugguuuaauaagauuuuuugaggguauauauucauacacgcauaaauacagagggagaggaagaggagggggaggaggaggaagagagagagaagagggagggaaaaaagauaauaaaauaaauauacuaaaauauugaaacugguguaucuggguagagaagccauaggaguucuacgcacuacucuugcaacuuuuguguaaaucuaaauuuacaacaaguuuuuaaaaaguguaauaaaguugguauuuaaauaacagauauaacccuggcuauauaaaacagaaacacauaguuauucuaucaugggaagugaagaaaaauccacaaagggacauuacaaauuuaucacucaccaacuguuucaggaacacacguuuguugcuauaaauacaaagucucuauuaaugacagguuacagaacuauguaaaaacucauaacucauccuaagggguaaaacaucaggugagauuucugagccaaaaguaauuugggcagaaagcacgcaaguaagccaauaaagcauuccaacauuaaauccugacuuccuuugacgucagccccagcagaccaaggugagugacgacacagagaagucagcacaggaggaaaugugugccagcuugugcccaguaucuuggaagugcaaauuuaccagguaacauaaaacuccauaacucuaucuuaaaugcugguauauaaaucacaauguaucucuuuucuuaagagucuguauccagcuucucagaguucaaaauaaguuacaagcaauaaugacuguugaguauuauuaagcugacuguagguuaaaauuuuuuaaaaaaaacauagauugaaagagagcuugcuuuuugaugauacuuuuaauuucaaacucagcaggaaacaagauaaucacagguagcugaaagucaagacaauuuaaaacccauaaauguauguuauugaugaacaaagaccucaaugcuaauuaaacugcauuuuccuucauauucuguaauuuccuaauauauucugcauacauuaucucuaaggucugaccuagagauacaguauuguguagcaguguuuucaaguauuuuugcccucuggccaugcaaaugaaaaaaggaaaaugguacacuauguaaaaauuauguaucaauugcaaaaaaaaaaaaagauaaugacacaaaauuauuuauuuuacuuacuuuuuaaagucuuaaaucuuaguuuuaaauguggaaagcauauaccuuuuaucaggaccagugaccccacugcaggaauucucacucaaauaaaaucuaaaacuuuggcaugaggucauuaaacuauuccuagggcacccuuuuacgcuaaaagccucuguaagcgauuaaaguucuaauuugaauaauuacauuccaccuacauaaauucccucuguaguuucaacuguaugcaauaucagucuucauuuccugaauuaaauuaaugucguguaauguggugcuucuuuuuuaaaaaaagaaguacaucuacuuucauagguaaccuuucagcaaccaguaaaagugauucaugugcaugaggggaauaggucaguaugaauaaucauuaaccaacaauuugugccagcauuuauugugucgagcauugcaaaagggacaacucauauaaugaaaugaaugcagcuauacggcuuuauaaaaaucaaauauuuuauaaacuaaauccuauuuuccauugaauuuaccaaugcaucauuagaaacuuuauuuuuuauuuauggcuugccuuuaauuagcugauacuucccauguuugaucacccuuaucuuucuagucaaauacuuaaugaauugcaaauuaauacugaaaauccuaacuuaaaaaaagaaccacugaguaguguuuaaaaaguaaauaaguauuucucauagagggaaucuuaaaaacaugcuuccccuaaucacaaaccaacagaauuuuugaaagaccgaaaaacaauucuuacagcaaaauuuguuacucaaagugaauuuccaguguaaccaaaacaguauuuauucaauaaacccaaaagacuaguauuacaccucccuuuaaugagauuuaaucuuucgauccuuggauauuucuuaaauaaugugucuaccaguugcugagugaccuucaagaguggcuuuucccagaguaaagaaaaacagcuguguuccuugcaggaugcucagugacuuccagagaucuccacaccaugccaacuauuucaguccuugagucauuagagaaauuuaaagagaagaauuuaucccaauugucaaaaauucuguugaaccccaugacauaaacguguuuaguugaucaaagcuguauaguagcaaagaugucuucaaauauguugaauuaguuaaucccuaaaucucauuauuauaauuucugcucuuaaagaauuuaaaguaugauuuacuggcaucuagugaaacuguaaauuaaauuaucuauuauaccuagaguuggucucaaauucaugaaauauagauccaauuguaaaaacauauuuuccuuucuuccuagaauuccauucuacuuugauucugaaaauagcauccucuuuccucuaggaaaugucaccuguacuccaauccccaauucccacagaacaaugugauucaaagagaugcugucauuuucuuacagaucacuuggccuagccacaggcuugggguguguacuuguucaaagcuggaccaaucacgguaccccauucugguggccaaaguugaucuguauaguuguauagauaagggcaugugacccaagcugaauacaucacaguccuuccccaagauauuccacacugaaaucaaggcaguaggagcaaucucucucaggcggugaagaaacugggcaugcgagcugccagcagccauguacccugcuaugcagagaaaacuggucugagagaacuaagccaagaugcagagaagaacuuaaaaaagacggagcacuccagcggcauccaaguccuggcucuaguugucccugacaacugucucacucgugccuuccuuguguguauauaauaagccuuccaauaaauccccuuuauaccaagcuauuuuccuauuaccaguagccaaggaaacuauacaauauaccaaacaaauucuaacauaauacauuugacuucuuagggauagggccuaggaauacugcaagaaauccuaauaccucugcaaauucaaauauaucuaaugcaaaccuggguuuaauccaugaaccgacauuuagaaauaacaugauuuaacacuuucuucacugccuucuucacuggggauaagccuuguccuuucauaaggcagucaaggucuugugagcaagaccuguaucuuauauuuugcaaugaauugcucucucagcacaagccaugaacauagauguucaguaggaauauauuaggcuaaaaauaugaagauugggauauuaugauugccacaugauccucuggaauaucaucagauccaaaguaaggagauuuuguguucuggaaaaguccuucuuagaauagugauagcuguauagcaagacagcaguaacaaaauugggggaaaaaaaaucauucuuaaacugauuauuuguuaccaaaagauacaugcuugugaauggauucaaagggauccuugggaccaaaaaggaauguggguggcugugaagaaggcaguuuuaaucugaaaugaagaaucugacuccaaagcucagcaaagaaagucuacguuucccuaaggauugagucuaagacaaggcugcuaggaauucaagauuaaagaggcaacgaauguaaaauacauucuaucuuaaacauauuaaaguguauuuaaagccauaugccuauaaaucuuucuuucuauguuuacuguaccccuacauuaagauauuuuggcauucaaaguaagugaccaguuugcuuugggcuggugauccacuauggagagaaccugaaagacacgguugagagcagaaucuucugcccaagaaaaggcccuaaccaugcucaaaugauggaaguagaauauaaaggcaguccuguuuuaaaaauguagcuuuucccaaagaagcuaaaggauuuccugaccuucuguaucugacuaccagaacucagggagaaguucaauaccauaauuauaauaaauaaagcaaacuaauucuaacuccuuaaagcugauaacuaugcccuuaacuaguucuaacugaaacaaaaagaaaaaaaauuaagcugguuauucucuguauaauuuugauuuuuuagaagcuuauauauucauuuuaguuauuuguuuuauacaacuauuuaccacaacgcaugaacuuaauacauauugauaauacaggaaaccaaauccuauaacaaaaugcaaauucugccuaacugcuuaaacuuacuaaaaaagcuagguucuagacaucaacuuuaggacaacauaauuuucucuaaguuauuccagaagacuauuugcauaaaacuuuuggaaaucuccacuccaaaguucuuccacuguaaacugcacuuaaucuuuucaauuagcaacaugcuuaaagaacacaauacaauaucugggaucaauggucuagacauuucuacaaacugaaaucauauaccuauauaacaagagagcaacugauugugacucaaacccaucuugcaacuacacuaauaauuuggcauuaaaaggauauucuaauagagccauauucacagaaaacagugucauuuaguauaauuucuuaagaaucuccauuuaaaauucucagaaaaauuuaaacuacagacccagagaacugauaguuacuuuuauuaaccucuccucugauuauaauacgacuguauuagaagaccuuaagaacaaauucaguaaaguaaaauuucauuucaaugccuuuuuauaaccuuucaguucccagaauaggaauaauaauuagcacucucauuucuagugcuugaaaaacaaugaaguaugugcuuuaaagaacgaaguuauaucauuuucaccugcaucgaugcuccuucuacucuugccacacaggcgacccgauccaagaaagucacugccacaggcaccgccacaaagaagccuuuacaaaaggccuugauguaucuuuucacccacccuugugacugugccauaccuaaaaauacaaagaaaacaacuaugaaauuagucucaagaaaggugaaaaacaaagacauaaaaacaguacaugaaaaguaagaguuaccgaagggcaaucuugucucuuaauauauuacacacucauuccuguaaccauuagaauaaaucugacuuacuuaaaguccuaaagugaaauacgugaacucagguuaaugcuuuuccacaacucaaguccacuugcuaacuucagugggaaauuucuccccacaaaacaguaaguuagaaaaaaacaagcauuccagaaguaaauucuuuucuguugcuauuaugaugaaguuacuccuuauaccccugauaucuguucucuucuacaguaauaaaaguuucaguggaacauguggcugcccaacuaaagacuguuuuccagccucccuugcagcuaauugugaccaugucacuggauuugaucaacagcaugaguagaaaggauauaauucuugguugcacccugaaaaggaggaugcccucccuuuucuuccccauuuuauaacuguaauacuaacaauuuggugguaggagcagggguggccaucucaaacuaugagauaaaagcuucaaguaaagaugacaaagcaacaaaauggaacgauccuagguccgcaacaccauggaggcaccauacuguccugcauugcuuacauuuggacuguuaaaucacagauaaaucacuugcgcuguuugugguggcaguguugguguuguuguugucguuguuguuuuuagacagggucucacucugucacccaagcuggagucuuggcaagacuuuuuuggauaagacuucaaaagcacagucaaucauagcaaaaacagacaauggagauuacaucaagcuaaaaaguuucugugcagcaaacaaucaacguaaugaagagacaaccuacagaauggaagaaaauauaaggaaacuauacuucugacaagaggcuaauauccaaaaacgcauaaggaacuccaacaauucaauagcaaaaagacaacccaauuaaaaaaugcccaagagcuuaacaauaauuucucaaaagaagacauacaaauagccaacagguauaugaaaagaaugcgcagucaugagggaaaugcaaaucaaaaccacauggauaucauuccaccccaguuagaauggccauuaucaaaaggcaacaagugcuggcaaagguggagcaaaaggaacccuuauaucuguuuaugggaauguaaauuaauauggccauuacagaaaagaguauggagguuccucaaaaaguuaaaaauagaacuaccacaugauucugcaauccuauucuuaggaauauauccaaaggaacugaaaucaguauauugaagagauauuugcacucuuauguuuaucacagcacuauucacaauagccaagguauggaauuaauccaaguguccaucaauggaugaaugaacuuuaagaugugagauacauauauauauauuauuucaccauaaaaaaagaaugaaauccugccaucugguacaacauggaaaaaccuggaggacauuaaguaaaauaacccaggcacagaaagacaauauugcacgaccacucauauauagaaucuaaauaguuaaacucauaaaaguagagaguagaaggguaguuaccagaaggugggguaguuaguggggaggagagguuggggagauguugcucaaaggauauauaauuauauuuaggaggaauacauuucaggacaucuauuguucaguaaggugaguacaguuaaugguaagauauuguauucuugaaaaauguaaacagaguggauguuauaugcucuuaccacaaaaaugauaaauauguuagguaaugcauuuauuaauuagcuagauuuaaccauuccacaauguacauguacuucaaaacauuauguuguauacaauaaaacucacaauguuaucuguucacucauaaaauaaauaaaaauaaaaauacucaaccacuaauucccucccaaaucuuuaacaugucacaggaaaaagaugaaugauaaucuaaauuggcuaauucugaauuaccuacuguaacugacaucaaugagggcuauauguaugcaagguaaguaagaccaguacucuuguuuuuuauacuuuuaucaacauauauugcacauaacauucacccaaaccaguaaucuuuuuauaccuaaucaaaauaauguaacucagacuaacuuuagaauauaagcaauuuaaaaacauguuuucauucaaacucaucuaacaacuauaaucuuaaguuaaauugcuuaugaguucacacaucugguacucaagaaacguguuuggcccaagguacugauuguuucugcgagcagucuuaaccacuauauuccuaaaagaguaaaccugcuugacauguuucauucauucauacccagcuuuaaugugagcccuugagugaaacuaauuucucuucaaugacgucuuuugccuagaaucaaaacaccuuuacuaacucauuuuauauaucucuacaaaagauuuaauauacuuuuccaauggacuauuuuacaaagaucccauuuaucauguacuaccuccauuaauauaaaagaauaaccuugacauauuuaucaaaucaguaccuucaagaugcaaaagaugcauuuuccucaauauuagauuucauuagcucagucucucugaaaacacuucuaaccacagguuuagcaacacaaacaucagucuuauaauaaauuuaaaaacggaaugaccuccacaucuauucuuuuuauuguuuccaaaauauauauaaauaaauaaauaaauccaaagauuucagauuauaaaauaucugaauccacaaauaauuuauaaaaugcucccauguacauaggaaaaaaaauaguuacuacguagaagagaaaggaaacggcucaacaguaaauaaucaauuccucuuugaccaguuugauagcuucaaaguuauuuuaaguggucuacacuuauguuuaagucauauacaacucccagauaauaauuccaggguaguguuccccaagcuugccuugacugacaugcuuaaaaaugaagauccccacuccgacucagaccuccaaaaucaaacacuucaggugauucccuuaauagagcaagucuggaaaauacugauauuuggguguuuaaaggucagcuguuuacucacuccucaaguuuauuaccuucugaaaaugaaaacaggggaaaaguuagcaaagaaauaucacccugaaugucuccucacauuuaguuuaccuccuuacuagauuaagaaaaaguaucugcagaacaaacauugcacagaaaaugaacaccacuaccagauccuacuuuguaaccucuacgugguuccaucagaaaaugacuuccaguggauuuucucuuugccccacuaaggcaguucaaucauccauccacucaucuacccagucacuuacuaccuggcucauucauucuuucaaccaguauuuacuaacggucuuccacaagcacuguguuagguaccagggaaucauaaaacagugaacaaggccagucccagucccugaucuuaucaaguuuuuacagucaacuauggagugauaagggucaaucugaaaaucacauaaacauacauaagaguuguaauaagugcuauaagagagauacacagaggucaggaaaggucuuugaggaagaggcugaacugaaaaaugaggagaacuucucuagauaaagaacuguggguaggcaaggguauuccagagagcagccaugucacaugccaaagucccugggucaggaguggccauguugugauggacaacugaagggaggcuggugcagauaaagcacacaggaaguggaagagcacagugggacaugaaugggaggaggcaauguaaaucccagagcaguuaagaccucacaggccccguaaggauuugcagcaaaugagaaguaacugaaauguucuaaaauugaggugaaugauccuaucugcauuuugaaauaaucaucuaucugaaagccuggauaggacaaaaauggauauagggaaaccacauuauucuagugguccagggcaagagaugauaguuggaguagcaugauaguggagauggauuaaaaugggcagauuuauguauauauuuuggaaguuaaacugacaggaucuggaaauagauggacaauggugggagaaggaaggagauaagaaagugucaaggggccgugguagccugucaaagcacugcuauucuguuguucucuugaauuacaugucaaaauauuuaauacuaaaauuaugcucauaauuccauuccucaaacuuuuuuuuuggcaaacaagcagaugugcucccugcccucaaggaguuacaauauaccaaggaagacugcccuucaacaauuauuuccaauggaugagcauuaaaagggacgauggcccugaagcaugacagcaugaagcaaggcugucuauucaucagaaaaugaucaaggaaggccugccccacuccacccccacccccaaaaaauggcauuugaggcaagaccucggcauuucagguaaaagcaguaacauauaugaaggccuaggggcaaaauaaaauguagcuguuuaagaaacuaaaauaaguucaguuuggauagaguauauacagaauuuauuacgugaauuuuuaauucaguaagcauuuauuugcuaucaagcagcaaugcuaaguacagaggauauaaagauggcuaagcauacaguauaguaccauucaaaaacucucacuaaacaauaccuuacauuucaacauacauuuauaugugcacauaaaaguauuuaaaauugaauauuuauauuguuuuaauuguuuaauaaccacucauauguuacuuguguaauuauuaaaguauaccaaaagagggaagaaagcagcaucaaaaugcuagcagugguuaauucuauaugcuaggaauggagacgauuacuauuuucuucuuugaauuuuugcugguuucuaaaacagaaagaugguaucugcccuaggaagucacuaugauauacagauaauacgggguaacacuaguguuaauuucuaucccaucacaaugaacaaaccacacucucaccccaaucucugcugcucuaaguaguacaaauaacacugagcaagauucuuuccuguuuaugcagcaaucaauauauuuaacugacuauaauguuguuuauguagccagugcaggcuaucuauauuucuggaaacuucuggaaaguucugucaaauauucgcuacuuuuauuuuaagaggcacagaauggaaacaugucuucucuuugcuguucaucaugcccugcaugcauggaccuucacaaaacagcugaggauaccugcaggacagaaacggaaugcuuccaaauaugaugccacagcuaucuuaguuauaagguaguaugcaugauuaaaauguaaauuaagggggaaacauuaauaaaaguugcauuaaauucacauuuccugaauugugagccuccucuucuuuuccaguaaugcucuccuacauuacuucuacuccauguagucacugguccccaaaaaggagcaugguaaugagacucaggagaccugagguagauaucugucucugucuauaaccaguuccaugacuuugaacaagucacuucuggccuguuuccucaugugugacaagaaggggcuuauuugggaggccaagcaagagggucacuucaggucaggaguucgaggccagccugagcaacacagcaagacuuccaucucuaaaaauuuaaaaauuagcaaggcaugguagcauacaccuguaguccuaucuacuugggaggcugagguggaaggacugcuugagcuaaggaguuugagacugcagugagcuaugacugugccaccacacuacagccuaggugaccaaacaagacccugucuccaaaaaggggggggggguagauuuaauaucuaagguucuuucuaagccagaauucuuuauuucuauaacuuuuuauugucuuuuaacuguuucuuaagaacuuuggcagauacuaaaacaaacacugagaucacuauugacuaagaaaaagugaguugccuuuaugguuugagacuuuuuuaaguauugaaaauaaaagagaauuaacuuuuuuuaaacaacugguuaaaagacccaacagugagggagcugaaaccagugccaaugauguaaaagaacauuuuaaauauagauaaagaccugaacaccguugcucuuucacuucucauuuccacaaccugacugcugaccagagcauugcuaccaucgccugcacaacaaagucagggcaaguguuuuucugagagauuauaaaggagcaugugggagaugucucaaucugauaugugcugauccugcuccaagccaaggaagcaagagcaauaaaagcuacccuggaaacaagguacaagugguugcuauuuucagaggcucaaaagaaaacgcucaauucaguccuguuuuaucugaauugugaggggcaccuauauuucauaauaauaaaacacuguuaaaagcuucuaucauguaaauacuaaagaagccauucauacaugaagaaaugaacacaacauuucuauguugucauauccaauaauuuucuuaaaguuuuauggcauucacauauuggcaaaguuaaugcaccuccuugucuauguaaauugccaaagaaucauucagaugauccggucuuuuguucacaccuuaaauguuuaaaaccaccacaguaauaaguaccuagccccgacuuccucugggaaaauuucaucuaagcaauaacaaucagguacuaaaaucacccccagcaaaaagggaauaauuuuuaucaguuaccucauucuucuuguaacuauggaagucacugagguucaaaacacugcuccugagaaaauuauugcuuaaaauuguaaguacacccaguucauuguugaagugcuuaaacugagaauauuuuuuaaauaagcuuucagaaucaagugaaaccauauuugccaccuggcauacagcacuuacaagugagaguuucuuggugaugcugaccucaaccacauaacaacccacacuguaaauuucucuccuucccguaacaacuuguggcuugaucaugcauuaauucaucuaaaauuguucuuaagccugcuuauauuuuagcuuguacaaagucaccaaucacucauccauggcaaccagguggauaaauccaccacaagucauccuaauuauaaaaacuauuuaaaaguugugugggagguuugaagguaagaggaaaauaauaaguuauaaagcaguaucuuauguaaaauguaaccuuucaaucaucauaagccuacacaaaaucaagauuuuauuuauaaagaggaaaccaucaaacuaugaauaucagagaacacaagaguagggauccaagcaaaucugacacacaauuccugaaucagucaguauauguguaccuaccaugcaccauggaauugugcuaagagauaaauauguguuauagaacaaggucagcaugguccuuucuccacguagaguuugcauuuucauucuuucaacauuaagugccuacuuugugcuagacacuauguuaagacaccagauugaccaagccauacuuccuccccagagggaccugugacaaggucacaagaaacaaguauaugaccauaaauaauccagcuaucauccuccacggaucuuucuagcagccccugguaccaauaaccuggcucggcaaacagagccuaagcaugugaaaaaucaggagacauuuggauacauguggucuaauacaaggauaaaaaagaaaaacugaugaauuacaacaauuuugguuccacuggaagcagauccuggcaaguaaucuauagaaagcaauuuaaaaaauuuuuucaggacuaucuugcuccuuucacauuauaaguaaacaauauuuuauaaacagacacuuaguacucuuuagaacaugaauaccaguaucaaauucuuuaucuuuagucuugucugaccuaguaguucucacuugaaaauucucaggaaagaccaaaauggcacauacacaaaaaaagaaauaagaaagaaagaggaaaaccagccaaaaauaauaaaggaggagaaauguaauuauguaaggcauaaaguuagucauuuuuuggcaaagauacccaauaaaaaagucaacacugauacaaugaugaagcuaagcccuauaaaauugcuucuuucauggagauaauugugacuuucuguugguaaacugauaagcaucuggauacuaagagaagagagguuaaaacugauguauucaaucuuaagucagcaauauguaaaaacaaaugaauuugaaggucaugcucuaguacaacugauguagagagaaaauacaaccaggaaacaacuaggauacagaaauucauaaaggcuuccugauuuuugguaaggacuccuucaacuugcaaacaucaugcauuuaugcacacccuucccucugauucaguggaaaagcaggccccauccuauccaaggugcucuucagaagcagcaucagcaaagagggaaagucagugaaaaccuggugggcuuugaauccaagaccucaguucaaaucgugauucaacaguguggaaauuacuuuaucucaguaagcaaaauuuuucaucugugaaaccuugcaggguuuccagagguucaaaauguucauauguguuuguuuucuuuuguuuacauaagcauuuguguaaagaaaaugacuagaucaucaaauaaaggauauuucuucagauaaagcacuagcuaugucuaaggaagaggacuaguaauaacaaaucaaaaaaggauaacagaauuaaggauguccauuacagacaauaaaccaauaaagcccaucuucuaggugauaagacaccuaauacauaaucauuuuguucugcuuugaaccucaugcuguucuaagauuugaccaguuaggggcaaucauauguacugauauuaaccaguuaacaagaauguauucagcacugucuuaggugucuugagauuuuuuuaaaagcaaaauaaaaggaaauauaagacuuagugccagaauuggaccacagggauagauuauauaauauucauugaggaaagaauaaaaaggaagaaaacuggaauuacaggaaaaaaauucaugaugagaaaggcuaaaaagaaaaaaaaaggaauuagaauguaggugguggguuuaaaaauguucauuauaaaauucuuagaauguuucuguauguuuaaaauuuuuccucaaaacuuuggaaauaaaagaauaaauuacaucuguuaagucacucagauaaaagaaaaauauaauuagaaugaagaugcauacagcccaucugagauagcaagaaugcuggccagaucagcgaacaggaccuauauuaagacaagugagacauaagacugaauauuaauuuuuuuuuuuuuuuugaggcagagucuugcucugucacccaggcuggagugcaguggugucagcucacugcaagcuccgccucccggguucacgccauccuccugucucagccuccagaguagcugggacuacaggcgcccaccaccacgcccggcuaauuuuguuuugguauuuuuaguagaaacaggguuucaccauguuagccaggauggucucaauuuccugaccuugugauccgcccgccucggccucccaaagugcugggauuacaggcaugagccacugcguccggccugaauacgaauuuuucuuguuuuaguuguuuucuuuuuuuuuuuuuccucaucaauauggacaucuucauggcuccaguauuuuuggaaaccauauaaagcaaaauccuuuaacaauaaucuaggacucucuaagaacuggcucaggccauccuaauccuauaaauuauccuuauccuguaacuccaaauagacaccauuuaacagcauuuacaaccaaggccuaaucucaaauuucaguuauuaaaaugaaauaaauucugcaaaaaguuuaccauaaaaauuaauaagacagugaauagcuuuuuacaggagaaaaauccuauuaaaugauaaccauuagcacggagaagcuugguaagcuuuaaacccuaauaaccacaaaauuuggauuucaacacuguacuuuauuuuuuuccaauuuaauagaaaagcauaacugcuaucauuaaguagaagcuaaaggcaacgugaauuuuaagcuaacaaugugaggacuuaaauauguauauaaaugaaacagaccagcuacuuauccauaacccaagcaaagcaauuagaggauacuuuucaccauaaguccauuuuuucuugaaguaauaauacaguggguuaguaaaaggauauauuaccagcaucaggaauacuuacugaauagcuaagaagaaaauacugcauuauuuggcauuugggcuguguucaaaauuggcuuuaaaaaaauuaagaaggccuauaaauggaaaaagcacucuuuuuagaaaaaaaaaaucucaagaaccuuucaaaaaucaaaacuuagaagaagugagauaggggaaauaagaaaaagguaguaacacucagaaccuaaaaaaagaaggguacaaaauauuagaaagugggcauuaggcaauaacaugaguaauggaaaaguaucacuagaaaccaugugacagccaguuuccaaagcacggucauccaaguaccaagcuuugcuguuccuuaucuacuuugcuaccucacauuuuuuccuacuaucugacacugcuucauauucacuucucuuacacugcagcccuacuucggucuuauuuuagaaugguacaagggucuuauuagggcucaacaauaagcggaauugaaaaacuuuuuuaaagaacaugguuucugggucucaugaaaauccuauccugaucccuacucuucaugccucaaauauauugcuaucuauacuagaaugcaaaugccuuuacuagaaugccauaucaacucaagucauacuuacaacauggcuuuuccuuugaucaggguugggaguaaggaguaggaaggcuucucaaaagaaucaggccacuagaccccaagggacaaaaauggaaagagaaagucacaaaaaaguaggacugaaaaauacaauuuaaccagcaaacuuauagcuagcccagggacuauuacuacucuuuacaaaaugauaaauacaaaaaaauuagaaacacaggcucccccaucaggaaagcacauuaaggcuccaauuagucugucaaaaauaaaaucuauucagacuauggcuugaagauuuggaaaggugcccacagcccauguauggcagcugcaaguccauggggaguucaaacagcaacagugcagagucaguacugaagaugcaagccagaggaaaagauuuaugcaauuuaaggugaaagcaacagaaauaaacucccuuggaaugagugcuuaugguccuuuuagcuuauaagugcaaguguacccacaaacaugcaugcacacuugcugaaauggcaacaaaggccaaguuagcagcauauguuaaaaaagaaaaaguaaaaauaaauauauaaauaaauagaacagccaagaggccagaguauaaagcagcucauccugaguggccuggagauaaaagcagauggagcacagcauuacccagacucaagugucuguugcacaaaaaguccagguauuauaacgagccugugguauuacagcaaauggaacugcgaucucauuuagauuauucuccacucuuauaugccuuguuuugauuucugcauacuugccuauaaauuggaagacacuguuuuaagauaccugugaaauuucaucaacuguggcuagaguugaaaucuuaacuucaaccuuaagagaaacacugaaucagaacuacaaagcugacccgcuccuaaauuucugaugauccauggaaacugugugagauaauaaauguguuaagccacugauuugggugguuauuuguuuugcagaaaugacuaauacaauacaaaaugcacaaaaagacccaagggcgcaaagaaacuugguauuugauaaagucgacauucauauugggaagagaaguugaauuaacaaguuauguugaaacaauuagcuacaauuuggaaggagaauaaaaucaaagcuagauauuuauuaaauucauuauaagaaaauaaauuccagauaagccaaacauuauauguaauaaauagaaauauaaaaauaacaagagaaaauaaaggcaacagucuuuuaaggguagaaagaggucuuucugaacauuuuacaaaauccagaaaacaugaaagauaaauacugauagauuucacuacauaaaaaucaaaacauaccauaaauaauguuaaaagacaaucagcaggacauaaaaaauuauaauaucaguaucucuaaaauuacacaauucuuauaaaguauaagaaaaaagacaauaauuuugagagaaagguauuucacugaaacaaaauauggacaguauauaaagacauaaaaagauguacaaacacacuaauaauaaaaucaauauaaauaaaaacaaaguacuacuuuagucuaucaaacugacaaauuuaauaugguaauauguaccaaaauguuacaugaauauaccuucugaugcagaaacaccacuccaggaauuuauuuuauggaugcaaagauaugaucaacgauauucaacauaccauuuuuauugcagugaaaaaaugaaaacaaccaaauguucacaaauauguaaauaaauuaugacaugcauacaguagaguaaucugcaaucauuaaaaagaacaauauaucguuauauugcuugagauucuccuccaaaaaaguuggaaaauugcauuuuuaauaugaacccauuuaugugaaauuuuauacacacacagcaucauccucaucgucauccuuaucaucaucaucauagaaagaggucaaauaauaaagaauaugaaccaaaaugaugacaguauuuauuugcaaugaaaggaauuucacuuuaugcuuuauauuuuuccauauuacuuaaaucuucaguaauagguauuuaguaucuuuauauacuaaaacaaaauuaauauuacagucuuuucugcuacaauagcuauuucuuaauguaaauuagcucauauauaggaaaaugacgucagucuuaugugaaagcuaugcugguucauacacaauuuuccccaguacaugaagguuuugauucaaccaagagcaagucuucucccaauuaaagugaaagucucauuugguggcuucaagacuuuccacuguuaaaggaggcugagcauaccaacgaagaaaugcaaagauauuuuccccuguguuuaaaauagaauaaaaucaacagaucaauauccuagagcagauuuucaacuuugaugaaauuggucuguauuagaaguagaugacuuuaaggaccuacaacaaaggaagaaaaccaggguuucaagcuaagacugaugugaugcugggugcaaaugcaaggagggaguuaauagugcucguuuuuaugacaacuucuauuuucucagcucuguuuacaaaaugucacugguuucaaaugaucuguuccuagcccuauuuucuuuauaagcccuaaaauuuuaugguuuaauuuugcagaauuaaagauuuuucaggaaugcauguaugucauuaauaggagaaaugccucuacuauucugaguaaaaugcaguaagguagagaaauguuccauaucaaaaagaaacaaaaaacaaaaaaaggaagcaaaaaggagaaaugaaggaagggagggaaggaaagaaagagggggaaaaagaggaagaggaaagaaaaaaacugcacacuucacuuuguuuuagugagagugucuaacgaaagauauuaaaugcagggcaaaacaaucucauuaauauucuugauuuauaccacacauuuugauucuauaugagauauaucuaaagaaauggucuuugccccaucggacacuuaaaaucuaaacaagggagugaauuaaacagucaucaacuaugguggggcaggaaaagggacuaauccaauuaacuuuaggacacaguuauuuaauuauacccaacccaaggguauagagucaaauacuauaggcgguauuugggcugggaaguugggggguggggaaugcaaacagugagagaaacaauugugaaacuacuuaagauacauuguaggacucagcaaaugaguugggagaacaguggugacugugggaaaagggagauaaaaauacacagugggaaucagggaagaaugcuguggggcccuggaagcaaaaccauauagaaguagcaaugaguauauguaguacucaauucuuagggucuaauaccauucccuacuccaaagaaucagcaaucuucagaguaaagguugauucuggggcugugguggggaagguuuaagaugagccugaaacauuuucuuuggccacuaagaagugcuuagaaaaaagauggaaguacaucaaaaggagacgggagcuugccuggugaucccacuggcuaaauaugaaaaaaauuugauuacuuauuaaauaaagucaguaaugaguuuaaacuacuggaaaaacagcuuugaaugugcuaauuuucugaaucugagcaauacuuuaaaauauggguuuuagcuucaaaagguaaaucagguaauuucauuuuauuuaaguaauaccaugaaaauaauguuacaaacuacuaaguuaaauacaauaugaaauauuggugguggguuguuuuuuguuguuuuuugggguuuuuuugaaacaaggucucccucuguugcccacgcuggagugcaguggcaugaucacggcucacugcagccucaauucccaggcucaagugauccucccacuucugccucccaauagcuaggaccacagaugcacaccaccaggccuggcuaauuuuuuauauuuuuuguagagauggaguuucaccauguugcccaggcuggucacaaacuccugaauucaagugguccaccagccucagccuccggaagugcugggauuacaggugugagcuacugugcuccgccuaaaauauuguuuuaaaauaaguccccuuuaugaucauucucagaaauuuguuagaaaagaaguucccuugcacauauaaaaaauuuuuuucaauuuauaaauuauccuucuacacuaauuuccaaagaauaaucauugagaugaguuaaagcuuuucacuauucuuugaauauuauaucagcauauccaacuguuaauugaauuugagauccacuaguaaagcaaaaagcuugugacuuugaagacuauuuaaaauguacaauguuuuauuaauuaucauuaguaguacuauuauacaaugguuguacccuuguaaguuuguuaagaaacagcugacauugaaauugucugcaucuaaaggacaugucaggaaaagcagagaaaucuuaccaaaaaaaaaaauugaaucaacaucucuucuuuugguauuuaccccuuucacaucaauaaacauuuacugaauaucugcuaagugccaggcaucauaucaguuucuauaccgaaagaguaaagacguuucuguauaguaucuauauagauauugaacauuaagcauuguucuuuggaauuauuccagccuugagauaaggcuaaaagggccauaaaaauaaaaugaagaaagauggauuuuauaaaggauagaggcaauuggggauguuauggaaagacaaacuacacagcauuuuauacucucugguucuucuacuuucagagaaugacucuaucauccaaacagcugcccaaaggucaacaugguagugagccaaagugagcauucaugaaaaaaauagaaaucauccuaacuuucucuuacuuuaaaucguucaauaacuccucauuuucuauaggauaauaucaagcugcuuagauuuagcauauaaggcuaauuaugauuagauuccuagucucaucacuuccacuuuuuuuuuuuuuuuuuuuuuuuuuugagacagggucucacucugucacccaggcuggagugccguggugcgaccucagcucacugcaaccucugccucccaggcacaagcaauccucccacuucagccucccaaguagcgggaaccacagguaugugccaccacaccuggcuaauuuuuguauuuuuuguagagauggaguuucaucauguuucccaggcuaaucucaaacuccugagcucaagugaucuacccaccuucccaaagugcugggauuacagguaccagccaccgugcugggccaguuccucucuuucacagcacaucaugcuucaaccaaacccaccuccauacaauuucuagaauaugccacacuuuuacuugucucugggcccuuauacaucucucccuucugucuacaucacucuucccaccuuucuuuguuuuggccagcuuuacccauccuucagguuagcuuagaugucacuaucaggaaguccacuccgacucuccaaaucugacuuagauuuccuuccuauguguucccauaaaacucuaugcucccccuagcacagcauuuaucacaccugauuuucucauccuuaccccuaaucaguugugaguucugcgcgagcagaaacacuuguucacuacuauacuuaagugcuuugcacuuaagugcucaguguucaauacaguuucauugaagaaauuaauuaaccacuuagcuguccauauaaacuacaucauacucagaaugugauauaaguucuggaggccuugauugaacagcacugcacaaccacaugccauaaauuuuauguguguguguguuaguuugugugugugguguauguacacacaaaugacugucuccaucucuuaccugauaguuuuacuucacagcugaagauauuuaugaagaaagugguuuuuaaaagaaauuauacuuaugcuguaaguauaaauauacacagaaagaaauaugugggcuggacacagugguucaugccuguaaucccagcacuuuggaggccaaggcaggaggaucacuugagcucaggaguuugaaaccaaccugagcagcauaggaagacccugucucuaaaaaaaaaaaaaaaaaaaaaauuaacauagccagucaugguggcacaugccugugcucccagcuacucaggaggcugaggugggaggaucacuugagccaaggagaucgagacugcagugagcucugaucacaccacugcacuccagccugggugacagagcaaugagacccuggcucauuuaaaaaaaaaaaaaaaaaaaaaaggcugggcacaguggcucacggcuguaaucccagaauuuugggaggcugaggugggcagaucacaaggucaggauguucaagaccagccuggccaacauggugaaaccccgucucuacuaaaaaaacaaaaauuagccaggugugguggcgcaugccuguagucccagcuacucgggaggcuaaagcaggagaauugcuugaaccugagagacggagguugcagugagcagaucaugccacugcacuccagccuuggcgacagaacaagacuccaucucacaaaaagaaaagaaaaggaaggaaggaaggaaggaaggaaggaaggaaggaaggaaggaaggaaggaaggaaggagggagaaagaaagaaagaaagaaagaaagaaagaaagaaagaaagaaagaaagaaagaaagaaagaaagaaagaaagagaacauacgucgauuacuacauauauaucuguauauugaacuucaggaaguugacuuuucuguauuuuucuucaauaaaucauaacacaacacucuuguccaaaagcaguaaagauggauaagaaggaucaaguaacuuucauaauccacccaacuauaaggcauuaagaauuuuuuucccaauuaacagcugauuuuuaggaaguguuuaguuagauuuucuuucaaagcaauuauuuuucagucugugcuucauggucuccuaaugauucccuggagucucaagggccagggggagcaggugcuaagugaacagaguucugaacugccucaaucagagccacucugcuuuuuaucugguuuuuuuuuuuucaauaauggaauuccaaccaagauuuucuuugaagaaggguucacuacauuaaaauaagaauaaaagaaaaaaagaaaaagguuaaaaaacacugccuuaaagaaucagcaguggauugagguuugcacuauauaauucaagcucuaauguauuucauauuucuugguuagacuaaauucaacugucagcuuuauaggccuuucuuugugcuaaaaugagaaauaccauuugaauacaaaaauauccagguagagggaaaacaaaauggguuuuugauaaguauauuuauucucugaugcagcuauuucuaaauuuacuuauuauuuuuaauggcuuuauuuauguaccaaucuucaaguuaaugauucauaacagaacaccaaaauaaucuaauugaacaacagaagcccacuguaaaugccagcugcugcuauguuucauauacuguaaacaaauacccaccucauuuuaauaguuucuuaguagaaagauuaccuuaaaggaaaagauccaccaaacucauauuuaaauaauaauuuuagcuauuuucgcaaucuagaaacaacaggggcuccggguaacugaaacugggggugcuccaucauaaaacauccagaagaccaguggggugaauuugaucugcuggugaacacaaugaagacuaauaagcaaaaaugggcuucuuccaacagaaaccuccugccaaccugugcacaacauugugcaauugcagaacggcacuucacuggaagucagggaaacacuugcaaucaaguccaggcucuguaacaaguuaagugaauccaaaaccuuuacagcugaacacauaaaauuauucaaaagcucuaacgaggugagaagcaaccaaacuugauuuucaucucugggaaacccuauauuagcacuguaacccacaaggcccucuuccacuuccaaacuccucuggcauucacuagccacaccuucauuuggcacccaagaguguuaguuaccguuuuauagguaacuccccaacuaaguuguaagccccuaaaggguauacauaggucaugucucacucuuuucuauacauccuaaaauucuuagaauuuugcuaagcauuugcagaugcuaaauaaauguaucuugacuguuuguuuaauuguagauaugguuuauauuaccacccguuuacaauguugauaguuucauaugguugugucagacgacauuccacuccuuuaaaugccagucaggagaguaacggagaaaauaagcggccagaucaggcuguauugacagccaugcaacuaaucugauacuaccucuccaugcaugcgucccucccaaagaccaagugcccacucuguucuagggcuaaguguuuucuguuccugcuaugcuuuguaccaagucagaaauaagauuuggauucaagucuuagcuaugccaaugaguaagcaauuugaauagaugaccuuagcuccaauuaucuaugauucuaugauucuaacuucaggccuuuaccuuccaauaucagaauggccccucccucacaguacuaaaauuacuuaucuuccaugauaugucccauuaucaucaucaauacacccauguucaaaggccauuucugacuucugcuacaaggucaacauacucaugaaauuauuuacacuucuaaagauaacacuguuaaauuucuugucugaucuuuacgucauaccugcguucauuuaauaaacacaaguggguaguuggguaauaugggaaaagacacucauuuagggaaguuucuaacauauuccugcuuucagcagcaaagauaaguuauggcuccauuugcaaauaagcaccaauaauaguaaauaaaacuaaauuauuuuuauacuggucacuaggaagguuguuuucaucuuaaacggcagcuuaguagccuugagaauaaucugaucucucccauuuuauaagaaacuuauuuuuauugucucaucaacaucaaaugauauuagggaguuucacaaugacugugacaauaaauggcuuagaaagaaaauucaguaacaauuuugauagguuuuaaggaauauaugagcuagauaaaaauauaugagccauauagagauuugaugcaauuuaaauuaauaucuaccaguuuugaaaaauaaaguuucucagaaccuaauguagcuuucuucugcaaaaaagacgaggcauaucaccuaaaaagaccugucccuaaccaacuguuauccaaguaauuaaaaagaaaagugaaaauuucaccucuucauacauguuaagcaaaaccagccauaauaaaaucccugaugaaaggugaguuuuaaaaauaaaagugagacguagguaacagaauccuccaagaaauacuuaaaagguuaguuuuccucagccaaaaucauaucaacauuuucguauauuuuggauauuaaccucaguacaaauauuagauuaucaaacauaaaauauaaaaauauuuggcuaaugguauaguaagguuuuguuucauuuuuaauagagugauuagccauucacaaaaaucagucaauauuacuccuccauaaauuaugacaaaaaauauacaaacucugaaugaagcauuaauugggaaaagaaaaaagcuaaauauuuuuauugugaaacuaauaaaauaaaaaccucagucuaguagagaauauacacuuuguguugauuaaaauuuuauaucacuauguuaaacacaguaauacugaaaauuguuauuuuaauuaccucauuuaaucucuacauuaaccuuauuuuuauccccauuuuaaaagauauaaaccgaugcucagagugcuuaaggaaucuucccaaggucaaagaaacaguaaguagcagagcugaauccagauuauuugacccuguaaacuagguauuuaagcacuaugcuacacugccuccaguuauucauaacucccaauaaauauucaacacucccaauaaaacacagggcacgaugaguuauugauuucauaacugcuacugcagcauucagauacuacuuauuuggaaaaguguucugaauacacaauuaauucaauccacuauguaaaagguaaauguucaagucucauucaaauggagaagggguagaaaaggaagaaaaguacaaagucuauauggaacaucaauuaauaaaaaauauuaucaggguugucuuuaaacuucacaauuacugaagguccuuauuaucuugcugucauuucagcacucucaauugccucuuagaauuugaaauuucacuguugaaacaaaagaaacauaaaauauaugugcauucuaaaaaauucugcccuuuugcaauuuaucuucuacauuuauuaccuggaucuucuaacacucgacuagaaacuaaagcaauccaacuguauauacaaaauguaaaacuggaaaugccagaaaaucaacaugaccuuucaaauauaacauuuuccacaaucauuuacuuaauacuagaaaaacauuuuacaguauuuaaagcauaaucuuuauguguaauacuuucggcaaauauaaaagcaaauacagaauaaagucaaccacauuuuuaaaccaaaacugcaauuaauuuuaaacuacuacuuuuucuccaguaguucauuaucuaucuauuaaaacauucauaaccauauuagugugcucuccguuucaaauacaaagcugauguuaaccacuguacuagucaccuccuguaccugguagggacugcuaguauaacaaaccccuccccugacaccaauuucccuauauuaguuugcuugagaacaaaaauauguauugggcaaagaaaugagauaagccuucucuguaagccagcaagaccacucuugauuaauccccaacguacuggccucaacagcauggcuucuaaccaaccagaauccucagucaaaaauacuuuaaacaaagauaaaaauuagcuagaagaucauguuacccuaaaauuaaauuuuauuugagagcaaauguauagccuuuauauuuucugauccaaucacaucuuuguuaaaagcaaaagauauguaaaucaacacuaauaggauguuagauuuuccaagagagaaucacacuucagauaaacuacuacucaaaaucuuuuuuauuccauaaucaaauagcaauccuuaagaauauaccuuucauucccuuuugacuacuuuaaguauuuccaaaagaagcugaacagaaaauacuuuucuucagacuuuuuuccgcacaucuccuagcaggagagaaaaauuagcaaaacaaaugaacucagaaucauuaaaagguguggacaguguccaucuuauagcuuuaauaccuaagaauuaggaagaaaaagagaucaaggaaauaaagcgaccaacauaauaccuggcugaaggacaaauucuauacuuaaaauuaaguauggcucuaaaaaaggaugaguuuauguccuuuguagggacauggaugaagcuggaaauccaucauucugagcaaacuaucccaaggacagaaaccaaacaccacauguucucacucauaggugugaacugaacaaugagaacacuuggacacaggauggggaacaucacacaccggggccugucgugggguggggggauggggugggauagcauuaggagauauaccuaauguaaaugacgaguuaaugggugcagcacaccaacauggcacauguauacacauguaacaaaccugcacauuguguacauguacccuagaacuuaaaguauaauaaaaaaaauuaaguauggcuccuaccgacucuaugaauucaguucauauuucuuuaaugcaaagagagaaagagcaaaguuacugaaugaagagauaaaaguguaaaacaucaacaaagcaacuaaauuagauaccucaccuaucacagagaaaaucaacaaggcccaaugaauuuauauguacacauuuaccuuuggaauaauacgucaucugcuuuuuguauucuagacauguucuauuccauugacugggaaaaaucgaaaagguggccuuuguagcagaggacaaacagaacucaggcuuaguguaacagagcagcaaaauaaggugagagaaaagcagcugagaaggggagguuuacauucaacauguauaaaaauaauguauauuggcuuuuuuuuuuucaugagggaaggaagguaacuggcuacccuaagaaugaagcagaaucagcauggcaagaaacaaaacaggcagaaaauuaaaggaucccugagaaugguuuauaccccaaacaaaacaaaagugagacaaaguagaaaaaagaccaaaacccaaacuaagacaaaaaccccaauccucucucuuacauugagagaagcagaauaagacaacaucaagaacaaaauaucugcauccagaagucagacucacacacacacauacucucagagcagcaggagaacaaaaggacaacauauuuuacaauauuaagauaaaacuaguacaauuauauuuuuaaauauuaauuuuuuuuaaaaaagagaaagaacagguuggucagcucugcccauagaugcuuccaaaaaacuccauagcagucauccuaauggaugugagacacaauuucacuaggccuuugauaugcauuucccuaaugauuaaugaugcugagcaucuuuucaugcccuuauuggccauuuguauauuuucuuugcagaaaugucaauucaaaccauuugcccauguuuuaaucuuguuguuuuuucuuguagagauguucggaguuuuuugagacagaaucuugcucugucacccagcuggagugcagcggcgcaaucucagcucaccgcaaccucugccucccagguucaagcaauucuccugccucagccuccugaguagcugggauuacaggccaccauucccagcuaacuuuuuguauuuuuaguagagacgggguuucaccauguuggccaggcuagucuugaacuccugaacucaggugauccaccugcccuagccucucaaauuauauacuguggauaguaaccccuuaucagauacaugaacugcaggauucuuuuuaaauucauuucucuauucccuaauuucucagaguuggcuauauguaaugcagaaguacauuuugaguugaauauauuucuucuuuguuuuuauuuuuuaccuaauacaaaauuuacaauacucaaaagaggaauacaauggaaaauaaccuccaucccuguucuucagcuacgaaguuccaauccccagagacauuuuucaucuucuuauaauucccuccagaaauauucuaugccuauauaagaaaauacauuucuuaagucuccuccaaaauaaucuauucauuguucugcauuuuccuuuuugauuuacuacauccugaagauuauuacauuucaguauauauaaacugccuuauuuuuaacaacauaaauauuucauuauauauacuauaauuuauuuauccaguccccuaaggaugggcauuuguuuccagucauugccaagaguauccuuaaauauauguuauuucacacaauuacaggaucuauaggauacaaucuaguagaaaacuuaaaugcuauauauauuucaaauuuuccaaacugaccucaaugaaaauugcacaaauccauacucccauuagcaaugaucacacuugccuaguucccuauacccucaaugacacauuguguuuucaaaauuuguuucuuugccaauuagguuuuaaaaaaaggcaucucauuagaguuuuaauuuugcauuucucuuauuaugaaauauuaauacucuuuguaucuuuguccauuuuucuauccaauuguuggucuucuucccauugaguuguucgugcucuuuauauauuuaugaaaucagcugucuuccuaugauaugaauugcaaacauuuuuuccuaguuuuucuuugcuuuuugauauacuuuguuuucuuaauucucaaauuuaggaacaaaaguacuuccacuaugucuuuguucaaacuauauuccuuauuuugaauguucuucccuuccuucaaaggucaauucaaguugaugucucugcucucucccuaaucacucaagaucaccuugauucaaaaauuauuuagugagagccuacugcauuauauuuacaaauaaguaaauccagugaauuuugugauauaguagcacacagcaaggaaaauuuauagaggccacuaaacauuuaaauuguaucugaaaaaaugagaagauaugauccaaauuuuaaaaaugaaacaaaggcccagguaacgagaacuuauugucuauaaauuagucucauugggguacagaaugcuaauguuguagugaaaaagagaaaaagcugaagaggcaagcagagccagguaggauaggucuuuuaggccaauuuaaguaaguuuuucuuaaucuaagggcaacuagaagccacagaaccauuuuaagcagcagaaugcuggucagagaagaauuuuacaaagaccacugacugcaaucuugaguuuaaccagcacuucagugaacagaguugaaacugauucaaauaucaaauauacucuuauuuauucaauaagugaauuuuaaaccacuauggaauagaaugcuacagaaaggugaaauaagguacugugcugcucuacuuccuuaacugagggcuuggaacaaucacuguugcaagucaauuuaaacaaccagacaaucagaccauguuaaagaugagaccucuaauaauaaaaaaucauaguugauucucacuuuaucauaaaauccaaaacggacaaguaugggcccaaauucaugcaguucacucaacaacuguacucuuacuucuccauuguaggcuaaacaaacugucauacccccccccccuuuuuauccugcuuuuuugcuuguuuuuuuuuaauuuuuuauuuauuuagguugggggagacagggccuuguucugucacccaggcuggaguacaguggugugauuauggcucacugcagucucaaacuccugggcucaagagauuccccugucucagccuccugaguagcugggacuacccaugggcaccaccacaccagucuaauuuuuuuuuuuuuuuugagacagggucucacuguguugcccaggcugguguacaguggcaugaucacggcuuacugcaaccucugccucccagucucaaacacuccucccaccucagccucccaaggagcugggaccagaggcacaugccaccacguccagcuaauuuuuuguauuuuugggagacacaggguuucaccauguuguucacacuggucucaaacucccagacucaagugauccuccugccucagccucacaaagugcugggauuacaggugugagccacugcaccuggcccauccugcuuucaacagaugacauuaaauguccagaaagaauucaugagauguuaugaccauugaauuuccccacguuuagccuggguagugagaaaccaguuucagggagagaauauuaucuaucagggagagaauauuaucuaucuugucacccaauucaauccucuaaaaugaccuucuaugugcuugcuacaaaaaaaaaguucuuccaaacaaauacauucaaaaaauaaaguuuguuugacugcaugcuucucuagaaugcuuuuaaaauuuucuucuccccauucucaauaucauaaaucagguaacaccuaacaggaauugucuguacuauuucuuauuugcuggugacaauuccuuuuugauuccccaugucuacuuuagggguuagugguuuaacagucauucuuacaucuuuugucauaggauauuccaccguucugucuuuagauauaugauacacuuugaaguuaacagaagaaaguaaauuaguauaaauacaaaaaguugauauuacaauauaauaagcaugucaaugguacuaacaggagaugacaauuacaccuuuaucucgaaguaaucaccaucaaccauucucaaacucagaaguguauaguuuuuuuuauaauuuuaauucauuaucaugucacuuaccauuuuucucuaaguauuuuaaacuauagggacauuuugauugaaacuagaauuguauucaauacaacaccucccucaggaauuuaacuuuacaagccuauuucuauucucuucccaagaaucuuuccaucuaauucuaccuugcccucguggcuuaacccauacagagacuggucauaagugcuuuagaaucuagcauuuucuuccuacaaacaggaaauaaugugucucugacacuauccaaaaauguggcaacauaauuuaugcuuuuggaaggaagacuaacaucucaagcugacaacuagguaauaaauaugauuaagacccaagcacacaaugagaauaucccaaaggguauaccuuucagaagaagacaaggcuuaaucagugagacauuuucagcaaaaaauacagucauuuuuuucucagaugcuccuaaauaaccaucuuuuuggcaguauugacuuguuagccccaaaucauuauuucccuucuuuacuauuaaucuucaaaacaaaaaaauuuaagucuaugauaguaaccaagucugacucauuaaccgaacaauuccccacuauucucugaguuuaaauucacauaggauucuuacaaacagcuuaugaaguccucaaaaauaacccaugaaguauguguuaucucugcuuucccagaaggaaaaugaaguucacagacaaaaagugacuuguucauguucacauagguaauaacagagcuagcaccugaauaaagaucuuacauauccuuuucacuauauaucaccacuuuaacaucuggauauuuauauuuaaagccuauuuuuuaacuuuuaauauagaaguuuuaacugaauguuuagaguauuagcauaauguagucauauacaucagacaggucucaaaaaaucuucuaauauguugucauaauccacauacucagacuacaggaugucucuuaaacaugagaaauaguaagauucuggccacgugugguggcucacaccuguaaucccagcacuuugggaggccaaggcagguggaucaucugaggucaggaguucaagaccagccuggccaauauagugagaccuccaucucuacuaaaaauacaaagauuagccagacaugguaacacaugccuguaaucccagcuacuugggaggcugaggcacgaaaaucacuugaacuugggaggcagaaguugcagugagccgagaucacgucauagcacuccagccuggaugacagagcgagacuccgugucaaaaaaaaaaaaaaaaacauagugagacucauaaaaagcacaagcuaauucauuuauaaacugauucaaacugcccucacauaauaacagugcuaaauaguuauuaauauuuaacaaaacuaaauaauaauuauucaguauuuaaaucugacacuaaaaaaaacucuuauucaagcaacuauuaaacaaauaagcuccugggaaaauaccaagauccuuaguaaauaaucugcaauaccaauaaaacuaaaaauaaaggccaaaaaggcuacauacuguaugauucuaacucuaugacauuauggaaaaggcaaaaacauuggagacagugaaaagaucagaaguuaccagggguuaggagaagggagggaugaauaagcacaacccaagauuuuuaggcagugaaaauacucuguauacuauaagcauacauacauggcauuacacauuuguccaaacccacaaaaugcacuacaccaagaaugaacccuaauguaaacaaugaacuuugggggauaaugauguguccauguaguuucaucaauuguagcaaacguaccauucuggugggggauguugaucaugcaggagaggcuaugcaugugugagggcagggaguaaaugggauaucucuguaccuuccauucaauuuuacugugaaccaaaagacccuaaaaaaaagucuauuuuaaauaaggcaaaauaucugcggcaaucuuaaucuucuccuaucaauuauuacuucacagguccucuguuaacuauuuaguagaaagcauccuuggcugucaaugcuaaccuucugcacagcucuuauuuacacacacauugcuccucauaacaucugcucugcccacuguagccugcuuauccucuaauggucaucaguauacugaguccaaagacagggaaggagucagguacaaaugagauggagaagacagguaguggggcuaaggaagcaaagaacugcuaaagagggaagucagcagauaaaucugcaggagaaaaucugcagcaacaaggagaaaagaauccugaguugauacaaauuuguuuauugguuuacauaaugggaaaaucauaugaaaugaaauuauccuaaaauacaaaacaugaugacauuacaaacauuucccuucuuuaaaaaaaagucuuugcuguauacaauuccguaacuagaacuugauaaucuguuugcaaugugucccccagcgacaagcaagaugauuuuucaaaaguugacuguaaaugcuacauuuuucaaaggaaagauauauaaaagugugugugacaaagaccuaugucucagaauaacuuggaaaaaaguacaaauauuaaauuuuuaugauuuauugccugaaagaaaguuguacacuuuuauauucuggguauucuuaaucuaagaagucaagaacauacuauguauuaccaaacugggcaagaguucaaugagauucugaaaguuauaccuaacguacuauguauuaccaaaaacauacaauauguuuaguaacaaauaguauguuagguauguuagguaugacuguuagagguguguguguguguguguguguguguguguguguguggucacuugcuugcuuuggucaucggugaggaagccaggcuaagcaacuaacaaagaguccaaauaucugagucauuuaugagaggcuaagggcuccaguggcaaaucagggaccuauaagacaggcucaaagaugguucuggcaggauccaccaccaccaucacuaccaccucagcaaaauacaaccuucuucaucugaaguuucagggaagcacaaaggcucgaguucugccagcaguccagcucaguaaacacugauuaagcaccagugaaguacaaagcauuagguuaaaggugauaaaagacacugaauaggaggaaauauagccccuacuaccuuaagaauuuuccaguaaaaaauaugguaagacuauaauccaggcaagguagagcaaguacuaaaagagaaauacaaagaaggcauucagagguuuccucaaggagaugcucuagaaugaaaccugaggcuauuacucagaugaccaacaaguucaugcuauagccacugcucguuuauaauuuucucccauucaauguacuacuucuacaccagagaugugagaaacuugaaaaaggcuauuuuguucuagcugauuauuaaagggggagaauucuugaauauaaaguaagauauaagguaaagcaagcaggaaaggauuuggagcaaggugugucauaaugcuaacauggcacaaagcaaaauaauucaacuuccauucaguuuuacuggucaaaaggaauagcaucauuuuuguuuuguuuuguuuuguuuugagacagagucucacucugucacccagccuggagugcacgggcacaaucucugcccacugcaacuuccaccuccaggguucaagagauccuccugccucagccuccugaggaccuggcaucacaggcauguaucaucacacccggcuaauuuuuguauuuuuaguagagacagaguuucacuauguuggccaggcuguucucaaacuccugaccucaagugauccaccugccucggccucccaaagugcugggauuacaggugugagccaccaucacuucuauaacacauuuauaugcugcuuuaaugguuuacaaaggacucucacauaaaugcuuacaaugaaacucaaagcaauccuaugucagguagagacuguuauccucucagagagccuacccucacaagacaguccacaaugauccuugccucauguccuuguguaauccacucccauacugaaucagggcuggucuguagaaccaauugaauacaucugaaaugaugguguaugacuuccacagguaagucauaaagggcacugcaguuucuacuuuggcagcuugaaucucgggaaagucaucugccaucucaugagaauagucccacggcaagcccauuguggaaaggaaccaaccugccaacaccaacuggccagccaagugaguaagccaccuuggaagugaaucuuuuagcuccagugaugcuccuauaaaacuuccacuccugcugauaucugacagcaaccuccagagaaccaagcaaggacccucaaauugcugacccacagcaaccaugagauaacaaacaaucauuguuguuuucagccacuaagguuuucauguuacaaaacaacagagaacccaauuuuacauaugaggcucagagagguuaauuuaccaauuaucauauaggaaugaguagagaaaacagaucuggaacccagucuuuaggcuuuagguucaauuugucauuaaacaauaccacuuucuucucaacuaaaauaagguauaauacuguaaggaugaucauuccuacacgauuauaugacugauacuaguaugucaagcuuccuacaguacagagacacaguauaugucccugcauucuuaacgaauauaaugggaaucuccaaaauaaguccauuuguggugcuccauugugcucuguggaguuguuacuauuuucuggaaaauggcuauuuuuaaugugcauaucaugaaaauaaacacuuaacacauuuagagaauuuuaauacuaaaauauuacugacacugagacuacacacuuaaaucuuaauuacaauaagcaucuguguaauuuuaaacaauuagaauauaucagacaggaaaugcucaacugcuauuucuuuaagguucugcauuuuggcuuuaggucuucaaccuuguagcauuacacaaauguaguaaaauauaucaucaaaaugcucgugaugguaaaauauuaaaucaaaauccauaaaguaguuccuaucuuacaggacaagguagccagcucuuaagccuguccacuucuggagaaggucaagagaacauuuuauuguuauaaucacaucugcauauaauguuccuucacacaaaucuccucuuuugagccauauaacuuugcaaaacagguaggcaggacggguauacuaccauccuauuuuucaaugauggccuuagagaagucucaguaacuuaacuaaggauacguaacuauuaaaaggaauucaagaaucuaaucuacaauuuuuuagcuccaaaucccagccuuuucuucuaagccauguuuuagcccagugguucuccacccugacugccaugaggacaccuaagaugcuuugaaaauaucacugccuggaccucaucccccagauacuugauauaauugcacugguuuguguuagcugucuaauauauaauaaaccaguguugguaaauucacagaaaguuuauaucacaagggagaaaaugcugauacgucuauauguaaacugaaacauauuaacccccuaagaacucccucaaacacaaaaauaucuugcaauaaaaucacgcagaacaagaagaaagggaagaugagaaacccaagccccuucugcugcuaucguggggccauuaaggaauauuuuauuccccuaaucuuacuccccgaaccucaccaugccauaucucaagcuauagcucagguaucaccuuuugugagaccuucaggaucacaaaaauaaugaaguccauuuuuugcaucuaucuuaccuugaacucuaucauagcacauauugucccucaaagcauugcuuuauuuuuauuuuauuauuauuauuauuauuauuugagauggagucuugcucugucacccaggcuggagugcaguaccacauucucggcucacugcaaccuccaccuccuggguucaagugauucuccugccucagccucugggauuacagguacaugccagcaugccugacuaauuuuuguauuuuuaguagagacgggguuuugccauauuggccaggcuagucucgaacuccugaccucuggugauccacccaccucagccucccaaaguacuggugcugcuuuauuuauauauccauuuuucucacugcccugagggguccuuaacccauuuaugcuggagguugcaaauuuuuuuugugaaaaaucaggccuuggcgaugaccuugagaaguaggauauaaauaacucccacuagcuuagcgcuccaauaauggagcacuaggcauaaaugcauuaagaucagaucccuauguuacucauccuuccugccauauauaucuuuguauccagggccuuuaccauagcagauauuaauacauguuggcuaugcugaaugauuuuuauguuuguuaucauuauuuccuccauucuccuagcagacacuccugugaaauuuuucaacuuuuaauaaaggaaaauggaguuuuuacgcacaacuggauuagguuagagaauaauguaugcaaaagggccagacguagugagagcaagacagcagugaacuguggggcaggaaagaauagaguagaaaggacauuuaaaauucauaucugacaguuggggucagauaugaauuuugcaagccgggaaggaguaggcaaacaaagcgacaaccuaaucuucauucacaaaaaaaaaaauaugacaagcaaggaaucaggcaacuguauuuucaacaucucccuuucuaugguguuucuaacucacagcauacagacauguuguuucucucucaaaaaauaaaaucugaagcagugauaugauuucacuauguauuugacuuuuuuuuaagauuccacaugugagauaauacaauauuuuucuuucugcauuuggcuuacuucacuuagcauaauguccccuagguuuaccuaucuuauggcaaaaagcagaaucuauuucuuuuuuaaggcugaauaauauuccauucuauauauguacugcaguuugauuuucuguugucuuuuguuggacaguuagguuguuuccauauauucacacccaucaagauggcuacuaccaaauaaaacaagagauaaguguuggcgagggugggagaaaagagaacccuuguauacuauugguacaaccauuauggaaaaaguagggagguuccuaaagaaauuaaaaauagaacuaccauuacuucuauuuuguaccaauuagccaucccucuucugugugcauguauauauauauauauauacauacccaaagaaaaugaaaccgcaaccuuguaaagauaucagucggaauuuuuaaaagcucucuaggggauucuaauaugugugcauacagagauggagaauaaaacagugaucccaggggagggggaaggaaauugagauguaggucaaaggacacaaaguagcagccauguauaaugaaagaguuugggaacucauguacagcaucaguacuauauaauacuguauuguauuccugacuuuugcuaaaugaguagauuuuagcuacucuugucauacacacaaaaauggauaacuauguaagaugauggauguuacuaugucucacuacaguaaccauuuuacuauuuacauguauuccauaacauguuauuuuccuuaaauauacacaauaaaauguauuaaguaaauacccugacugaagaacaauuaucuccuaagagggacccaagcauaucuacucucuauucucauguccagcccccuucagccucaucuccuauucaguccuuuacccacagcacgauagcuuuaccuccaccacuacaaugaaaccagugacuucuaacagucauugaugauuguaacuuuacaaucaucaucauacuuaauggccacucuccuucagcaucuuuacaucuuucucuuuuaugguuucuccuuuaaauuuuuacauucucuaagacuaauuuuuagcccuuuucucuucucuuucuauacaauuccucuauguacuuuuauccguaucuauggauacuucaguuacucuccauaugguaagaacacacaaaucuguuucuccagccuuugcaaucucuugugauguuccaggauccuauauccaacugccuucuagacaucucacacuugccaaugauaugcccugcgagcauguuaaacacagguccaaaguugaacucauucucuucucccucauaccuucuuccucuucucuuuucccacucacaacccagaaaccuaggaagcauucuaacauucucccucucccauaucuuuuacauucaaacagucacaaagaccagcaaauucucccucaucuuacuuuuccuaaacauucucacuucucuauucccacuacuuccaccuuuaucuaagcuuucaaccucucuuaucccuacugauguacuguccuugaaagcuuccagucuugccaugaccccacacccaaccccacucuacccucaaucuacccagcacacugcuuucagugaucuuccaugacacucacaauucuucaguggcucacuacuacacaugguauaagaaguguacccugaacuggcuauccaguuucaucuaggaaguguacccugaacuggcuaaccaguuucaucuccuuucacuccugaccuuguccuucacacucuaauauaacugaccuacauauaguucccaguauacacuauguucucguaaugccacacaacuacucaugcuguuagcuuuaccuagaaaugcuuucuauugcuugucaacaugcccacuccuacucaguuuucaagucucagcucaaacacaaccacuacuaaaacccuuaccugguauugcaggcagagaucaagagcucuugcuagauuucauuuguacuuguaccuaccucuguuauagcaaauagcauacaguauuugaacuauuggucaagauaucuguaguccuacagacuauaagauccuuggucaaagaugacuuuucaucuuuauauccuccuaacuaguucaauucacacagucacuaguuccauguacauuacuagcucaaugcagauagauauacuaaaaaaaggaggggcgagguuaaugaauaagguacgagucaaugaaagaacaagaaaaucaacuggacuuugaguauagaaaaaaaaacaccagaucuuaagaacguacagacaucuuuaguacagacaucuguuacuguaguacagauauccauuacuaaguccuaaccauuaaaaaaaauagaaaaauaugguuauucagguaguaugaagaugacaaagaaaaaaacuuauuauuggacuaaguagacauuaagaagguaagaguuuccagcggaacaguugacaaagaucaacagagaagccagagaaaaagaugguucuuucuaggaaacaaguaauucauugaucuaaauucauggacugagcaaaagacugccaccuuucucucaguucacaaccccucuccuuugucauuauucugcaugaccccuucugaguccucacuaccaaauccccaauaccauggguaguuccccuccaauggagccacagguccaggccagugacuuaaucuggaugcaagggcaagggauagaaggguaucuuuguucuugugucuaggacuuugaggaaaaaugaaacaacuauuuacugagaauuuauuuuacggcagauucugugccacauuacacucacucacugaauuucacaguaaucauaaguaauuaucccauuuauagaugaggaauuuguguccaaggucaacaguuaagcaauaacaggcccugccugaaaaccuaagaaugacaaccuccagagcuuuuucuauaccccucacuaccucaaaauggagggagacgugguccagccauucuagguuggcacucaggagacacuuaccuccaaaacacuauuauauauguugauuagagucuacaguaccacuaauauauaauaagcacacaaugaguuuaaaaagcuuuccuuaguaccuuuaggaaaguaaguacuagauuuccugggguucugaucuggaaaucuaaaugcuauuuauuccuauaaguacauuguuaacuuuacaaacaacagacuugaaaaugaacuuguggaauacaauggguucuuaaguaaggcuuuucuuuaagaauauuuucuugcuuccacaaaaaauacaaaagccaccaaagauagaaugauuuugccuuguuaacuuguaagaacaaugacacuagaagaaaccuaugggaaaugugcuuaucugaccaggugcucauuuucggugggcugucauuugacuaaaacaucauacuaaacccuacagaccacagcuuaugagagaaaugccacaaacuauagcaguacaguuaauaugccuauaaucuacugacaaaacauacuccucaguaaagugaaaccagaugucuggugugaaaucagaugucugugaacuugucuuucucaguuuccagagcaguaucagauauacuaaauacacagcuaagcuguauauuaaauccacaacuuggcaaaaucaugacaguuuggacaugaagcaucagcauuuuuauuguaauccuuauaaaccaaagacauuuccaaaauggaaauccuaaguuuaaguacucagcuaaauacaguaauaugucuuucucacuuuaagaauagugucagggcuuuuuaaacacauuauagaaauucuuucccuucauuuuucaagcugacacucuuuauccaaggcuguggaaugaucugauaaggccacaucaggugucaguccucgucccagaaauucuaggaucagauacaccaggugaaccccugugaaaagcaaaucccagggaggcuuaacagcuauaggaaaguuaggcacuacauggcuuuccacaaucaaaaggaagaucauaggaaaguaaugggugaccacauagaaaaacagggagggaaauuuaaaaguaaguacuucuaugccaggcacuguuuuuucacacauucuuuuauauauacucuuuguucuguuuugauggauaagaaaucaagcagcagagaaauuuuaauggcccaaagugacacagcuaauaaaauaagagccagaaaucaagcucauguccaaaagacuguaaaagucaugcuacuucuacaugaaguugugggguggagugaggaggggugguaaauagccaagaagaaggagaaaaagaaagaaauuuacaauuuuaucaaauaacagugaaauauauauauauaaaacauguauuauguuccacauauguuccauauauaauacgcaguuaagauguauacauguuuaacauauacuuaagcugcauauuuaguauguguauauauggaacaaaaaguugaagaaacaaguaucaaauuguuaaguggucaucugaaaguggacucauaggaaacucacuuauugccuuuuauacccucccagauuuaauucuaaauaacuuuuuuuugacuuuuuauuacucuuauaaccagaaaaagacaaagaacuauucuagcuuagaucuuuuaaaugaggcuaaaugcacagaaacccaugcaaguuaaaaauggucuacuuucgaauuuauuuuucuaaguacaucauccuuuacacucuccaugauuccuaauauuagguccuucuuauggaacaacuacaaaaguuauccucaucuaauuauuauacucguacacuggaaaaugacuauaacauuauucauuauaggaaacaaaucaucaaggucagccauccuuguaaguuuauuacugaaaguacuagaaaggcggaauaauaauucuguucucccacaacacuguauagaccugcaaaccacuaugaucaguaguacagggaaagucuuguaaauuaacauguaacuauugagaaaauccacaaaacuggugaaaggccuaccccaaaacagccaucuccaauacaaucucaucauucucaccauccuacuuuuaucaaagugcugauaaaagugcguagcacaugguaagagagaauuagcuauugaaucaaugaaggaacccauuaucaauaaacaaucacuuccuguuuuccauaaauuauguggucaccuaucacuugagcacaaacaaauaggcacguucaggacacaggcagccaguaucagaauaggcagccuaucacagagggcaauucuacuuuuccuguguaagaauccaagaaugcaguuuuacuacauuccugcuuguagcuaaucugaauuucaacuaauuuaaaacgguuauuuauaugugacauauaggaugcauaaugagcucccaaccuugugagaggagcuguguuucauuucaccauacaggggagagggaagcaguguauuaaagaagugauagaaaagucccacagaagaaccaaugaaauagaccacacugaaaaucacaguaagccucagagaacuucaguguccuuuuuggcaacuuuucaaaagugaauggaaugcuugccaggagguaccaagagugaaagcccagagaaaaaggcccagccuggucaucucucuccccucaaaacaucuucuucuguaagcuugagagaucccaaagaacuucaacacuuguaaucuuguuacuaacuuuaugcuuugggguccuaaaggauuuuuucaggaguacccuuuuaaaauguaaacaucccuagggggguuacuguucauuaucaaacaggaccuggauucuuuagugcuauggucucagggauuagucaaagcuggcuaauaagauaggggccggagacagacaacuagagaggaccaauguuccaagguaaaaacagguaaaggggaagugcaguuuucugucgggucaaggggcuaaaagggauccacaugcccaagcuguuaaacucuauagacugugugaggcugaaaacaguccggggccuggagccugugacuuugaagguggguccuccaguucccgaugaaaagguagaaucugggcccaaguuccccacgagcaguucuggacaucuagcccuucucucucucgcucgcucucaggauaaaguccuagguccuuccaccccugaccauuccuuacuuacccuuucucccgcucuuccucggugagaagggguaagugguuauuuugugcccucgcccaauuuggccaaaacccuaaaaguaaaaaacgacagacagacacgugcuuuaaaaucauguuguucaagccugacgcucucccaccaccugcccaacacuuccaggcagaaggcagcgcgcccccacagcgcucccucacggccagagccgggggccggacuaggccccuuugugaggacugggagagggcgcguuguuggggcgccggcucggcggggaggagcgggccagcuccgggccaggugugccgccuguggcgccgguuucucaaccuaguuagccaguggcaccaagaagaggacuaggcugggguggccgccgcacgcgccucagauaaacacgcgcacgcacacaugcucgcgaucacgcaggacucgcggccgcgcaccccuccgccucccggcaacgcccgccccgccggggccggggccgacucccagggaaggguccccagcccaagagaccaccaagggucggcggcuacgcgcccgccgaccccugccagccucacagccccccacccgccgccggacgccgggcgcccgcccuccgcacccgcugcgcagcucagcccgggggaaguccccgcgcagaccccgcccuccgccg

SEQ ID NO: 192353 - RNA, 71315 nt, Homo sapiens
ggcagaggcggcgccagccauguuggccgggcggaggucuucgcugaggcccggggcgggguggcgccaccccugauugcggugccacggacugcuccugcugggcggagaggacagauuuugcaaagcggaggcugcgacggguccugcagggggacagugaggaaagggccgccucgucuccgcuccugggggaccgcaggugcgcagcggggagcgggggcgggcuggcggcggcgggcugggggcugggauccugggguggucccggcucugcccucucggugccccggggccagcgaggugugcuggaggcugaggcccgguccggcgcggggagcguugagugcugagcuugccacccucucacccacuucgcucugccggggccgggggcccggccuccuccagcuccccuggauuagguggaaagauguggaaaacggugguucgagcaucucgcccagcacccacccccaccuccugggccacccaccuccacccaaguccaucaucgccucugggcccuuggacuuacuguuucauuccuugccagauauggaguguccuagacuuugaacccaauugacuacgucaccguaauucagccuuggaaguuaaagggguuaaaggggaaaagagcuugguaaagauaaugccuuggguuuugauuacaaagaguucaguuuuccagcaggaccagcccuaucucacugggcuuucuuucuacgguagguaguguuucccgauuuggugguaaagguacugccugaggaaggucauaguaaaucuacaucaaucacugaaguggggauguggaauucucguuuucacuugaacucccucaaccucuaccguccaaagccauggauaacuagccaaauuaacuugguuuaaaaagguuuuagauuuaaauauaaaugcauguugaguuuuccuucucuuucuccucugguagugaaugaacaucauuucagaaguccagcuauuuuuuuuuuuucugagacggagucuugcuuugucgcccaggcuggagugcaguggcgcaaucucggcucacugcaaccuccgccucccugguucaagcgauucuccugcuucagccucccgaguagcugggauuacaggggcgagcuacuaugcccggcuaauuuuuguaucuuuaguagagacgggguuucaccauguuggccaggcuggucucgaacuccugaccucaggugauccgcccgccucggccucccaaagugcugggaucacaggcaugagccacugcgcccggccagaguccagcuauuuuuaauugacuuacagaauuuuagaguuagaugggaccuugugauuuucuaguccaagucucuuauuuugcugaugagaaaaacaggauucagagagguuaauuguccaagaucauaagaagacaauucauugaggauuuuggaagugaaaaguaggagacaaauuuaauuggcaacuaacaaauacauguaauuggaaggaacucaaauuuacuuggcaaguacauuuucaauuagauaugaauaaaagggcuuaaaauuagaauauugaaaaacuaucauagggaaagucuuuuuuguuuuuuuuuuuuuugagacggagucucgcucugucacccaggcuggagugcaguggaacgauuucggcucacugcaaccuccgccucccagguacaagcuaagcuauucuccugucucagccgccugaguagcugggacuacaggcgaccgccaccaugccuggcuaauuuuuguauuuucaguagagacgggguuuaaccauauuggccaggcuggucucgaucuccugaccucaugauccacccuccucggccuccaaaagugcugggauuacaggugugagccaccgcgcccggccagggaagucuuacuuuuaaaagacuugggcacauauuugauauacuagguuaaagugacauagugguuugcuucuuagcuuuuagcucuauuaugauaaauuauuuaaccaaaguauauuguacugaaauuggacauuucuuuguaauagucuuuuguguuuuguaucacuuuuuaaaaaaaauaaagacuaguggcugggugcggcaguuuacgccuguaaucccagcacuuugggaggccgaggcaggccaaucaccugaggucaggaguucgagaccagccuggccaacguggugaaaccccaucucuacuaaaaauacaaaaauuagcuggguguaguagcucacgccuguaaucccagcuacuggggaggcugaggcgggagaaucgccugaacccgggagguggagguugcagugagccgagauugcaccacugcacuccaaccugggugauagagugagacuccaucucaaaaaaaaaagagacuaauaugcuaagucugcauucuaauauaguguguggaauaauauuucuuugguuuaauacuuuuaugcaaacauguuaguauuaggggagagagugcuuaucaaauaauaucauguuaugaaaagcuaguuuguggcugggcaugguggcucacaccuguaaucccagcacuuugggaggcugagguggguggaucaccugagguugggaguucgagaccagccugaccaacauggagaaaccccaucucuacuaaaaauacaaaaauuagccaggugugguggcuuaugcccguaaucccagcuacucaggaggcugaggcgggagaauugcuugaauccgggaggaggaguuugcggugagccgagaucacgccauugcacuccagccugggcaacgagcgaaacuccgucucaaaaaaaaaaaaaaaguuaaguuggcuuguaaaaggacuuuauuucagauaugccauugucggacaugggacuaagccuggcaaauuuuguaauugaauucgugauuuuaagauugcaugacuccuacuauggaaaggugagggaagucagggaaguguugugcauagccauguaauuggaccaauugagaaacaggugggauuuucuucaaacuacugcuggaaugugggaauguaagaaguauaauagaugugauuuagcaagcaaauugaucuuagagcagggagauugagaggaaaaaaugugaagaagagaagagaguugugcccagauaucacucaggugauauuuaguaugucuuaauaagaaguaagaauguagagauacaauccagccuuuuaaccaguuguagaaaguuaaaccuggcuauugucugugugugaaugucuuccugcuaagacuccuggaaccuuucuuagugagguuuccuaaugguccuaaggcagugguuuucagaaccccuaacuuaaacauuauugaguauccaaagagaaaaaaaaaaggcuaaauagaagacagguggguuuucauaucuguuucugcaguuuauugugauauauuguuuugguugaauuguaugaaggauuaauuaauaaauuaaaagguuaauugcaguguggaaucugaaagcuuaggagugaccuuuuuguacuuuguuaccuuaaaacucauuggccuauucuacacuuugaauggaucaucuacccaugugugauauuuucauaucacaaauugacgguuuggaagauauugcuucacugaguaauguauaucuucuaaauguuaauacauuuuguuauauacuaucaaacaaauuacauuaauaccaacacugaucucaucagaaaaaucuuuacauauuaggaacuugucaagcuuaugguagcaggcacaaguuuuaaaacaauuuaauggcggggagcggugccucaagcauguaaucccagcacuuugggaggccgaggccggcggaucacgaggucagacaauugagaucauccuggccaacauggugaaacccugucucuacuaaaaauacaaaaaauuagcuggguaugguggcacgcgcauguagucccagcuacuugggaggcugaggcaggggaaucgcuugaacccgggaggcagagguugcagugagcugagauugccccacugcacuccagccuggugacagagugagacuccgugucaaaaaaaaaaaaaaaaaaaaaaacccaaaaacaauuuaauguuugcuugaaagcucaaauuuuuaucauuggcaaaaaauacuauaaguuguuuucuaugaagugauagguuuacuucauacauuuuugagaaaauaucuguguaauaccuaaguacuaguuauguacuauccuugggagaauugagaaaacagucauugaaaacauuuuuuguuuuguguuucagcuauuuuaaugccuuuugcagauguguuuuagaugcauuuuauuuuuuuuuuuuguuauggcacauuagaauuuuuauuuuuucuuaauaacacuggauuucuuaugacuuauuuuuugucaaauguagucaucccuguucugauuucauuuuauuuuauuaaauuuuuuuuuuuuuugagaaggagucucacucugucgcccaggcuagagugcaguggcaugaucucggcucacugcaaccuccaccucccggguucaagugauucuccugccuuagccuccugaguagcugggauuacaggcacucaccaccagcucagcuaauuuuuguauuuuugguagagaugggguuucaccauguuggccaggcuggucuugaacuccuaccucaagcgauccgcuggccucagccucccaaagugcuaggauuacaggcgugagccacugugccuggccuuaaaauuuuuuuuauuuuuaauuuuuguggguacauaguaggcguguacaugcuucuuaaauuauaggagcaauuaaguaguaaacacaauuuuauuugccuuauguucuguauaauaaauguggaagagguuugcauagucuuagaauuuauauucacaucaguaacauggaagcuguugcuaaaaacuggauuucuaaucucccccucacccccacguccugguuguuuuuucuuuauugccaccuauguuacgguggaguuugacaucuucuaacucuccucugaauaucccacaccuuuguuuuaucauuaucuuucaacacuuuuccuugaaagcucauaccacccuucucaaagcugccuucuauauuuaccuucaaaauaguuuuguuuuuuuuuuugagauggagucuuguucugucgcccaggcuggagugcaguggugcaaucucagcucaccacaaccucugcccccccaguucaagcgauucuccugccucagccuccugaguagcugggauuacaggugcaugccacccugcccagcuaauuuuuuuguguguuuuuaguagagacgggguuuugccauguugaccaggcuggucuugaacuccugaucucaggugauccaccugccucagccucccaaagugcugggauuacaggcuugagccacugcacccggcccaaaauagucuuuucuaaacaaguuuagucuugggauuucucuuuacccuuuaugcaccuuugaaaaaccacaaucuuuuuugauuagcguaagauuuucuagcugucuccaagauucuggcacaauuggaggaaauacaguguuuucuuuaauuuuuauuuucuuauuuaaagaagagaaaguucuuaacugcuuggaaugcuuagauuuguuaagcuucacuuucugccauuuguuuuaugaaaauuuauuugaaagauuuucuaaaauuaaaauuguuauaucuaacuuuuuccccccaaauaauaucucuucuuucuucacuuaaauuuuagaaucagcuucuugucccacuauugcucuuagcaacuuuaaacauccauguuggguuuuccaggcacccuagguucacaguucacuucuuucaacuugacguccuuccugucugcugcauaacacuugaaugucuuuguccucccacaccuuuaaauucuucagcuuccuuccaugacuaacuacuguugcaguuugagagcaugagauagagcuguugccuacguaggaaagccggcauccuaccuaggcauuuagacaguaaaaauggagcugucuuuugauacuggucccuccccagagugcauccucuucccuugguuaguaaacuuaaauuauuauacugaaauuuuauaucucaaauuggaguuuaaaaugcucucauaauuuggaauguucaaaauauucugaaguaaguuucugcaaaagagucuaaaugauauauaaauugggggaacagcacuuaucaagcauuuuauuuauugugccacaaauagccuguacuugcacaauaagaaaauuaccuguccaaagcagaaguguccaguuuuaggaaaaucuuuuuguuacauaccauuaaacauucucuucuguaaaguuuaguggaaacuuguuauuuuucagauagaaaccaugugaguuuuagaacuuuauaauuuugaaaucuguuuauaugaauucuuauaauuuucaaaacugauauggaaaacauaggaucuagguuuucccccuauuuuugcauuucuuuccuauauauccuuaaagaaauaagacacuauuuuuugccaucaucuuuuagagugaauaaaaaaguguuaaauaccucuuauugggccuugugaacauuggguagagccauuaauuauuuuguuaugaguugcuugcuaauuuuuuucugagauaaauauuuucauuugguccugauuuuuuuuuuuuuugagauggaguuuugcucuuguugcccaggcuggagugcaacggaaugaucucggcucaccacaaacuuugccuccaggguucaagagauucuccugccucagccuccugaguagcugggauuacaggcauacgccaccaugccuggcuaauuuuguauuuuuaguagagacgggguuucuucguguuggucaggcuggucucgaacucccgaccucaggugauccgccugucucggccucccaaagugcugggauuaccggcgugagccacggggcccagcugguccugauuucuaagguguuaauauugcugaaugaggggagaacauucauauuuugaacguucuuaagaggauccuggauuuuaaaauauuuuaaaauuuugauacagaaauaagaaucaaacuccacaaugacaaccuauuuggaauucauucaacaaaaugaagaacgagauggaguccgauuuaguuggaauguuuggccaucaagucgacuggaagcuacaagaaugguuguuccuguggcagcccuguuuacaccacugaaagagagaccugacuuaccaccuauucaauaugaaccuguucuguguaguaggaccacuugccgugcaguuuugaauccuuuaugguaaguaaaauauauagaaaaacuaauguggcaaugugauuuuaaaaugucgggguuuuucugcauauuuuuauaaaaaucccuuuguuuuuguucauacuaauuuuuucaaauuaggacagucaaaacaauccagagagcuguaaaauuuuaggaucauucuaguuguacugaguugguaauauaaagagaccaaauguaaaaguggcacuauaaaaacuguuagauuccaucagugucuucugaauaguggugcuggauguguaucaacccaucuugcaucauuagauaagucauaauuggccgggcgugguggcucaugccuguaaucccagcacuuugggaggccgaggugguggaucaccugaagucaggaguucgagaccagccugacgaacaugguggaaccccgucucuacuaaaaauacaaaacuuagcuggggugugguggcaugugccuguagucccagcuacucgggaggcugagacaggagaauugcuugaaccugagagauggagguugcagugagcugagaucgugccucuguacuccaacucugggugacagagcgagacuccgccucaaaaaaaaaaaaaaaguugugauugagugacaugauguuccaaaaauguugugauuucuguugcugaagccaaaaucucaggaaucaucucuuacuucucuuuccauucccucuccccccagccaauccacuagcaaaucugggugaucuaccucuagaacauuauagauucugucucuuacagccucuuauuccaucucugguaguauacccugcuucaagauaccacagucuuuuuccugggcaauuucaauauccuccuaccugcucucccuguuucuauucuugucuuucagcagucuguucucuacccagaagcuagaguuuuaugaaugaaaaucagaugaugaacaucuuccaguaguagcuucuuauucuuggaaugagaaauacaaacuccuuaucaagaucuauaaagccuuguaugaucuagccucuguauauauuucugccuucaucuuguguuauccauuuuccuuauucucaucuacauaauaccuuaacccuguuacccucuuucugauucuugaacauaccaaacuuacuccuaccuugacaaugguauaguagcugugcauucugcccggauucuucugucuccauauuuucguaugauugcuuccuuuucauucugaucauacuuuaguugucuauuuaagaaggcuguuuuuuaaagcagcccucuuaaacacauucucacauucugcuuuguuuucuuuaaucucuguuauuacaauguaaaaguauuuuuggcugggugcaguagcucacgccuguaaucccagugcuuugggaggccaaggugggaggauugccugggcagcaaagcaagacuccauuucuacaggaggggaaaaaaaaaaaaaaaaaauauauauauauauauauauauauauauauauauauauauauauauguguguguguguguguguguguguauauauauauguauauguguauauaugcauauauauguguauauguguauauaugcauauauauguauauguguauauaugcauauauauguguauauguguauauaugcauauauauguauauguguauauaugcauauauauauauguauguguauauaugcauauauauauauguauauguauaugcuggguguggugguaugugucuguaguccuagcuacuugggaggcugaagaugggagaaacacuugagccaggaguucaaugcugcagggagcuaugauucuaccauugcacugcagcaugggcaauagaacgagacccugucucaaaaaaaacaccaaaaguauuuucuuguuugugcaucugcuugucuuuugucuguuuuuucuagaauguaaacuccaugagagcaguucucuuuuucuuguaucaccagcgccuaaaauagugguugguacuuauuaggcauucaguaaauauauuuuugaccugaauaaauguuuucuaggucugaguguagauguuacugaagucacuugaagaaaaaaauaggauuauuuuaauuuuauugauauuugcuguauauaugugugcauauauauauuuuugagaugguuucacucugucacuuagauuggagggcaguguugugauuguggcucacuguaucuuugaccaccugggcucagaugauccucucaccuaagccuccuaaguaacugggagugcaggcaugugccaccacgccuggaugauucuuuguauuuuuugugaagacuggguuucaccauauugcccaagcuggucuugaacuccuggacucaagccaucugccgccucaggccucccaaagugcugagauuacaggcgugaccuacugcacccagccaauauuuacuauauguuaaaaguuauauucaccauuuagguaaacuuguauauguuaaaagugugaauuagauauuggcaguaucuaaaacuacauggcuuuuaaaaguuacuuugacuaucaauuugaauauguucauguuuuaggaagaaauuaauuuuauugaaauuaggauuuuuguaaaauugaacugaaauaugaacugauaugucuuuucuuuuuuuuuaaaacagucaaguggauuaucgagcaaaacuuugggcuugcaacuuuuguuaccaaaggaaucagguaagaaaacauccauugcaugccgggcgcaguggcucaugccuguaaucccagcacuuugggaggccgaggcggguggaucacgaggucaggagauugagaccauccuggcuaacacagugaaaccccgucucuacuaaaaauacaaaaaaaaaauuagcugggcgugguggcaggcgccuguagucccagcuacucgugaggcugaggcaggagaauggcaugaacccgggagguggagcuugcagugagccgagauugcaccacucuacuccagccugggcaacagagcaagacuccgucucaaaaacaaacaaacaaaacaaacaaacaaacaaaugaaaaaaaacccauaaaacauccauugcagauguuaaugccaaaauacuagucauguagaaaaaugcauauuuaaaaaaagauacaaauaauuauuucucauuuaaugaaaaugccuuuuuaaaaauaauuaaaugaucaggaaauacuuuguuuaaaauuuuauuaaucuuucuagccuauaauuuguuaaaaauuuuuguuuguuuucuauuuguaguuuccaccuaguuaugcugguauaucugaacugaaucagccugcugaacuuuuaccucaguuuucuagcauugaauauguaguucugguaagaaccuaagaacaaauauuuaagaaaguuuuaaaauuuauacugaaagaauuguuaaauuaugaugauuuagaaggaaucaugcuuaauucucacauugauuugauggaacauuucaaagguaagaacuguugaggucaguuugagcaggguaauuccuauguuguacuuauuugauggguggccaagauacuggguaggguggugugauuugcuauacugaguagaucaguaaacaauaaaguauaaaucuugcuuuguaguuggaaggucaguuaacaaauauuuagucaauaugaugcuggaguuggcuaauguaucccccaggucuaauuaaugaaaauaaucuugcauuggucuuuaggaaaaucauuuuuauucucuuucugaauacuuaaccauaguuguuuacauguuuuacuguggaaguaauaucuuuuaugaauguuuuagagaaaacaauuaugguucacuuggaccauucaguaauuuguccagccuggcuaguuucuaguuaucugaaaauccaagucagguuuacuaauuauuuuaaaagagucaaaugaaaccuuaugcauguaguuaaauaaaauggaaagugaaaguccccucuguguaacuauaccucauguucuuaaacuuaauuuuucaccugaugauaugucuuagaucucucuccaugacaguagaaauaaccuguuucauuucugaaauggcuuuacuaggauucuuuuguauucguuauuuaauuaguucccuguugacugucuuguaugcugugcuuuaaacuacauauuuuuucuuuuuggugaauuuuuuaaaagcgugguccucagaugccuuugauauuccucuaugugguugauacuugcauggaagaugaagauuuacaagcccugaaagaauccaugcagaugucauuaagucuuuuaccaccuacagcuuugguuggacuuauuacuuuugggagaaugguucagguucaugaacuuggaugugaaggcauuucaaaaagcuaugucuucagaggaacaaaagauuugucugccaaacaacugcagguaaacaacaagaaugguaguuuuuaccuaucugaaaauuacucuauauauguuuauaaaugccuucuguauguuucuaggacaaauuuuuauuaugaauaacuaauauaauuguauuauaacaaaggcuuuaaauucagugcuggcuucaguuuucuuuucaugugccuuaaauuguuauacagauuaaacacccuucacuuuuaacuauaucuuuaaaauuuaaagucaaaccaacaguauuuuacuagagauuugaagggcuuaugaagagucaugcugaaggcuaagagagagcaacugcagaauauuagcuuguuucuuuuuuuuuucuuaagaguucagcuuuuuuauugaacauguuauaaaagagguuuagucaaaaagaccaaaguccaugucaucaucauacuccucagguucuucuuucuuuguuuccacuuucuuuuccucagcuggggcagcagugguggugggggcaggaccuucugcaggugcagcaccaacuguuggagcagguccaccagccccuacauugcagaugaagcuccugauguugacauuggccaguccuuugcaaacaaaucaggccagaaagguucaacauuuauaucagcugcuuuaacaagggcauugaucuaauccacugugauggucaccucauugucgugcagaaugagguccaaggagauacagaagaacuugagauggaggccaugaugugggcgagugcagggcuggugcugccugacauggugcuagucaccugaugaagugagggucucaccccaguguggucuuggcuuccucauaagaaccgagaaccuugguggcagcugaggagagagcuuuuauuucuuaacauuucacuuaagaacuaaauacuuuuaguauguuuggugagggaaguuauuuugagacuggacgauuuuuaguguaggaacuaugguuacauauguuuuuuagugguuuuuaucacugggacaaauugaagcuuucucuuccaaggcaaaggaguuauguguagcauacuaggaucaucugcucagaugaacaucuuuuuuucugcccagagauuuugauaguccauaagagaguaauaagugaaugucuguuuguauugggggauaguugguauauauaccuuauauauauaauauaagauuguucauguagguacuuugaaaaaacuuucuaaguaauucuggugcaacuccuaguugagaacauuuacccuagaagaugauagauaagccuggcauaaaguugacagauguaaaaucagacuuuagaggcuuccagguagaccaaaaugaagaagaaaggaagagauuuuugagggugagucuaauuugaaacuuggcagacugagguaguggugcugcaguuaacuaagagaacauacuaggggaauuugcagguuuaaauggggaggauaaugaguaaugaaugcguuagucaaugaauagugaauaagauuugagaagguagagaaaguugaaauuuguucuuuuucuucugagacaagagucucgcucugucacccaggcuggacugcauuggcacaaucuuggcucacugcaaccuccgccucccggguucaagcuauucuccugccucagccucucgaguagcugggacuacuggcacccgccaucaugcccagcuaauuuugguauuuuuguagagacgugguuucacuauguuggccaggcuggucuugaacuccugaccucaggauauccaccuuccucggccucccagagugcugggacuacaggagugagccaccgugcucggccugaaguuuguucuuuuaagagguuuguugaagguaaugaaggaggagauagcaugggaauuugagagagaacugaguuaaagagauguacuuuaggaggaaggagaaaggaaagagacuaaagagggugaguuaaagcaagagugagaugaggaaagucagguuuaggaagacauaguagggauuccuucaggagcacaggaagcggaguaccuuagagaggagaaucauguuuccaugagacaggagagaaagugaaccaguugaaaucucugugcuuuaguuuuuuucaauuguaaaauagagauaguaauaguauauaccuuauaguguagucaugagaauuaaaugaauuguacauuuaagcauuugcuacuauuaauguuauuauuaaauuaugaauuuauuuagaauaguuuacuguucugauuguagaguaccuuuuacuuauauaaugcauaugaagcacauaaaacaucuuccuuuuuuuuucuuuuuuuuuuuuuuuuugacacggagucuugcucugucacccaggcuggagugcaguggcaugaucuugcaaucuccgccuccuuaguucgagcgauucuccugccucagccucccgaguagcugggacuacaggcgcaugccaccacacccggcuaauuuuuuuuuucuguauuuuuaguagagaccggguuucaccauguuggccaggauggucuugaucuccugaccucgugaucugccugcuuuggccucccaaagugcugggauuacaggcgugagccaccgcgccuggccaauuuuuguauuuuuuaguagagacaagguuucaccauguuagccaggcugcuugaauuccugagcucaggugaucccccugccucagccucccaaagugcugggauuacaggugugagccacugaggccggccuaguuuuuuuuuguuugucugagacagagucucgcucugucacccgggcuggagugcgguggcacgaucucagcucacugcaaccucugccucuuggguucaagcgcuucucuugccucagccucccaaguagcugggauuacaggagcauaccaccaugccuuacuaauuuuuguauuuuuaguagaguuggugcuucaccauguuagccaagguuggucuugaacuucugaccuugugauuugcccaccuugaccucccaaagugcugggauuacaggcaugauccaccgcaccuggcccuaauuuuuguauuuuuaguagacaugggguuucaccauguuggccaggcuggucuugaacuccugaccucaggugauccacccgccucggccucccaaaauacugggauuacagcugugauucacugcgccuggccacaucuuccuuuuuucaauaggcaagugaaugccugcagacugaauuuuuuuucuccauugaaacauguuuauuuucuuucccuauuuagauuaaauuucccuauucuuucccuauuauuaguugaaaagagccuggccuuugcuccccagauaguccuggauucaaaucuuaaacucuucugguuguaugauccuggguuuuugucuuugcugauugugucauccuucauagaaaggaauaaacuaccuauuuugccagguuauuaguacuaaauaugaaauucucaauaugguguaaacccuuauagagcuuuauagaaaaaccuggauuuaaaaucuugcuuuguuacuuacugauuguguaaccucagacaaauuacuuagucuuucugauugucaauuuucauuuauaaaguagaauuuaagaagaaaucuauuucauuauuguuuugugaggaaauaguauauauaaagguuuuagcauagaauauggaacauauuaaguucuuaguaaagaguugcuguuucugcuaacaguauaggaaauauugcaggauuaguucacuaauuuuaucuuuguacaucuuuagacuucaguuuucuguuacacaguuuuauaacuccaguacuucaugacuaagcauuucuagauucaagaaaaauuuaguauaacauuauuuucauuugucuagagagaaauugugcacauaucugaaauucaaaacaaagguggcaguucguaguuugguuaugaauuacauuagaaaaucaagauguauauagguacaaaguacgugagccuuauaacuccccaaguccuaacauuuacuacuguugcaauuuuacauuuauuuaucuguugauuugauuaauuuauguuucuggauuuuaauuuccaugagggaagggacuaguuaguuuuuaccauuguauuccugccacauagcaggugcuuaugauauaguuugcugaaacggaugaaugaauauaaauuaagaaguauggacauuuaaguuacacaacaauuuauuuugacuguuaauuagaaauaaaguguuuuugagcuaauaugccuccucuuugguuauauaacaccuugugcuuuucucucucaugaugauuauuuuguguuauuguuuucuugauaaucucucccacuggauucuuuguuuucugaggaaggagaccuuguauuuuuuauuuuuguguuucuaaugucuagcacagcauuuuauacaugauaaauaguugauaaaucuuuguaaaaguaauuaaaugaauauugcacaaguaaucucuuuacaggaaaugcuggggcucucuaaaguaccacuuacucaagcaacacgugguccucagguacagcagccaccuccuuccaacagguaauaaauaugaugaagagaauuugaccguuucuguagcuauuuuaaacauuccauacccuugaacauaggcauucagugauacuauauuguuaaauauuuuuaggaauauaaguaaauuguauuaacauacuuuuuaaagaauugagucaaaaucaugucauuaaaaugguuuguuuuuugucuuaacaauguaaggaguuacuuuaguuuuguuauuuuccuuauuuuuuauuuugaacuuuggaaaaaacuuguuuuugugugguuuuagggcagccaagguuuuuauuuuuucuucuuagcuuuagagguagcuuuucccgcuaagguuucuggagugcaguggcaugaucuuggcucacuacaacuuccgccucccagguucaaacaauucuccugccucagccucccaaguagcugggauuacaggcaugcaccaccaugccuggcuaauuuuuguauuuuuuguagagacgggguuucaccaucccaaucuccugacuuuaugauccucccuccucggccucccaaagugcugggauuacaggugugagccaccgcgcccugcuagcuuuuuccccuaagcuuucuaaucagagguaguauuacuaaaauuuaguugauguauuuucucauaauuauuucaguaaccuaaaacuuacuagacuagugagagaugaaauccugaaguacuugguuugaguguuucguuuauugugguuguauucaaaaugugguuucuggggcuguuaucaucacgugucaccuaggaaugcguuugaaaugcaaauucuucggcuccacuccagaccuaccgaaacaaacucuagaacugggaccuagcaauauguguuaaaacaagcccuccagcugguucucauauacacgaaaguuugagaaccauuggucugcuguguguucagaguguuguuuucuauuuuuaggaaagugaaauuuguuuaucgaacucucacccauaaacauuuacaaauggcuuuuuauuuaauucuguuucuuagauucuuacaaccaguacagaaaauagacaugaaucucacagaucuucugggagaacuccagcgagacccuuggccuguaccacagggaaagagaccuuugcguuccucugggguggcacuuuccauagcuguaggacugcuggagguagggaagaugguuuuguuuuggaauguaaaguguguguguguguguguguguguguguguguguguguguauauauaauuauaaggauaagaagaaccaaagugcuuuuuuuccucccuauucucucacucagcaucaacaaagaauacuucuaugguuuucccccacauaccaaccaagcaguucugccuucgauaccaccuggguguccuguaauucaguucaauucugauacuaucuaacuggagauaacaucacaucucacagauugagggcucagucccacaagacugcccccacuuaagugccagucacauaguagguugucaccuauacuucucugauagacuggcuguaaauuggacacucuuggguuugauuaauuugcuagaauggcucacagaacucuaggaaacacuuuauguuucucgguuuaugauaaagauauuacgaagacuauagaugaacagucagauggacuagaugcauagagugaggugugggagaagggguuccaaauuucuguggcuucucuggggcaccacccuccaggaaccuccacauauucauuugucuggaagcucuccaaacuguguucuuuuggcuuuucaugaaggcucacugcauaggcaugauugauuacaucacuggccauuauccccucucuccuucuggagguugggguguggaacugaaagucucaaccuucuaaucaggcuuuagucuuuucagugaccagcccccaucuugaagcuaucuaggagucauuuuauuaacauacaaaaggcacucuuggcugggcaccucaugccuguaaucccagcacuuugggaggcugaggugggcagaucaccugaggucuggaguucgagacuagcacggccaauauggcaaaaccccaucucugccaaaaauacaaaaauuagccaggcgugguggcgggcgccuguacucccagcuacuugggaggcugaagcagggagaauugcuugaacccaagaggcggagguugcagggagcugagaucgcaucacugcacuccagccugggugacagagugagacuccgucucaaaaaacaaaaacaaaaaacaaaagguacucuuaucauucuacagaauccaaggcuuuuaggagcugugugucaggaaaggagaggaaaaaaauauauucacaguauuauaggaaaugguauguauaagauaauauugagugaaaaaaaaucagguuauaggacaguggguguaugauuuuaucuacgugaaguguuuuccuccagcauauugucuuguguauuguuuuguauauauccuguacagacaugauucuggaaagaaguucacccagauguuaacagugauacaauaaguggaguuuuaguagaauuugaaaauuuuaugcuauacauaucuuagcuuuagaauuacaaaauaguggcugggugcggugguucacgccuguaaucccagcacuuugggaggccgagguggguggaucacgaggucaggagaucgagaccauccuagcuaacauggugaaacccugucucuacuaaaaauacaaaaaaaaaaacuagccgggcgugguggcgcaugccuguaaucccagcuacucgggaggcugaggcaggagaaucgcuugaacccggaagguggagguugcagugagccgagaucaugccacugcacuccagccugggcaacagagagagacuccaucucaaaaacaaaacaaaacaaaauaguuuuuaaaaauguuuuuuaaaaaauuugaaaugcuaucaaauuuacagaaaagaugcaagaaguguauaaauaauuuuuuucuccaaacuauuugagauugugaaccccaaauaucugagauagucucaauuaauuuagaaaguuaauuuugggcuuggcguguuggcucacgccuguaaucccagcaucgugggaggccgagguggguggaucucuugaggucaggaguucgagaccagccugagcaacguggugaaacccugucucuacuaaaaauacaaaaaaauuagccaggugugguggcaggcgccuguagucccagcuacuugggaggcugaagcaggagaaucaccugaaccugggaggcagagguugcagugagccgggauugcaccacugcacuccagucugggugacagagcgagacuccaucucaaaaaaaaaaaaaaaaagaaaguuuauuuugccaaggcugaggacacaugccucuggagguccugaugacaugcguccaagguggucagagcacaguugguuuuauaaauuuucgggagacaugagacaucaaucaacauauguaagauguauguugguuccauccagauaggugggacagcucaaguagggaggggcuuccaggucacagauaggugagagacagguaggugagagacacagguaggugcauucuuuugaguuucugauuagccuuuccgaaggagcaaucagauaugcguuuaucuuacugagcagagggaugacuuugaauagaaugggaggcagguuugcccgaagcaguuuccagcuugacuuaucccuuuaguuuaaugauuuuggggucccaagacuuacuuuccuuucacaagauuaaguugcagauaugauagucccaaccccuugaaacuuuguauuuccuaugaaccaggauaaucuccuauauaaccacaauauaaaacuauuaaaauuaaaauguuaacacugauacauuacuaccagcuaauucucagaccccauucaaguuuuaccaguugucccaauaauuuccuuuacugaaaggauuuaguucaguccugcauuuauggcuauaucuauuuacccuccuucauccuggaacaguuccucaaucuuuccugaucuuuggaagauucagaccaguuauuugguaaaauguucuucaauuugaguuugucuugaaguauucucguaauuugauucaggucuugcaucuuugggaggaauaucacagaaguaaugcuguguucuuauuguuacauuuuacagguggcacaugguuuucauuuguucuguuacugaugauauucacuuuggucauucauuaagguaguaucugccagggcucuccacuuuaaaauuacucuuuuuuuaccccuuuguaauuaauaaacauugcaaaauauuaggaacccccauguugauuuauuucauuacugcugauguuaacuuuccuuacuugguuaagguuguuuuugucacuguaaaguuacagguuuuccuauuguaauuauaaauaucuuauuaggagauaccuugaaaauaugugaauaaccaguguacucagcaaacuuuuacccacuaguuuagcauccauugaugauucuuuucugaucaauuauuauuaugaugcaugccaaauaguggcuuucuaauuccaucauuucuacuuuuauuaauuggcuuucuacuugaggaagagcuuucucuccucucccauuuacguauuuauauauauauaaauuuauauacacauauauauauguaaauacauacagaauacacacuggguguauucuuacauucuuauuuuauacaacaagauacauuccuuuacuaucauaauuuacuuugaugcuuaaguuuuccccgauuuggcuagugggagccucuucaagcugcuucuggguccuuauuaaaugccgcauguuugcuuaaauacuuccuuucugguauaguaaguuguucagggcucaucuuauccuuuuccugcucuggaccugaaaugaaaccacuuaggagcccuguuuccuuuuagccuugguucuaccaagaagauaaugcuucaugugcacccuuacccugggugucauuaauucuaggucccagcggauggagcuaagaagaagauguaugugcauauauauguaucuauagauguauauaaaaucauaaguauaugugugugcauauaugucugcauacuccaauaugcaucuauaucucuauuaaaauaaaaaaaauuuuauauuaaaaaccaauguuucuuucagguauguucaauucaguaccacaggguuuauucuauccuucccacuuuuccauauuuguaacucauucucuaugagaaaccugcucccguuaucaaauauauuuacuuauuugcucaguccuagaauauauagaauaguuucagaguuucuagcucauaccucuguuagaaagaagcuuaggaguuagagcccaguauuuguuuaauguucugagaauauauaguacaaaauauaauguucaaaaguuaaguggguuauuccccuccacugcccuuagugugauuauguuauucuuugcuguaaguuuuauuuguaucuucuaguaaauuucuuaagaagacuuaagaguacagaauuucuugggcuguugaauguuuaaacuuuuuuccugugguucugauaguugaagaauagcuugguuggauauaaaaagcuuugguucuaauuuuuuuuuccuggagguuuuggaaaaugcuuuuucauuauuuucuuaccuugauguguguguguuuuuuuuuuuuuuuaaacagagccucuguugcucaggcuggagugcaguacgugaucauagcuuacugcagcacugcaaccucaaacuccuggucucaagcaguccuccagccucagacuccucccaaguagcugggacuauaggcccaugccacuaugcccagcuacuuuuuaaauuuguagagacagagucuugccauguugcccagacaggucucaaacuccuggucucaagugauccuaccaccuuggcugauguuuuuugagaaggcugauaccagccuuauuuucuugcccuuguaaauuauuugaucauuuugcuucaaggucuugaggaauuuuuuuuuuaucuuguaggguuuuuguugcagguuaauuuucucuaguaugugguaggcccucuuuauauguauuuuuuccuauaaaguugucuuauaguauuuuuuccuauaaaguugucuuauagcuuuaaauaguaguuuuguuccauuguuuuauuuuauuuaagaacucccggccaggcgcaguggcucaugccuguaaucccagcacuuugggaggccgaggcaggcggauuaccugaagucaggaguucgagaccagccuggccaacguggugaaaucucaucucuacuaaaaauacaaaaauuagccgggggcgguggcacacgccuguaaucccagcuacuugggaggcugaggcaggagaauugcuugaacccguggacagagguugcagugagccgagaucaugucacugcacuccagccuggccgacagagcaagacucugucucaaaagaaaaaaacaacugccguuauauauaaauugacucuucuuugcuugcuuuuuauuucagccaucuuuuuauuucuuuauuucauuuucauucucuugguuuuuuucuuuucuuuagugccucuuaccaaguuuucauuugaaucuguagucguucuucuaggccugcuguuuguuucccucuucucucuucuguguacuucuucccaaacugcccuugaucuuuuuggagaauugcaaugagagcaugagagauacaguucacggggauuuaguggcuuuuuuuucccuccaguuguaggaaauuugaaguuuggauguucuuugugucauaguuuuaugaaaguaucuguauauaguuuuauuugcucuuuucuucauuuuuucagcuuuacaugacugcuauuaucucaaauacccagaaugaagagaguauuuuuguuauuaguuaagaaaguuauagaaguaauaaucauaccuugugaaaacauucaaacaauaugcaaugguauauacaaauaaguagaagacaacuuuccuuguucucuagauuuguuaaccauaugauuuuauuuuauuuuauuuuauuuauuuauuuuuuagauggauuuuugcucuuguugcccaggcuggagugcaguggugcaaucuuagcucacugcaaccuccaccuccuggguuuaagcaauucuccugccucagccucccaaguagcugggauuauagguacccgccaccccgccuggcuaauuuuuuguauuuuuaguagagacaggguuucaccaugcuuagccaggcuggucucgaacuccugaccucaggugauccgcccaccucauccucccaaagugcugggauuacaggugugagccacugugccaggcuaaucauaugacuuuaaaaauuaucaugaaguuuauaucguuuacauucuguucugaagcuguaguguagguugaaaaauguacucuauuuuguccaauaaccacuuauagaaauuagagauaaaauagccuuucuaauaugacaauacaaauauuaauuguggaauaaaguagagcgauuauacacagagaaggauacuuucauauguaaaagucauaggauaucuuuuacauuuuuuucuagauccugucacuuccuuuggaucauacgcaguugcucuuuuguuucuuauaaguauucugaguucuucuauauucaaacauuaaaaaaaaauggcccucucauuucauugguaguuuggguggcuauagaauucuaguuucaaaauagucuucacuuggaaauucaagucauuccucucuaguuuucugacauagacauacaguuuauugaugauaauuggauguagucucguucuuuuuuuaggaaacuuauuuuuucacuagacauuuuuagaauauucucuuuaauuuuggaguucugaaauuuuguuaggcuguauuuagguuugauuuuuucuuucuuuaauuacguuugguuuugguagacccuuuaauucugaaaaauauugucauucuucagcuuaauuuauuucucuuucuauucuauauuuguuacauugaugcuggaccucuauaucucuuuauauauuuauuuuuuuccucauaucuuucuuugcuccuauuuauaugagauuuccucagcuuuguuucccauauuucuagcucagccuucagacaugcuuuuuggcccauccauugagguuuuaaaaauuuucuuaaugcuuuuauuuccagaaacuuuugagaguugucauguuuguugugauauccauuguaacaugugcuugguucuguaucucucagccucuaauuuucaugcaaagacccuucuccaggcagauggccugcuuucuacagagaguaguucuuaggaauugcugauggcagaaucugucaucagcugcuguaucuggagguauagauacacacuguuucuucuuugguucauugcugcuuuuuguauuuuuugacuccaaauauggagcuuuuugggcauccuccuuugggaagaucuggggcuuacuuuugauaucugugauguguuucguugauucuuuugauaauccaguacaauuuauuguuugaauuccucaaaauuucugaucuacugcuugcauuauuuccuaucuuuaaauuuuauguacuuuuuguuuuuuuuugagacaagagucuaguucuguugccuaggcuggagugcaguggcaugaucaugguugacugcagcaucgaacuccugggcucaaccaauccucccaccucagccuccugagaagcugggacuauagcaugucccaucaugcccaacugauuuuguuauuuauuuauuuuuuucagacaaggucucccuuuguugcccaggcugaucuugaacuccugggcuaaagugauucucccaccuuggacccccaaaaugaugagauuagaggcaugagccacagugucuggccuauuuauuuauuuuuaauuuuacuuuauuuuauuuuagacagugucucacucugucauccuggcuggaguacaguggugugaucuuggcucacugcaaccuccaccuccuggguucaagcaauucucuugccucagccucccaagaagcugggauuacaggugugcacuaccacaccuggcuaauuuuuguauuuuuuuaaguagagacaggguuuugccauguuggccaggcuagucucgaacuccuggccucaagugauccaccuaaaacaacuuuucucuuauuucauugacaucuugugaggaaggggaaguagauugggguauucaauccauuaacuuggacuggaaguguaagucaugcauacuuuuuuuucucucucucucucucuaucuuugucucucuuucucuuucuuucuuuuuuuugacagagucuuaccguguugcccaggcuggagugcaguggcacaaucucggcucacugcaaccuccaccucccggguucaagcaauucucugccucugccucccaaguagcuggaauuacaggcgcccgccaccaugcccggcuaauuuuuuguauuuuuaguagagauggguuuucaccauauuggccaggcuggucuugaacuccugaccuugugauccacccgcuucggccucugaaagugcugggauuacaggugugagucaccgugccgggccucuuucuuuuuuuuuuuuuuuuuuuuuuuuuuuugagauggagucuugcuccauugcccaggcuaaggugcagugguacaaucuuggcucacugcaaccucaaccuccugggucgaagcaauucuccugccccagcuuccugaguagcugggacuacaagcaugugccaccaugcccagcuaauuuuuauauuuuuaguagagacaggguuucaaccauguuggccagacugguuucaaacucuugcccucaggugauccacccaccucagccucccaaagugcugggauuacaggcgucagccacugcguccagccucuauuuuuuuuuuuuuugagacggagucucgccuuguugcccaggcuggagugcaguggcgugaucuuggcucacugcgaccuccaccucccgcguucaagcgauucuccugccucagccucccgaguaggugggacuauaggcgucugccacccugcccggcuaauuuuuuguauuuuuaguagagaugggauuucaccauguugaccaggcuggucuugaacuccugaccucaggugacccacccgccucagccucccaaagugcugggauuacaagugcgagccaccacgccuggccuuuuuuuuuguuguucuaugauacuuguguucuaaacaucaaaaacaaaaguaaaacaccaacaaaaaaauagaagagccaggugcaguggcgugugcuucucauuccagcuacuuggaaagcucaagugggaggaucacuugagcccaggaguuaaaguccagcacuggcaacauggugagaccuugucucuaaaaaaaaaaaaaaaaaaauuaaaaacccaaaacaaaacaaaagaagauguucacucuuccacuuuucucuccacucuucccugucugagaugaguuaagcaggagaaauauccauguuuauagggauuaggcucauagauuaguuuagaauuaggaaugugcuacuauauaccauaggauuuuaaaagaaaguuguucagauaccuuuguuuuuaaauuucauuguaaacauuugauuauuuuauuucuuagaaaauauaugcuuuucucuuauuuagaaggaauauauaaaaaauuauuaucagaaauguauauucauauguuuucuuuuaaacucuugacuuuuuuuuuaauaguguacuuuucccaacacuggugcucguaucaugauguucauuggugguccugcuacucaggggccuggaauggugguuggagaugaguugaagacaccuauaagaucguggcaugacauugacaaagacaaugccaaauauguuaaaaagggaacuaagguaauuuugacuguuaaauauuuuugccuuauuagaaaacagguauucauuugcuggcagaagaagaauacaaauaguuuuugauagaaauugguauuauacaguuugauacuauaacugguauucagaauuggagaaauauucauuuuuucuugauaauuuguuguaauguuucugguuugaaauauuuaaacacuucauaguacgugucaguagguaucuccuuaaaaauuauuacugagagaaacauucuaugccuuuuuaaauauucauguuaaagaaugccuuucuguuuaggaaaaguuguuuuuacauuuuucaguuuuucauuuccaagaggcaguccuuaauuuuuccuuuagauaugaauauuguucauagcuuaaauaguccaucauuuucuuguaaguuguuuuauguucaucuaacuucccauuuuuuggguuuguguaaguacauuucacuaauguugauuuuugacucucuuauauucguucuauuuguuaauaucucuuaauuuuuaaauucucuagaguucaguuuuaauuuggcuugugcuguaucauguauuuuuugauagucuucaucaguauuauauguuuaaaaguaauuuaugacauaauuuuugccacuguuggugcuuuucuuuccugccaacuaauuuccuuuuugagcuuggaauuuuucuugguuacagcuucaaaaaagguuuuagauucauuuaucuuacugcuuuuuguauuuucucuauuuuuggauguuuuuguuacuuggguauggauuuagcuaggaaagagaguucucuguuguuuuucuuucuuuuuuuuugaggcaaagucucgcucuguugcccagacuggaguacaauggcaugaucuccacucacuguaagcuccaucucuuggguucaugccauucuccugccucagccucccuaguagcugggaauacaggcacccaccaccacgcccggcuaauuuuuuauauuuuuaguagagacgggguuucaccguguuugccaggauggucucgaucuccugaccucaugaucugccugccucggccucccaaaaugcugggauuacaggcgugagccaccacgcccagccuguuguuuuugugcuauguuuauauaggaagaacaagauaugcaauaggacuuucuuuaaguuuggcuucauuuagggguuuaucuagaaagaguggcuuucaaggaaaaugugaaaaugucagacucacagaaguuguuguauaauuuuauuaacauuacagaaaguuaaauaacuaaucauaauuuaaauuaugaguuacucuuuuaguccuuagaucauuuugaucuguuaauggaaaaaagauuuauaggacaauuuuguauauuauuuuaauuaagaaaaucuuuuguagcauuuugaagcauuggcuaaucgagcugcuacaacuggccauguuauugauaucuaugcgugugcauuagaucagacaggucuccuggagaugaaaugcugucccaaccuuacuggguauguauuuaaauuuuuacaguuuuuguaauuauaagcaaaugaugacauuuacugauauaaaccaauaaugaccauuuagggaaaagugucaucuucccacuacuucaaggcaacacaucuguuaguaguuuuugauauuccuuucaguaaaacacacuuuugaauuuguuuaaaaauauggaguuauaaagguccaacccuguuucuaaagcucacuuugauaucuugaagucauuauuuugauuuauuacuucaacagcauuuuugagauaaaauucacauaccauaaacuuaccauuuaaaauguacaguuugaugcuuuuaguauauuuacaggaugcacagccaucaccguaauuuguuuagaacauuugcauuacccuagaaacuauguucccauuagcaguuacuucccauuauucccuccuuuuucuucucaccacccucucauccuuagacagcugauaauugccuguucuggguauuuuauaaaaugaaaucagaggcugggugugguggcucacgcuuguaaucccagcacuuugggaggcuaaggcagguagaucaugaggucaggaguucaagacaagccuggccaagauggugaaacccugucucuacuaaaaauacaaaaauuaggugggcgugguggcaggcaccuguaaucccagcuacucgguaggcugaggcaggagaauugcuugaacccggguggcagagguugcagugagcugagaucaugccacugcacuccagccuuggcgauagaguuagacuccgucucaaaaaaaaaaaaaaaaaaaaaaaagaggaaucagagccgggcaccguggcucccaacuguaauccuagcacuuugagaagccgaggugggaggauuaucugaagucaggaguucaagaccagccuggccaacauggugaaacccugucucuacuaaaaaacauaaaaauuagcugggcgugguggcacguggcuguaaucccagcuacucaggaggcugaggcaggagaaucacuugaaccuggagguggagguuucagugagccaagaagauugugccacugcacuccagccugggccacagagugagacucuguuucaaaaagaagggaaucaaauggucucuugugauugguuucuuuuacucagcauaauguuuucaagguucauccagacuguagaauguacuaauauuuuauuuuauuuuauuuuauuuuuacugcugaguaaaaagggaacaaggggcuaaagugcauuuaauaguauuccauuugauggauacaccacauuuuguuuaggaauccaucaguuaaugaacauuucauuuccacuuuuuggcuacugugaauaaugguccuuugaacaucguguucaaguuuugguguggagauuauguuuuuguuucucuuagguauauaucuaggagcagaauuguugcaucacauaguaaucuguccuuaacauuuugaggaacugucuaacgauuuucccaaguaacuguaccaauuuaaauucccauuaccaaaguaugaggauuccaguuucuccacaucuuugucagcacuugucguugucuguauuuuaauuaauuuuuuuuagauggggucuuucucuguuacugaggcuggagugcggggugcagucauagcucacuguagccacaauguccagggcucaagcaauccucucaccucagccuccugaguagcugggacuacaggcacaugcuaccacaccuagcuaauuauuaauacuuuuuuuuuguggagacgaggucucacuuuguugcccaggcuggucucgaacuccugggcucgauccuccugccucugccucucaaagugcugggauuacaggugugagccaccgugcccagcuuauugucugucuuuuugaugauaucuguccuagugggugugaaguaauaucucauugugguuuucauuugcauuucccugaagacuaaugauguugagcaucuuuuuaugugcuuacuggccauguguauaucuuuggagaaaugucuauucagauucuuuacccauuuuuaauuugggcuauugauuuucuuuuuauugaguuaaaauaguuuguuauuuggauauaaaucccuuuaucagauauaugacuuacagauauuuucucuuauggguuuuuucccucacuuuuuuuuuuuugagacagagucucacuuugucacccaggcaagagugcaguggugcgaucuaggcucacuggaacuucugccuccuggguucaaguguuucuccuaucuuagcuuccccaguagcuggaauuacaggugugcaccaccacacccgacuauuuuguauuuuuaguagagacaggguuucauuauguuggccaggcuggucucgaauuccugaucucaagagauccacccaccucggccuccuaaaauucugggauuacaggugugagccaccccgcccggccucccucacauucuugaugguauuguuugcagcacaaaaguuuuaaauuuugaugaaaccuauuucaugcuuuuucuuucuuuuuuauuuugagacggagucgcucugucacccaggcuggagugcaguggcgugaucucgguucacugcaacuucuuccucccagguucaagcgauucuccugccucagcccaaguagcugggacuacaagcgccugccaccacgcccaacuaauuuguuuuuguauuuuuaguagagacuggguuucaccauguuggccaggcuggucuugaacuccuguccuugugaucugccuuccucggccuccgaaagugcuaggauuacaggccugagccaccgugcccagccuugauuuuaaaaaauuuuuuaauuuuuaaauuuugagacagagucucacuguguugcccaggcuggagugcaguggugcgaucucagcucacugcaaccucugccucccagguucagcagauucuugugccucagccuuccagguaucuggauuacaggcauguagcaccaugccuggcuaauuuucauauuuauuucaaguuaucugcccgucuuggccuaccaaagagagcugggauuacaggcaugagccacugugcccguccaacaauugauuuuuauauguugauuuuacccccugcaaccuuguggaacuuguuuauuaguuuuaauaguuuuucuguggacuucuuaggauuuucccuauauaacaucaugccaucugcaaauugguauuguuuuacuucuuccuucccaccugcaugcuuuuucuuuuccuugccuaauugcccuggcuggaauguccaguacaggauuaaaaaugugagagugaauauccuuguguuguucuugaucuucgggguaagucguuuagucuuuuuuuuuucuuuuuuugagauggaguuucccucuuguugcccaagcuggagugcaguggcacgaucucggcucacugcaaccuccgcccccuggguucaagugauucugcugccucagccuccugaguagcugggacuacaggcaugcgccacuacguccagcuaauuuuuguauuuuuaguagagacgggguuucaccauguuggucaggcuagucucggacuccugaccucaggugauccaccugccauggccucccaaagugcugggauuauaggcaugagcuaccguguccagcccuguuuagucuucuaccauuagaagauauuagcuguggauuucaucagauugaauaaguucccuuccaaaaacucucaugaaaauguguuuuugggauuuuguuaaaugcuguuucuauagcuauugauaugaucaugugacuuuuguccuuauuaauaugguauauugcacugauuuuuggauuuuaaaccuaccuugcauuucugggaugaaucucacuuggucauggcguauaauccuuuuuauuauugcuaaauucaauuugcugucauuuuguugaggauuuuugcaucugucuucauaggagauacuggccuguaguuuucuuuuguuugguguuggcaucaggguaacugucgucacagaaugaccugggauguguucuuuccucuuccaugagcaguuauuauuuuugaaauaauuuaauuaggcuuaaaaaucaauuagauaugucaacacuuucucagguuuauuuauuuaauucauucaucuaauaaauaugaaugagcaccugcuauguagccaacugcucaaggcacugcaaguaaagcagugaacuaaacguaaaaaucuuugcccgcauggagcuuaucuucuagcgcagggcucuuccguauaauuucgcaauggauauauucuuugugcugucccauugaaauguggcaaguaugacugaggaacuaaaauuuaauuuuaauugcuuuacauuuaaauuuaacuagccacauguuaguacaguucuaaugagaggagauaggauaaguaugguagauaggaugucagauggugauagcauugggaagaaaaaaguucaggaaagaagaauugggguuugcaguucuaaauaggaugaauaggcagagccuuauugaaggugauauuuuagcaaagauguaagcaagugagagugagccaugugcauauaugaaguaagaguguuccaagugaggaauagcaaguacaaaguugagaauguaccuggggccaggcgcuguggcucacaccuguguaauccuagcacuuugggaggcugagguggguggacugcuugagcucaggaguuugagaccagucugggcaacauggugaaacccugucucuaccaaaaauacaaaaauuggcugggcaugguggugugcgccuguggucccagcuacuugggaggcugaggugggaggauugcuggagcuugggaagucgaggcuguggugagccaugaucgcaucacugcacuccagccugggugacagagugagaccugggcucaaaaaauaauaauaauaaagagaauguaccugugauguugagaaauagcaaggagaacaaaguagcuggaauggagugagugaggaggguagguuacaaaguccguuuaccuuuuuaaagggcuuuggacuuuaccuugagugagaugggaaggcguuggagaguuuucaacagaggaguuuuaugaucugacuuaauaguuuaaaaggaucgcugaauucauuugucauuuguagaguauagggauguaagaauaccaagugaugguagcacagauggugggaaguaguuggauuuuggauauauuuggaaaauagauguaaggguguggacaauuccuucauagagguuuacuguaaaagggagcagagaaauggggugguauaaauugucauuaaucuaggauguauuaucagguauaaugaugacuuagaucaucauagauaacauguuuguagaaaaucugaaagaauuuauaaacuauugguauuaauaugugaaguuggcaagacuucuggaucaaggucaguguacaaaguuuaauuauaaauuuauguaccaguaacauuaaaaaauuuaaaaggauacaauuucuaauaagcaucagagauaacaaaaacuucuaauaauaucaaaaguaaaauuauggucaauuaguuauaacacaucaguuuuauucuuuugccuauuuuaauuuuugauuguaucuuuuauugauguuuaauacuuaaaauauuuuaaaaaugugagcaaguguaucuaaauauuuguaugcauguguaucauauaaacaauauuuuauacaucuuuccucucuuuguguuuuucacuuguauccuagaaaucagucuguagcaguguauuacuccauuguguggauguaauauuuuuucaacuagucucuaauuacaugauuauuuggauuguuuucaguuuucuguuauucugaguuuguguuugaaauacaguauuucaaacacaagggaaaaaggaaaaaaacuuuuguuguuacaaauagugcuucagcgaauaaccuugugaauauauuuuguuuuucuguuuuuguuuuguuagaguaucuuuggaauagauuacuauuagugggguggcuggauuaaggaggaaauccauauauaauuuuguuagauauuaucaaguuacucuguacugggguuguaccauuuugcagucccagcagaaguguaugagagugccuguuuuuccauagccucaccaacauaauauguugcugucaaacugauuuuugccaaucuauuagagaaggaaugguaucaaaauaguuuuuaacuuucaaguuaauauuaaaauuuuuuuaauuaaaaaaguagguauaugcuuauuaaaaaaauuaaaaauaagugcaaaaagugaaaauacucucaauuuucuuccauucucauuugcuugguauaacauguauauuucaugugacacagauaguacaugcauauacauacacacacauacuuguuuuuaagagugagaaugggccagguggguggcucaugccuguaaucccagcaccuuggcagcccgaggugagcauauuguuugagcccagaaguucaagaccaaccugggcaacauggcaaaacccuaucucuacaaaaaaacaaaaaaauuagcugggcguguuggugcaaccuguaguccagcuacuugggaggcugagguaggaggaugacuugagcccaggagguuguggcugcagugagccgugauuguuccacugcacuccagccuaggcaacagagugagacccugucugaaaaaaaaaaaaaaaaaaaaaagagaaugcaugcuggaaacugucagguaccuuuaccaauauggagaacauuuguuacuauauacucuucuguaccuuuugaauuuuguaauaugguggauauauugccuauuuaaagaagaauuuuuuuuuaaauuaccaaggacaaaugcaacuguuagggguacucuguuaccuucggaauugagauuauuuguggggugaggauauucucauauauauuugaauauuaaaaauuaguaauacagcacauuuugggaaauaucuuuaaaauuuauugguaguuuugagagguaauuuucuucuacgauuuuaacacacggacucaguaacugugucaaguauguuguuuuuuuguucuuuccaugcagaggauacaugguaaugggugauucuuucaauacuuccuuauucaaacaaacuuuucaaagagucuuuaccaaagacaugcauggacaguuuaaaaugggcuuuggugguacgcuagaaauaaagguaagaaccaaaacuugacaugugcgauauguuaucaaaagacaacuuauaggcuugaguguaauucuaaaaugccauuaaucaaauuuaauauuuacuuucaaaauugugguuauuuuauauugaaaccugaguuagagauuuucuucaccagaagagugucaucauucaaugugugagacuuuacuugagcauuucugaacaauuguuagaaaaguagaacaauauugguaaaauauucuuuaacuuuuuaauuuuuuucuuuauauagggcuuagcucuuuaaaguauguuuuaucuucuuuuuuuugagacagagucuuccucugucgcccaggcuagagugcaguggcaugauguugucucacugcagccuccgccuccuggguucaagugauucuccagccucagccuccugaguagcugggacuacaggugugugccacugugucugucuaauuuguguuuuuaguagagacgcagugucaccauguuggccaggcuggucucgaacuccugaccucaggugaucugccugucucagcuuuccaaagugcugagauuacagacaugagccaccacgucuggccuguucuaucauuuguagagccaaaucuauuuauguuagugcuagguuaaugauaggaauuguuaucuaacuuaagaggaaacuguuuuuuuuaaaaaaaaaaaagaggaaacuguuuuuuaccuuucggauaaucaguaauuguuuuaugauuaguuguuauugcauaauucuaucauuuauuucaaauuuggauuuaaaauacccaaaggcuaagugcuucuaauccuaauugauucuuauuaaauuaacucuaagcacauuaauuuugaauuuucauuaaauauuuauuaaucuuguuuuauugaaugcuugcuauaugcccaacauugcuugggaaauuacagagaugccuagggauaucuaagguacacgucuugcuauagagaaacuuagcauucucuugauagagaggcagggaaagaaaacacugcauguaauagaaugacauaaugguaaauuauaaaaacacuauaaagguuuagagaagaaaaaugaacauauauaggacacaauuuauucuagacuucuagaggagugugacuuauaguuuuuuuuuuuuuuuuuuuuuuuuuuuuuuuuuuuugagauggaguuucgcucuuauugcccggcuggagugcaaugucaugaucucagcucacuauaaccucugccuccuggguucaagcaauucuccugccucacccucccgaguagcugggauuacaggcaugugccaccaugcccagcuaauuuuguguuuuuaguagagaugggguuucuccauguuggucaggcuggucuugaacucccgaccuugggugauccaccugccucagccucucaaaguguugggauuacaggcgugagcuaccgcgccuggccacaguuguuuucuuaaagauguuagaggauauugcauuuuauucaggaacccagugugaggagaggcauagaggugagaaucagcauuguauguuugagaaaacugcccagugagaguagaugcuuuguauuugaaugaaaggaaauagcuuaaaucugugggagcuggcuguaguguggagacacauguguaggcagaagucauuagguauuuuggguaagauucaucugacagugguauucugcauaugucaggaaaaagaaucucaaguaagaaaacaaaaguaagcuuuccaauuuuuuuuuuuuuagacagaagguauugugauagcuuacauuuugguggcaggagagacuggggggagaccaaucuuggugacagauuuucuaugggaggaaaaauagaauagggugucuaagguuuuagauuaggauaugugaauuuuggguggguagguagaagugugaagucaggaugagguucccaaauggagaccucguaugugcuaauggaaauagaagguuaacauuagguuggugccagauuuuaaauuugacagugagcauagaagugcuuauugauugauuauuuuucauguuaguauauuuucauuggcuuugaguuuuaaauauagaugaauaucuuauauucuuauacaccuguaguugaacauuugaacguaucuuugaggaaaccgaacaugcuguauucuuauuuugcagaccucaagggaaauaaagauuucaggagcuauuggacccugugugucacucaauucuaaaggacccugugugucugaaaauguaaguuguguuuauucuaaaaagaaaauacaggaccaggaacuguggcuugcaccuguaaucccagguacuugggaagcugaggcaggaggauugcuuaagcccaggaguuagagaccagcucaggcaacauagagagacccuguuccccuccuguuauccccccaaaaaagaaaaaaagacacagcgaacgcacaggacagcaccaauaaaaacuugggguggcagccuauagcauuccuuucaaaauucuuauauugauuguuuuagguaguucagcucccauugguauaccucuauucaugguugcucuuucugcauacccuuuucccauccaucccuaauuaaaacuuuuguacugucaccagucuucuauuuuuuaugccuaaauuaugucuugccccagugugccuaaaaaaaaacaaaaacaaaaaaaacucaugauuuggaaauuuggagacuucugaaagucaaaauuagcucuaaauugauuuuugauaccagaauuuucaaaaaaguaaccaaauuagccagauuuggaauuucaguucuuuauguucuuuuuauccaauuuaauggaaguauaacguacucuaaaaugguagaaucauguagcuguggagaggaugaugggacaaauaauacaaaguggguaaucaacuuuaaaaaugacaaagcuaaaaaauuaauauguacaagcaguuugcgugguaaaggucugucuauaucuaugacguuuucuugggaaucagagugcuuaacaauucucauccagagaacauguguucguaaaugcauauauuauauguuaaaucaguuucucuuuauacagaucaaguaguuggauagaaggauaauguuaguugcaauuacuucauuaaauagcauauacuuuuauuuuuuauuuuauuuuuuuugagacggagucucgcuuugccucgcagguuggagugcaguggcgccuucucggcucacugcaagcuccgccuccuagguucacgccauucuccugccucagccuuccaaauagcugggacuacaggcguccgccagcaugccuggcugauuuuuuguguuuuuaguagagaugggguuucaccguguuagccaggauggucuccaucuccugaccuugugaucugcccgccucagccucccaaaguacugggauuacaggugggagccaccgccccuggccaaauagcauaugcuuuuaaagagaacaguaugaagaacuuauauuaauacuuuuguaauuuacuuagcaagaauuuaaauuuuacuuuuauuauguaaaaauuauuuuauuuuuuauuauguaaaaaugcuuuauuuuauaauauacuuauggucuuaaaauauuuuaagcucuuaacauuguugaauuaguuugaaacaugacuuuuuuuuuuccuguggucuuuuuccauuuucacuuuaauauaaaauuaauaaauugugucucuagcuuucaaacaugcuauauuuuauuuuuacaggagauaggaacagguggcacaugucaguggaagauauguggacuuagucccacuacaaccuuagccauauauuuugagguugucaaucagguaugacuuucuacaucugaauaucaaaacguacaacguacauuugaauaaguacuuacuuuaggccaugaauaguucauauuuuuuuuccuauaguagauauaacccaacauuuauuuucuguauuggaauuuauauuugucguuuuuuauuuuucaaggcuaaacuccuuggugagaguacauauuguaauagaaaugcagggaaaccuacaaacgccaaaccuuggguagcccaacuuuuagucuguuuucuuucuuucuuuuuuuugaauauaaaauugaaggauaaaugcaguuauuuaaaauucccuucuagcuacacauuuuugcaauuagaugucuagcuuuuccuaguugucagaaaguauauaugacauaugagucuuuguacaagaaggucuaauaugucaaaauccauagaaaaaguuuggaaaguaaucguauuugggaagauuuuuuuuucugccacaggagauaauuaaucacauugaagaauaacacaaauuacugacuuauauauuaauaguuuuuagccauaaaaugaaccacaaaauauuaacagucagcuuuccuaaggcaggugcaauaguuuuuuuuuaaacauuaaaauuuauaagaaauauauugacucuuauugacaaaaacaaaacaacacacaaaaacaaagcaagaaugucuguugucagaaugcaggaauaaaguuuuccuauugauuacuuguauuucuuucugaugauaauuauuauauauugcuauuaguuucuucucauuauuaaucuuucauugguugguuguucaucauaugauuauguuccuaaaaguucugcuuucaucuucuauaccuaggggaggaggacuuagcucaauuucuguuuaucuaguuacaaguugaacaucucagaucugaaaucugaaauguuucaaaaucuggaacuuucugaaugcugacaugacacucaaagaaaaugcucauuggagagcauuuuggauuuuggauuuuuggauuuggggaucuucaauugguauaaggcaaauauuccugaguuuaaaaaaauacaaaauccaaaacauuucgggucccaagcauuuuggauaagggauauucaaucugugcaguuuggcuuaaauggcuucacuuaggaauugucuuuuaauuucuuugugcucucccuuuucuuuguucuuucaugucccucuggcuuauauauuacuugaaaauugauuuccuagcaggacugacuucuaucauucuugauuauuuuccuccucuccaaauuaauuucuccucuucuguguaacaaauuauaacuguuuugaaugcacuggaaauaaguauccuucuaaucaauuuuagaaugaauuauuuuuagugcuaggacauguagccugugauuauaugacaacagcauaguaaauuuugcuuagguuuuacuccauuauauuuauacagcauaaugcuccaauuccucaaggagggcguggugcaauccaguuugugacucaguaucagcauucaagugggcagagacgcauccgagugaccaccauugcuaggaaguaaguuguauuuguuagagauuugauuuucauaucacagguaucuggguuguguuuccaaacuggauuccuauuuugggugacauccaugacuagcaagugaauauuugugacuaauaguauuuuauuuauuucuuucuaacccagcuuauuugcuacaauaugcauuacuaagaaccguaagagcaauuuuaaaaaguacuucuaagacacacccuucaaaauauuauuuuauuuaccucauuccugugagaggagaaaaaucagauauuuaccuauaauagucaauaauaauauauauaauccauuauauauauaaaugauauagcacaguaauuaaucacauuacuuuucaauuagugauaaaaauucuuagcuauuuuuuuuucaaguuuuauuagucauuuaauucauuuauuaugccauuacucagcuucugcuuuguggaguagguucuguuuuaggagaguaugaaugcggaagccgugaacguacuuagccuccugcuguaugacagugugguauagagucauccucacauugucugugguaaagggccaguuguguuuuuuuuccuaauccuucggguacagaugcuuuuauuaaauacaauaaaaaugaauuacuagaaaaaugaaauuuuaaaaagugauuuaaaacaaacucccuguuuuauauuauuagauuaauaagauauaagauuauuuugugaaguugcucaguuucuaaauauuuauucucaguuccucuuuugacuucauggcacugguucacauaccacacuuugacuagcacuuguugagaccacaaaagguaaagucucuaucuaacagauucaauuauaggguaguauuuuguguaacauagucauguucuaauuuauugauauaggcaggguccccagaagggaauaauaaggcccaacagauaccuuuucuuauuccuaucuuugugauagauuuuccaaauaaggcauguauuuguucaugggcucuuugcccagcauuugcagagacaacaaauuuaacugaauuuaguaccuuucuuuuuauuaagaauuacgaauaaauuauuucucugcuacuuugguaucucuguguauuugugaaguauaaaacaaaaggaaaauaauuguggaaugaguuuaguuaggaagagguuuuuuagaugaggugaaucuagaaaugaacaggcuuuggucuuuauuucuguuugucuugaacuugguugucuggauaggaaaaguguugaucaguaaacuuacccaguuuagucauggucucgacaauggacaaggaaggcauuuguagcucucauuuucauuaaguguacuuaaacucuagcuucauuccugaaaaucuuaagacuuuuguugagugauggacaugaacacaacauuugaacugaguauuagcuguauugggugaucuauuacuuagcacaggguuguacauagauuuaguguucuguucuguuaccuugcuuugacuuaacauccuggaacaaugucaaggggauacauuauucauuugaagaaaaaaugucagcugaaccuucccuuagauuuauucagauuucagauaaggaacuuggaaguacugaugcuuggcaaacuucucaguuuauuuauggcucucaacgugugugcacacacacacacaugugugugcacacauuaaauuugacauucagaacauuugcuuaaggaaacaacgacauaccaaaugaaggacuuuuuacaacuuacaaagucacugguuuguacuauucaaaaaugucuuggaagacaaagaaagucugagcaacugauccagauuaaaggauacuaaagaaacauuaccacuaaugccaaugugugaucauggacaaaaugcaaaugucagggaaaaauuuugcuuuagaagccauuauuagacaauuggggaaauaugaauauagucucuuucuauaugauaauggcauuauaucaguguuagauuucaugaguuuaauaauuggagcuauauaagaaaauuuuuuguucuuaggagauauacacugaaguauuucaggcagaaggucauaauaucuccaacuuaaucuagaaaaguucagcaaaaaauguguauauaaauggagagagagaaugauaaugcagauguguuaaaaugcuaacaacugaugaaucuaggugaugguuauauaggaguuuauuccacucuuacugucuuuauguuugaaauauuuuuaaaaugaaaauuuuaaaagguuaggugacucuuucaagagacagggugcugucuuaugagaaauauuaugggcuuauauauuuucaguuugcacagaauuuaugaggcuauuuguagagacauauguguguuauggugccauuuauagcauugugucuuaccaaaagcauccgucuuuucaaguuaacuuaucccaaccauuuccaaugaucagagcaccuuguuguuuuuuuuuuuuuuuuuuuuuuuuuuuuuuuuaaacuaggacuaugacuuuaggggccuagacaaguguuuuuguuaagugaauaagccauaugaaaauaaaggcuccugagaagacaaaguuacucuauuuuucauguacaaaaugacuuugaucuaggaauuuugguuuaaacuaguuguaagaaucacagugaagggauacgggaaauguagaagacagauuuuuacaaugucaagaagcccuuuaaacuugacuuuaagagcccaccuuuuaauuuaugucuaaacaaauaauaauuaguaaauuugcauguguucacuuggaauguauuuccucuccugcaccauuauauuuucagaauuaaaaaagucaccuuuguaguucaguuuaaagcaaauaaauaccgucauucaaguuuagaaaguauugauucaaacaguguuguuuuaaauucuuugauuuuuaaaauuaaaacuaaaauaauuaauaaaacacuaaaccaaacuauuaguauaaucaugaagucuuuaaauugcauuaaaacauaacuuucaaaauuaccaaugucuucuuuuacacauucucagucuuuuuugcuucuuacuguuuacuacacugagauaauucacacguuucaaccaucugggaaacauuuaauaauuauuuugcuuauugaaagaaaauuaaaaauacagaaagaaggccgggcgcgguggcucacgccuguaaucccagcacuuugggaggccaaggcggguggaucaugaggucaggagaucaagaccauccuggcuaacaaggugaaaccccgucucuacuaaaaauacaaaaaauuagccgggcgugguggcgggcaccuguagucccagcuauuugggaggcugaggcaggagaauggcgugaacccgggaagcggagcuugcagugagccgagauugcgccacugcaguccgcaguccagccugggcgacagagcgagacuccgucucaaaaaauaaaaaaaauuaaaaaaaaaaaaaaauacagaaagaagggagaagaauuuuaaacaugcugcugccugaauucccuuaggaucacucaucacucuuacauguaaaagugguucagcacuuauuuucaggaagucuauaaguaugucuggccagucacuauaucugaaauauuaaacaaacaaacaaacagauaaaauguauugcugggucuaccuagguucaguuugaucugagucuacccaggaucaguuggauuuauacagcauuuggauuuaauaaauugcugcuauuuuauguguaguaucaaauuaaucccuuagacugaaguuuuuacuuauuaacuuuuaauugguuuuagucaguguauuaacauggaaauaaaagaauacaaaguaauuuuaauuauuugauuuuuaucacuaaugauugaaagaccaaugagaaacuuccgacacuuuauucauuuuccaguggaauaaacaagaauuacuuagguugagagaaaaccuuuauuuuuguauuucuauauuucugcuuuaacaaaauuaaauaaaugaaauuuuaaaguuggauauagggacuugcauaucuaugugugugggcacacguauauccuauuguuuuuacuuguaaaaaucuuuuauuggccaagugcgguggcucaugccuauaauccgaguguuuugggaaggcugaggcaggaagaucacuugaguccaggaguuggagacuagccugggcaacauagugagacccucaccucugaaacaauuguuuuaaauuggcugggcauggugguccgugccuguaguccugcugcucagaaggcggaggugggaggauugcuggagcccaggaguuugaggugaaucaugauugugccacuugaaccaugaucaugccacuucauuccagcuugggugauagagugagaccuugucucuuaaaaaaaucucuguuuuuuaaaaacuuccuuauuuuaugacuuuaaaguuuuuuuuuuuuuugagacaaagucucgcucugucgcccaugcuggagugcaguggugccaucuuggcuuacugcagccucugcuucccagguuaaggcaguucucaucuccagaguagcugggauuauaggcaugugccaccaugccuggcuaauuuuuauaguuuuaguagagacagaguuucaccauguugcugaggcugaucuugaacuccugagcucaagcaaucugccugccucagccucccaaaguguugugauuacaggugugagccaccgcaaccagccuagagauagggucuugcuguuucccaggcugaacuaaaacuucugggcuuaagugauucucccaccuuagccuccugaauaacugggacuauagaugugugccaccaugcugacuggacuaguaaaaauauuaauauuuuaaggaaugugguuggagagcugccuuuacacuuacuuuggaagauuucuuuagguuugguuauauuuuucugaaaaacagugaaugcuauacuaaaacugcuauuagugauuuaaaaaaaugcuaauuugagccugguguggugcucacgccuguaaucccagcacuuugggagguucagguggguggauugccugagcucaggaguucaagaccagccugggcuacauggugaauccccaucucuacuaaaauacaaaaaaguuagccggagccuguaguucuggcuacucaggaggcugaggcacaggaauugcuugaacccaggagacagagguugcagugagcugagauccuuccacugcacuccagccugggugacagagcaagacucugucuccaaaaaaaaaaaaaaagcuaauuugucuaaguaauauuggaauuuugaaauauugaaguaggcugggcgugguggcucacgccuguuauuccagcacuuugggaggccaaggcagguggaucacuugaggucaggaguucaagacuagccuagugaacauggugaaacccccucucuacuaauguugugggaaucaggagacuggagagacuaguaaguagaacaggaggauuuuauugagugcacucagaaccaguggauuaacauccgaagacugggcccugaacaaagacagggcuuggcuuaucuacacacuuuugaaagggggcugacuaguuugaaacaagcuuacaguggcaugaagcguaguggcacgaaagcucauguacagaggcagaacaaaggcaguuaauuaaacugugacagguucauaacucaggcuuaugugugacuccugcuauguggcccagauggcuguuaucuagcuuugcucaagagagccuugcacaggcuuaucucauaaccuucgcuauagcgccuagaugguugcaauccagucccgcucaggcaugucucaugaccuucgcugugcugcucaguuaaaacagacuacuugaaguugcuaguuauagaaaacaggaaucuguaaacucauagguuuacucauaucguaagagaaaggaaaauuuguuucucuuuuccuuguguuugagggagugcugggagggucuccagagcacauuccuuugagcccuggcuucuuggauaauguuaucgauacuuugccugggucugggcuuugccuguuacugccuuugggaugaguuagccuaauaccuaaagcuuguuuccuucucuuguuuaauuuuauuuuucuuuauuuguuuaauuuccugccucacuaaaaauacaaaaaaauuagcugggccugguggcaggugccuguaaucccagcuacuugggagguugaggcaggagaauugcuugaacccaauaggcagagguugcagugagcugagaucgcgccauugcacugcagccuaggugacagagcgagacucugucucaaaaaaaaaaaaaaauccuaguaguuucuguaucuuuuaucuuuuaaauuuaaauuugugugguagccaacuaugauauuguggguauaauaauucagaagcauuucuaugcuuucuuauugucuucagcugggcagaugcucaaacucaaauccaaaacauugcugcaucuuuugaccaggaggcagcugccauucuuauggcccggcuagcaauauauagagcagaaacagaagaagguccagaugugcuuagguggcuggacagacagcucauucgacugguaagaaauaaacacugugcuuuucuaaaucuguaugcuuucauuuguaguaaauguuuguugcagauaaucucuuucaaaguacuuaacaguguaucugaaauacuguaugagaaacuccuauucaaauuacugagacaguagcacaguaaugaauaguagaacucauuaaucucuuccaguaaacuagauugccuuuuuuccuuaaaauguaagagugacaauuauguaaccuauuauuuuucuauucuuauuggcuggaaugagguuaguucccaauuuaauucuauauuauuguaacaauuuuuagugcuuuuuuacauauuucuucauugcuguggcuuuaguuuuuuacuuucauuuuaauggaacuauuauaugugcaucucuuaaaagaaauuaggccaggaaugguggcuaauggcaguaaucccagcacuuugaaccaggaguucaagaucagccugggcaacauggcgaaaccccugucucuccaaaaaaaaauuggccaggcaugguacugugugccuguagucccaccuacuccagaggcugaggcgggaggaucacugcaacccaggagguuugaggcugcagugagcugugauugugcugcugcauuccagccugggcaacagagugagaccuugugucaaaaaagaaaugaacugggguagaaaaauuaugcauauuaacaugcaaaauauagacaagucuguauuaucugguucuagauuaccaagucgugugcuaauaaaguuauuaguaguguugauuuacuuagauuuuuaacaugccagaacaccauuacuguacuuacauuaugacacagagcacuugauuaagcuuagucccuuuuuuuuuuuuugagacagggucucacucugucacccaggcuggaguucaaugagaugaucauggcucaucauagccuugacuuccccugcucaagugauucucccacuucagccuccugaguagcugggacuacaggcacacaccaccacaccuggcaaauuuaaaauuuuuuuguagagauggagucugcuuauguugcccaagguggucuggaacuccuggguuuaagugacucucccaccucauucucccaaaguguugggauuacaggcaugagccaccaucaccauaccuggcuaauuuaaaaaaaauuuuguugagacugggucucacuauuuugcucaagguagucucaaacugcuaugcucaagcaccccucccaccuuagucucccagaguguugggauuuuacaagcaugagccaccacaccuggcuaagcucaguucuuaaugcuucauuuuuacuuagcaaccucuggcuuauucuuugaagguacuucuuuaugcacucuagcuuaaacacccuuuugagaacucuauuugcuaagcugucgaauuucuguguccaguggcuuuugugugguugguguaggcuuucauguaauuuuaaaaauucuugagugaacuagacuuguuuuaaaaaguuagccauuuuuauaucaucauucagaacuuuuuugauuucaccuccaagaguuuuuuuuauacuaguaccucuuugaaaaaagcagcauuaugacaauauuaccuuuuuuuuaaaaaaaaaaaacaagaaagauuaauccucucauaggguccacuauugaugggacacuauuagaacaaaugccaacacaguuccuucaagguggaucuuuuguuuccagauagauauaacauuaaauauauuuugacccuugcuuauuuaggauagcagaaaaguuucucuuuguagcagaaauuuuccuugaauuucacuguuauuuagaaaucugacaugacaucauugaaaccuguuaacucgucaaucuguagagaaucuguuauuuuucagcuuauuauacacagaugucuccagcaucaugugacaugucaucagugcuuugacuuauuguacuguuuuuaaaugggaccuuuucaauuucucagacuacaucuuuuuuuuguuuugagacagaguuuggcucuuguugcccaggcuggagugcaguggugcaaccuuggcucacugccaccucugccuccuggguucacgugauucuccugccuccgccucuggagcugcugggauuacaggugcacaccaccaugcuggcuaauuuuuuguauuuuuaguagagacggguuucaccauguuggccaggcuggucuugaacuccugaccucaggugguccaccugccuuggccuccuaaagugcugggauuacaggcgugagcuaccgcaccuggccucagacagcaucuuguccuagcauuuucacuuacugugauuuuacauauuggcaauauucuuuucucaacaacugugugacuuuuccuuuucuagguaauaaguuguacucugaaauagcuugcuuccuuaguuuuuuucacuaauugugacuuugucucaacaaaugcuucauuguuuagagauucuaaaagcugcuugauguaaucagcaccuuuugcuugucaaauggcugugauuuguaguaaagggcuuuuuccauuuugccagagguauugcugaauugguagguugucacauaugacacaaaauugaacaguacaacuuggauuacugucccauguaaaaccuacugauuuuccuuguaaagguggauuuuuuuuguaugucccuuguugcaugaauacacugaaaugacucagaugauuguaauucuucagaauuaucaggauucucugaagacuuaugucuagaauuguucucuuuuauaucuuuuaucucacaucucaauuuugagauuguuuuuuaauuuuuuuuuuucaacuuuuaaguucaggcauacacgugcaggaugugcagguuuuuuguauagguaaacgugugccauggugguuuacugcacagauaucccaucacccagguauuauaggccagcaucuauuagcuauucuucccaaugcucucccuccccucacuccccacaggugcccaguguguguuguugccccccauguguccauguguucucaucagucagcucccacuuguaagugagagcaugugguguuugcuuuucuauuccugucuuaguuugcugaggauaauggcuuccaauuccaucugugucccugcaaaggacaugaucugguuccauuuuuuuuuuuuuucgagaaggagccucgccuugucgcccaggcuggagugcaguggcacgaucucggcucacugcaaccuccuccuccagguucaagcaauccuccugucucagccucccaaguagcugggauaacaggugugugccaccacacccaggugauuuuuuuuuuguauuuuuaguagagacgggauuucaccauguuggucaggcuggucucgaacuccuggccuuaagugaucugccugccuuggccucccgaguacugggauuacagguaugaaccaccacgcccggcuagucuuguuccuucuuauggcugcauaguauuucaugguguauauguaccacauuuucuuuauccagucuauuauugaugggcauuuagguugauuccaugacuuugucucacaccucaauuucaaaaauugccacauuauuugacauguuuguaaaauguaagcacuaauguaaaacagaagggccuaguaauuaauuaaaugagacaacugcaaaaaguacaaaauuacauaaaccucacaguguacuuuacuucuaaucuacacauucuacauucugcagcauuuacaacagcagcagggcaguuggggcuagagaccagauuagucuuguggccccauuuuaugauaaugacugaaggaagcaagggcuuccugucauguuaaagguauccaaaacagacauggugccagcaccaauuuggcucuguaaugcacacugucuccaaaacaguacacaaaaaaugauguuucuuuuuaauuaaaguuacucuaguaagucaucaaggaaaagaaaacauauuacuaugcuaaauugagggaaagaaauuuauuaguauaauuuccuagguuuuugauuaggaaaaaacuuacaaaaaguuuuaauaccuaaacaguauuaacuuuuucucuauuuguguugcuguuguuguaauagcuaaaaauucagcagugaaguugucaguacaagaaaaugaggcuauccuagaauagcuacugaaacuaaagugcguuaucaccuaagucauuuaucacauaagauacugguauccacacaugauuuacugccucuauucucagucccuuguucggauccauugugcauccaacuucagggaucuguucaucucuuucuuucuuucuuucuuucuuccuuucuuuccuucuuuugagaugggaucuugccauauuacuuacccaggcuggacuugaacuccugggcucaagugauccucccaccucagccucccaaggagcaggaacuacaggccugugccacugcucccggcuuccuuuuugacuccuggccuuuucuguuucacaacuuaaaauugauggcugauucaucucugaccuuugguuuacccaucaaccacuaauuguguucucccuucagcugcauugcuagccauccuggguaaacacuucaucuaaucagacuugacucaggaaaucuucugucuuaagacuauugggacuuucccugcaagccagguuuucucuugcugcaccaaugggaugaaacacuuuagcuuuacuguuuuuacagauaccgcuuuugucauuaccauuuucuuauagagguuaggcauugaccccuaggguccuuuuauguggcugccuuuaugcauaaauaauuacugaauuaaagaaggaauuagccuuuuuguaagggauguuauuuuccucaggaaaaucauuacuguugcuuuaucugcccaguuuuauuacuucugaauaacucaaauagugggucuuggauauaccuucuuuaugcuucagucuguuuuccaccgguauuaguguuuugguuggguuguaaauaaggacugcuccucgugacucaaguaguugauacuagagcauuuuacagguguucaaaaaauuguuuuuggccgggcacgguggcucacgccuguaaucccagcauuuugggaggccgagacgggcggaucaugaggucaggagaucgagaccauccuggcuaacacagugaaaccccgucucuaauaaaaauacaaaaaauuagcugggcguggcggcggaugccugaggcaggagaauggcgugaaccugggaggcggagcuugcagugaaccgagaucgcgccacugcacuccauccugggugacagagcgagacucuugucucaaaaaaaaaaaaauuguuuuuuucuuuuucgagacagaaucucgcucugucucccaggccggcuugcaguggcacgaucauggcuuacagaguagccucaaccuccuaggcucaagcaauccuccuaccauagccucucgaguagcugggacuauagucacgugcaaccaugccuggcuaauuuucaaaauuuuuuguagagacaggaucucgcuauguugcccaagcuggucucaaacuccugggcucaagugauccuccuguguuggccucccaaagugcuugaauuauaggcaugagucagcacacuuggcucaaauuuuuuuuuuuuuuggagacagagucuugcucugccacccaggcuggaguccaguggcacgaucucagcucacugcaaccucugccuuccggauucaagcaauucuuuugccucagccucccauguagcugggauuacaggcgcgcaccaccaugccuggcuuauuuuuguauuuuuaguagagaugcgguuucaccauguuggccaggcuggucucgaacuccugaccuugugauccgcccgccuuggccucccaaagugcugggauuacaggugugagccacugcgcccggccacaauuuuuuuuuuuuuuuuaauagcgaugguugucuugcuauauuguucaggcuggucucaaacuccuaggcacaaucuucccaccuuggccucccaaagugcuggaauuacaggcgucagucacugugccagccuuuuugguguuuuaaggcacguguugagcuuuuuuguuguuaucuaagagcucuuuauuuguugugagagacacuuaguuaaaaaauauccaaauauuuuaaggugaguuauuaauuacauugggacaaugugguguuuguuucugaaauuuagauguuuuuucuuugguuuugucucuugguaagucuauaaguaauauuauaauuuuauucuuuaucaaguaucugcuuccugaugauugguaacuucuuguaaauagaauauuuauaggcaacaguguuagcuuuuauuccaggaaauaaauuacuaacacauuuuauuuuauuuagugucagaaauuuggagaauaucauaaagaugacccaaguuccuucagauuuucagaaacuuucucccuuuauccacagguaaguagguaaaagguccauauucuuuucuuuucuuuuuuuuccuuuuuuagagacaggcucucccuaugucauccaugcugaaguauaguggcuccaucauagcucacuguaaccuggaacuccggggcuuagucagccuccugaguaguuaggacuacaggagugugccaccaugccgagcuaauuuuuuuuuuuuugguagggaugguuuccugcuauguugcccaggcuggucuugaacucuuagccucaagcaguucuucugccuuggccucccaaagugcuaagauugccacauccagacagacccauauucuuuucuuguguggccaguagcauugagccucauuuuuccuuuuuuauugcucuuuuuaugguaucuauuuuauuggguuauucuuuuuguuagguaaguuuugggauagcuaagaaauuaauauugugcuacgaguaguuggugaaaaguauauaauauuuuuauauuggccuugcaaauagucauuuauuuguggugaauagagacuuauucuggaacccugcaguggguagaauuacauguaaggcugguuaguuuuccauuugacauaaggggaccuaauuauagugguaccagaaggacuucaucugagguuauuuuaccaguuagcuagucuugcaguaugguaucaucaccugagaacaauuuuauggggccagaccagauaaauagaaaauaaacucauuugauuuaccuuacagaauauuuuccaccuggagcaguggaaucuaucccuccaucuuccuguugauuugauagauauuuuuaagucuguguguuuagagugcugugugcagggaacuuuaggaggauacaggugacugacauggaucccucuuacaaggagcuuuuaaaagggugagaugugaaauauacauaaacaacacagaacagaaagugagaaauauacagaauuuaaaggaaacuuaaaggaguccuuccaaauggaugauuuuauauaucuuuugaaggaggagguggccuuuuagcuuaacuuggaaggaugauuaauauugagauguggaaauucauauuuuugcccaugagaacuuuguuuaaagcaucagcuuucuuuuucagagcugcucuguuuuuuuuuuuguuguuguuguuuuuguuuugaggauccuuuauugcugauugaucuauaacccagaaacuccaugcuuacagaggagagacuucccuaaaaccucuggugagauccuggagaaccaggaaaaggcaaggucugcuugucuuaaggcauguaaaauucuuuguuuugucauuuuuguagcagaaacuaauaggaaagugauggagggcauuagccuaaguauuugacuaaauucugcacacuuucucuucucucccugccucaagccuucuuguugggcuuuuagaucuucagagagaucuggacauuuccaucuuucuuccuuuccuggaaauaggaagcagaggacccuggaauacuuuuugucuuggguuuucaaagucugauaaucuucuaaaagguagcauagaccaaauuuaagggaagucuucauccccaaaauauuaccuaacauuuaccaauuggucauuucugugaguaaacaagaaugacugaaguaguaagggaugcaagagccucucaaugaauuauggauccugaaaacagaauaggaaucagaauuucagugaaugacauguugggagaaagcuguugagugagucccaggcaggagcaacauauaggcacuuaagaccugaggguuggaggaauuuaagagaagugacuaaagacaagugggaauacuuucuggcugauccuaaucaguuuuaucaaagacccaguguaacuguccauuauucaggccuaacucucccucuuuuugauuucuuucaugugaggaguagguggaagggaaggaaagugaaaggagaaagaagcagugaaacaaaaucuggagaauguuucuuagguauagggaagauauuaaauauuaagaaauuauauggguauauaugugguuguuuuuuuuuaaaccaguguagacccuucccaguacaauuuuuaagucaugguauucguucucauguugcuaauagacauacccgggacuggguaauuuauaaaggaaagagguuuguuuauuuauuuauuuauuuuugagacagagucucacucuugucacccaggcuggagugcagugauacaaucucagcucacugcagccucugccucccugguucaagcaauucuugugucucugccucccgaguagcugagauuacagacacaugcgaccauacccggcuaaucauuuuuuguauuuuuaguagagacgggguuucaccauguuggccaggcuggucuugaacucccaaccucaggugauccaccugcuucggccucccagagugcuaggauuacaagcgugagccaccaugcccagccaagaggcuuaauugacucacaguuucacauggcuggggaggacucacaaucauggcggaaagcgaaggggaagcaagacauaucuuacguggcagcaggcaagagagcaugugcaggggaacucccauuuauaaaaccaucagaucuccugagacuuacuaccacgagaacaguaugggggaaacugcccccugacaugauucaguucccuccaucuggcccugccuuaacaaguaaacuugaauugacaauucaaggugagauguggguggguggggauguagccaaaucauaucagccauauaaaaaguagaaaaucuguaauuuauuuuuauauguucuuagaaucuuugguguugguaaugaguaguaauaaaaaagcccaaagauauggucagacgugugaagauuaaaaacaaagaauggucauaguuuuacuaccuggcgucagccucugaauaacuuagauuugagcaagggguuuuugucuuuuuguuuuuuuccuuuuaaauacaaagucuuguuauguugccuagacuggucuccaacuccugggccccaagccaucccagaguguugggauuacaggugugagccaccaugcccagccauccuuuucuuacuuuaacuuaaaaauuuuuuuuuucuuucuuaaauuuuuuuucuuguggaauuuuauuuuuaggcagcugauaaauuuugugaauaggauuccuuuccugagggauauaaauuagaacauucuuauaauaacauguuuuguuauguuguuaauaguuuguaaucaaauauuuuugcuaauaguaaacaccuguuuuaauauuaaaaucaguaacaacuaucuuacguguuuaucuuacaguuuauguuucauuuaagaagaucuucuuuccugcaaguuuuuaacaauaguccugaugagaguucauauuaucgucaccauuuuaugcgucaagaucugacccagucucuaauuaugauucagccuauccuguaugcguauucuuuuaguggaccaccagagguaagagggacagaaaaaaauaaauuggucuuguuacugcaauguguggcauuaaaaaagugaaaauaacuaaaaaaaugcauauaguuacuaaauauaagaauuuaacuaaaagaauggacaucucaaccuauuaauguauucgcuuaaaauauuuaugaauguuuacuauaugcuagauaccauguaggcuguauuagaagauuguuaaauuuuuuuuuuuaaaggagauggaagagacuuucagaucauuuuguccagccauuugguuaaucaaauccuccaaagcauaugauuauucuuuacgucuuuaacaauguccagaagugauuauaauucuguagacuguagcuuauuccagaguuuagugucugugacaguuaugacauucugucuaaacaaaggcucuuguuuuaaucucauuuuccuuuguuuuuuugagaacauaaaaaauaguugauuauaaagacacaugcuuagaagauugauaaaguuauccauuuaaccuucuuagcagacugucccacuuauuuuaaccuguuaucaaaugaaccauuuuuccauucuguaguuaaaauggucuguuuuacuacuuaaaaguguguaguuacuguauuugaaaauaguaaggucaauauaaagagaauauuuacaauaucuauugauuaaugaucccucaugaugcuauuauucacgguuuuguaaaauaauggguaaaauauuuuauuucguuacaaugauuuuuuuguaauuggucaaauaguuucuauuuuucuaggaaauauauauuuuuaauauguugguuuggcuauauguauuuugccuuguauucuuugaaucaggaauguuuuagaaguaacuuuuuuuucuucugaguaauaacgugcauguagacaucugaaaaauguagaaugguguuuagaagaaaauuggaaucccacugucccuagugccugcuccuauuaaauuucaaccuuuucauuuaauccaugaauccuaucagcuucauguucuuaggguuuugcuuuuggaguuaucuucuuucuguucuauauaauuacuuucuguccaucuggaucauucuuauuaauuaacauagaaaccauaacaacagucagguuuauaacaaacggccaaaacacccccaccaugacccacgcuuucucuaacugccaccccauuucucugcuccuggugagaguugaacucaaaaaaguuauuuguuguuuauacuuucucaccucacauugucuucucaaccuauauaaguaagacuuuugucccuaacauuauauugaaauggcucuuauaaagaccaccaauguccuacaucucaccagagcucucaacaguauuuaccuagucuucacuaguacucagcccuugaaaaccuuuugcccuaggcuucugugacaccuauaccuuccugguuuuccucuuacucacucaccguucuuucucagucuuuugcuagcuuuucccuuucagaccucuaaguguugacaugcuuaagggaucaaucuucuggcuuucccugucuucccucucagugauguagucuaaucccauugcuuuaaucuuugugcuuuaaucuuugugcaugugacaccuagauuuaugucaucaguucagaccacucccuuucauuucauaugcagaacuauuuucccaugugcuccaaauuugcucuaucccaggccuuuccccauuuaggcuuaggaguuauccuugaauucuucuugacuuuacucuauuuuuaaauuguuuguuaccucagcuuaaagggauuccuuaaaaaauuaaaauacacuauaagaauucauaauagcaagagauuuuagguaauaaaauauaaauuucaaauuuaggccaucauggccuaaguuucaaauuuagugcugagccuguaaucucagccuuugggaggcuaaggcaggaggaucacuucagcccaggaauuugagaccagccuaggaagcauagugagaccccaucucuacaaacaaaaaaaugaaaaaacuagcuggacaugguguuacacaccuguagucccagcuacuugggggucugaguugggaggauugcugaagccugggaguuugaggcugcagugagcugagaucaugccacugcacaccagccuaggugacagagcaagacccuucuccaaaaaaauaaauaaauaaauaaauaaaagaaacuuggaaaauaaccuggaaacaucuauuuuauauuauugaguagauuauuuuuccuuuuuccucauuucucauuguuuucuuuacguuagccgguucuucuugauagcaguagcauucuugcagaucguauucuucucauggacacauucuuccagauuuugauuuaucauggugagguaagauuucaauagcauuuaaagcuaugcauguaaagucuuuuuacuuagaaagguuuucuuacuucuaauuguauggcuaguguuucaucuaugauaaacuuugauuuccauuuuuauaaaauaauaaaauaugaugcugccuacuauaagguuuuaggcuucaauugcaguugacccacaugugauuauuuuauucauuugucacacaauuggauuuugcgcaaagcacaguguugugaaaguaagaacacugacuguacauagacaaauggcacuuuuggguuuuaccugaaaacauuaaggggggaaaagucagccuuugucagugggcaggcuuuccuuuuacguuaugcaaucauuauaaguuauuauuaaguguucuacaugaucuugaaaacucauuuaaagcauacaugaauuaaaauuuguaacuucauuggaaugguaaaugauuacagagagcagaagauuuuaguagcuauuaagcuuuaauccagguauuuagcagaccuugaugcauuccugcaguuacucauucagccaauuguuaagugcuuccucuggaugcuuuggaagauauagauguguucuuuuuucacagaucuguucucaaacuuacagucuaguguuuuacuaaguucugcagauuuauuuuuucaguugcuuuaauuguaaaugauuuuagauuugcacugugacugggugugguggcucacgccucuaauuccagcacuuugggaggccaaggcaggaggauuacuugagcccaggaguucaggacuaaccugggcaucauagugagacccugucucuacaaaaaaauuuuuagaaaagauuuguacuguaauaguaaagacauuacucaaaauauucuuugaaguaguacuacccaggacuuuuuuuuuuuuuuuuuugagacucagucuugcucuuucacccaggcuggagugcaguggcgcuaucuuggcucacugcagccucugccucccggguuccagcgauucuccugucucagccuucuggguagcugggauuacaggcacaugccaccacgcccaguuaauuuuugcauuuuaguagagacagguuuucaccauguuggccaggcuggucucgaacuccugaccucgggugauccgcccguguuggcuucccgaagugcugggauuauaggcgugagccaucgcgcccgaccuacccaggaguuuuaaaagauuuaauuauuauuauuguaaauuauuuuuaauugauaccaguuucuaaugcccuuuacuuguuaagaauaauaccuguuuuaacuucuugccuuuguuaaaaaaaaaaaaaaaaccuguaauacugacagggcuuuuuuuuuuuuuuuuuuuuuuuuugcuuuuucuuuguuuuauggugauuuuuacuuuuucaaguagcuuguuaaaggagaaaucagaaaugcacaugauuguuuuauacagagguauaaagcuauaaaagaauguguugacugauucagcuaacuuagaaaauaaaccaggcauaaguuuuuagaugauuuaauuacaugguguuuagagcuacuuaccuauggauugauucaauugcuuucacguaucauaagcuuagguagauagcuuuuagcuaacauucauuugauaagcauaguguuuuaaaaauuuucugacuuauguaaguauucuuucauuuuacuuuuaaaggagaagaaauauucuaauuuuauauuuauuaagaauauuuucucuacugaaauuguaacuuuuaaaaaauugagguaaauggaauaauggucuauaauuuuuuuaguuucuaaagauuauuuucuuuggaaaaaucucaagauuuuuggaugggcaagaaauuuaaaguaauuucuuuaauuguuuuaaaauuagaccauagcacaguggcggaagucaggauaccaggauaugccugaguaugaaaauuuccgccaccuucugcaagccccaguggaugaugcacaggaaauucuucacuccagauuuccaaugccaagauacauugacacugaacauggaggcagccagguaaguaguguuaauuuguuuguguguuuguuuguuguuagguuugcagugagguguaccugcuugccuucugauuuuaauagauugcuucauaaagcagacagaaagguaaggagauagguggggaagguaucagugcuuacuuuuugcauuagcuuuugagagcaaaacaguaagauuauugacuaguugccuaaaccuggcacuuuccaucaucuucugucucuagccuagcuuccugaacagggccaggauggcauuguggugguauacuagcuuugguugaacaagaaaaugugaacagcuuggaaaguaauauacuuuucuuaaagccguuuauuuacuguuaaagucuaugaauaugacauuugugguaacuuacauuuuuucauugucuucauucuaucauuccaauuuucuagaaaauaaaauuuuauguaauaggaaaacacuguaguauuaugaaaagguuuuguggcuuuuaggauuuugaggauacauauacguuagauacauauacauacauacacaguugcuuugagaccuucagaaggcuaaguuagguuccuuaacauacucucauaaaauacuucuuacuucucuuuuguaauucuuauaagaguuauaauaaauuaauuauaaguuguuauuaauuuguuuuacaugcucuuugaaggcagggacuaugcuuuguauucccuagugccuaguacgguauuauaaaauagguagcaaauaucaguaacuguuauucagaaaugauaauuacuauuaguuuuacuguauuuauaugagaguuauuucauauugagaauuugcaaaguacuucugcaugccuuaucucauuugauccucauaagaauucuaguguuauuuucauuuaacagauaauaaaacugagaucuagguuacuuauggccaagggaacacaguaaauacaggagugggauuugaguccugguacuccagggccagugcucuucacuguuagguuaaacugauuccuuagagaguagaaaaagauuuuguaugauacuaaauuucaaaagauguuacugucuaugugcuuccauuaugaguuaaaaaucuuacugguucuuucauugaugucucacuguguguauuaccauuuuccucuuuuauucugguuauuauuuucaugaugauaagccauaguggguagaaggauaaaauguuggaucacuugucucauagaaucaccugugguuuaagaaagcuuaagggucauuauuuuaagcaaaagaacauacagauuuucauggcuuuuguuuuuaucauuauuugggauuuugaacuucugaccaaguguuuaguaauuucacaccaaccuugucauaauuguugcacacauaauuuuuauaugcugaguuuuggacucaacaauguauuuguuauuuuggauguaugauuuggagagaagaggugcauuuauuauuuauuuguaacacuuagugaccuauacauuucaaaguuuaaucuuuuaaaaauuaaguuaauaaaauuaauuuuaccaacacauacuaaauaaaauugauuuugcaugauauaauuauucagcugauauugacugaaaccauuuuugauggauaauguuauuucuucuuugcuuuuaaggcccguuuccuccuuucaaaagucaacccuucacagacucauaauaauauguaugccugggggcagguaaguuuaaauagcaggucuuggaaauuauuucuuuguguauuuauuguuuauuauuuuagugaaagcuacauuuuuuuccuguguauuuaguaaugguuucuguuggaaaaguaauguaaaaaugagaguagaaaacagaauuaauauuuggcgacaccauaggacaaaagugauccuaucaaauagacuccaaguuuagcacuauacccuugagacaaaaagcaaugaaguguguaagacaggaaguggugacuccaguuuaaugcuagguugugaaccacaaaaggccacgauaagccaagagaggccagggaucauaguugagaaggaggggcaggaacccugcaaaucauuauugauauaguuuaauuugguaaaaguccugcugggugugguggcucaugccuguaaucccagcugcucaagaggcugaggcaggaggaucacuugaggccaggaguuugagaccagccugggcaacauagcaagacuccaucucuuaaaaaaaaaaaguguuaaccucuugguauaacauaucaacauuuauugaguguccaguauguuuaggacuuuguauuggcucuuuagggugcaguuauuacccaugccuuuggagagcuuguagucuaauauuagagauaaaauacauaccuaaguaaauuacaaggcagaaugggauauuuguccuuagaaagcuaugaaguauuacaaagguuagaagaggaagauggcaagaggucacauagugguagcaggaagaggguguguaaucagaaaagagcucagaaaaaagaaacauuucauuuaaagaaugguuauuucaguaauuggaaauugcaugaggaagggaaaucuagguagagaauaguaugggcuaagauaaaagacuacaugcagagcugacuagaagaacauaaaacggaaauguguuguacaaguaaauuguggaggaucuugaaugucagguugaggagugagaaguugaguauuuauuugguaaguaauggagagucauugaagguggacagagggcagauuugagucuuaguauaguugaaucuuaagauuaaauggaagcagucuguagguugaaaguauauuuacgaaaauaauccaagugagagggaguaaaggcaagauggugaaaggaauagauuugggagauauuuuaaaaguagacucaauaggacuugauuagaaguugcaggaaaguaauuauuccagggcauggcaacuaugcacaaaaucugaauucugauugaauccuggauuaaagggagagaauagcuauaaagaacauaauugggauaauuugugagauuugaauauagaucauauaucagauaacuaguacagaauuauuaaauuucuugagagugauaauggugugguuauguaggagauucuucuugaucuuaggagauacauccugaaguauuuaggaauaaaaugucaugauggcuucaacuuccagaaguuauucaacaaaaagaagaaaaaaggaaaaauaauguagaaacauaaagcauacguggcaaaauguuaacagucagugaauguagguaugcuauauggguguuuauuguacuucucucucaacuuuaauguagucuugaauuuuuaaaaaacaggugaggggaaacaggguauuuugggguuuuaagccugagugacuaggaaaacauaugucaauaaaugggagaguggagagaaauuguuugguuuagacacugaguuugagguacuaucuagaaggccuuauugagccacaauaagaugaccauauugauuauggccauguugagugggcuguuggcaauuuggguuugauggucagggcaagaaugagaaaggugauaaagucaucacaguaaaugcuugucugaagagagaguaaagagguaaaggagagaugagacaaaaacuucaggggaguacaagugguaggaguguuuagugaauuaucagagaggcagaaugaaaagaauaguaugucauaaaaggugacuuuauagaaggaagaagaaggagguaacaaacugacaugccgcagacaguugaagagggauacagagugagaaaaggugcuuggauuugauggcuaggagguuauucguggcauuguguaagcggcuuuaguauggugguugaguaagaagauaaauuuauaaggaauuagugggugagaaagaagcggaggucgaaaguauaaaugauucuuuugcaaauuuaaccugaggauaagcaguaggauaggcagaugauuguuauuacgguaagggcacagaacuuauuuggagaccaagcauaggaaagacacaaaagaacagauauuuaagauccucaggagacaauaugaucauaagcaguauauggacguuaagcauugguaaggaggcagggcacuuauuucugcaaaagcaaaagguaagaagggugaagacagaaagguuuuuagguggagugaaaacucacauuggauaauugccuguuucuuuucaauaauaugagauuauuuaggagugaaaaaggcuggaguuaggggccaaaaaaacuagaaaagauuaaaaacaguucuaaagaauacaaaaaucaacugaagauuaauaaaacgcuuuugcagcaguggugagggccuauuuuauuuacuaaaaauaucuagagcaugcuuccauaauguucuuuuuuuuuuuuuuuuuuuuuuuuugagacggagucuugcucuguugccaggcuggaguguagugacgcgaucucgacucgcugcaaccucugccuccuggguucaagcgauucuccugccucagccuccugaguagcugggacuacaggcacacaccaccauacucagcuaauuuuuuugguauuuuuaguagagauggaguuucaccauguuggccaggauggucucgaucuucugaucucgugaucugcccaccucugccucccaaagugcugggauuacaggugugagccacugugccugggaguauccaugaauagauuuuaauuguuucaugagggcggaacccuuaugacccagucaccucuuaaaggccccaccuuuauacugccacauuggggauuuucaaaaugaguuuuggaagggacagauauucaaaccauagcaccguccuacaauugcaugauugaauuuguguaauaucccuguccugucaucccuuuucccgccuccauuuuuuauggcauugcuccuguuagauuauuaauuacuugaggcaauaacugucauuuucauuuuugauuuuccauaggaccuuaaacauagcauauauugaauacaauagaucuggacaggagagagcagagauuagaauauuggaaaucuguggagguggcuaggaguuaagaguuuuuguaauauagguaaauaaauugaaucccagguccaaaaguucuaaaaguuggggagguuauaaaaaguaaucuuggaaggguggaaggcugguaauggaaaaugcagacucugcaaguuacuugacuucucuuuguuuucacuuccuugucuauagaguuuaauaaaacaugcuugaaauggacaguaauacucaguaaauguuagcuauuaguuuucacuauuaucaauggaaaaaaaagucacuucuuauauuuaacaugggaaaggaaaccuauuuuaaacucugaaguguaauuguuacugccuggaaguaggggcauuacaggcauaaauaagagugcucaggucuuucuuaagauuuuuaugaguaaugaugucaauauuuuaauaaucauaauaucuaauacacugaaucuacuguuuuagucacuaugcuuuuaguguacucucauuuaauuaacuuuuauaagguggauacuaguaauccuauauuucaugagaggaaauugaggcucauauagauuaaguauuuuaugcaagaucauguagcuaaacuguggcagggucuagauuuuaaccaaggucuaacuccagacucugaauuuuuaaucaaguuaauuugaugauugcauuuaaaggaaauaacaguaaccaagaauuuuacuaaaaauuaauggacucuaauagcuuacaggauuuuuugggggucagaaaucaaggacccuaugauaaguauuauccaugaacggccguaagagggcaccacugcaacacuucugugacagugcuggaggccucuguugcuguagugccucauauacuaaauaauguaaagcuuguaccuuucugccuaauccuggauauauuuuaaauagaaaaaggguccauuugaaaaguugagaucagcuaacugcuaauuuuuuauaaaaucgaaugagcauugguauuuaucauuucaagcaggagcucugugguauauaaauuaggaaauccuuauauuuugucuugacuaggagaaauggcucugagauugggugacuugagauggaaaacauuguaaaaugaaaauaaaaucaggcauaguuacaggaagaaaaaaguaagagccaugagguuguuacugguuuagguuacaguuuugagacuugugcuuuucuguguuagcuaugcauauagaauaaagaaaaguauuucauuguuauagauuuuugaacaggaggaacaauagaaauagcuaaaacauguaugucuacuguguguacuagguacuguucuguuugcuuuauagaauuuaacucauuuaaucauuacaacaacuuguguaagauagguccuguuauuauccuuguuuuacacauggggaaacuaagacauaguuuaaauaacuuauucagucauauggguaggaaguggcagagccagaauuugagccuaggcauucuggauccagacucuaugcccuuaaucccaguaagggauugccucccuucauuaucaaaucuuucaaguucuuuugaauaaacauaugauaaaauugauuucccuuuauucaggagagguuauggcauguuuguggcuaugccagacuagaaucacaggagcuauaaguucucaucucacauuugccaauaauuugcugaaauuacuuaauuucccuguuuuagacuuugaauauuuauaauuaauaagaacuugaguauaagaagaaaaauguaaaauucagauuaaaaaucuucuagaaauaccuucucuugcugaaguaaaauuucauuguuaauggauuggguuaccaagaucauucugucaauacaguuuuuauuaaaauggauaauaggaauuuucccuaacucuuguuaauuacuuggaaccuacagaaaucaauuaaaacgaccugaaaacuugagaagcauaguuuauuuaaaaaaugauauuaugaguuugcuuccuuccagcugggauuucucuuaaaaugccagggagaaagggucuggaggucaggcuuucuuuuaaaagcaccaagccucuaauuccauuguuagucuucguggugacuagccgccauccugauucaucucaucucauagcauaaacuccuaugugaucccaucagccuaugaauaaagacacuccuauuaucagggaauucuaaggauguagagucucccucccagcaaccagggacggaggccaguuagauucuuuuuauuuaauaggaccauaggcauuucaaaugauuuccuugucuauuuuaaacauuuguguauaaauuccaugauaucacccuaugcuuuaaucauaacaaauaucuuuuuuccucuaggagucuggagcaccuauucuuacagaugauguuaguuuacaaguguuuauggaucacuugaagaaacuugcuguguccagugcugcuugaagugcuaauaauguuaaagacacuuaagaagaugaaauaauauucaaauuucauuuuuuccuuuuuccauuuaucuguggaaaccaacagauauugcucuauauuuuuuguauuaguaugguuugagacaacauauggaaaauguucacauuuguagauuaagcuggaauuauaaugagagcaauaagaacaaauuuauuuugcuuaccacaguguuauagcugguucuagaaauuugaagucuuuauaacuuaauuauguuuaauaaaaaauagagucugccucguacuacagauguaacucauuuguauauugcagacagacccaaaguggcacugaauuuucuugcucaccuuuuaaaaacuuguuccuuaauuuuagccagaaagcaaaaaaacaauaguaaugauaaaugugaacauuuuugcuuauucauugaauauuuuucuguaauuuucagcacuuauguauacacuuuuucuguacuuacuagguuaaggcagauuuauuuuuaugauuuguuuaggaauuauuugauuuuauaaugguaauuuucaugaugauaauguuuuugguuauuuggaaagauaguuuagagaugaaagguuuuuuuggguaacaaucccgcagcugacaaaaaaugugaaauuuccacaaaauauccaacuuaugugacuaaacgcaguaguuuuuuuaaaaggggagauagaaaauaaaugguuuuguuggagugcauuuuaguaagccuuugcaguaaaaugacgguuguaacuacuaaaccaaauuuaguuuucacagcaugguuuuguuguuuuccccuuguuuuucagagguaaauuuugcauuauauccuucaguauuuuaacacuauuuuggcaguuuacacauuacuuuuuguuuuuccuuccuuuuugugaaauguauuaaguugugguucuuauugaaacaguauuauauaauguuugcuuaauuauaucaugugaugcucaguucuauuuugauuuauucauuaguauucacuuuuaccuuuaaaguuuacuuguagcaaauauguuuacauugauaaagccagauauguuuugacaaugaaauuuacauaucaaguacugcaaauaaaagguggugcuaugauauaugcuuaggaggacaguuuuaaugauuguacuugcaugaacacaaucauaugaugguaaagcagaaacuuaagaaaaaauuguuuauguguuauauucaauuagcuuaaauaaguugcuuuguuauauuuuauuugaauugaacuacgcuaggccuaaaugccaauaaaauauacuuuucacuguu

SEQ ID NO: 192354 - RNA, 22690 nt, Homo sapiens
cgcugugaccuagaaugggcgcaugcgccgagcggaacuggcugguuugaaaaccauggcguggguaccagcggaguccgcaguggaagaguugaugccucggcuauugccgguagagccuugcgacuugacggaagguuucgaucccucgguacccccgaggacgccucaggaauaccugaggcggguccagugagugauucggcccugggcgggugggcuggucuucugcccugccccuggguacagcccucggugcucuauucccguuccagucuguugcgaguucaggucuauucaggauucuggauuacauccuaacgugggcgaguuucuguugaacgugauugcacguaucaagaugugugcucuuagauuuguuuucaauccagauaauuucagaaauacauuguuuaguaccucaauuggaagucugaauuuuuuucugauuucacaaugaacuguggaaguggaucgcuuguuuuacuacaccugagcaaagcacaacagaaauuuaauuuaucgcguuuauuacuuauuuguaggaucgaagcagcucaauguccagauguugugguagcucaaauugacccaaagaaguugaaaaggaagcaaagugugaauauuucugugaguuuuauuaaccgucuggagauuacccccaaccccccaauuaaaagacuaacgcucuuccuauaguaucugacagcaucaauuaugacguaagauuugacuacuccgugcaaaguuagacauucgcuuguacuuuuuccuucagaaagacaauuggcauuuacugccucuaaagaggcuuucuguaacucuagccuuuguggaguguugcccaucuuacuucaggacauuauccaguccuuucaaaggagucuuuaaauggguuacuuauguuaucuuuuauuuuuugcuuguuuguuuguuuauagagagggagucucuguugccagcuggucuggaacuccuggccucaagugauccucccuccucugccacccaaagcguugggaucacaggcgugagccaccucaccuggccccuuuauuuuuuaaggaacuuuuuccaguuauuggauugguguuuaaucuuagugugcuuugcauguucugaauuugaccaaguuucacuuuuuuuaagaauagaaacccagaugucuuacacuuuuuuuuuuuuuuuuuuugagacaguuucacucuuguugcccaggcugcagugcaguggugcgaucucagcucacugcaaccucugccuuccgguuucaagcgauuaccgugccucagccucccgaguagcugggauuacaggcgcccaccaccacacccggcuaauuuuuguauuuuuaguagagacgggguuucaccauguuguccagucuggucuugaacuccugaccucgugaugcgcccaccucugccucccaaacugcugggauuacaggugugagccaccauacccggccuuacacuuuuauagcuacuugcacacucuggacauuuucauuuauuuauuuauccagcacaucuuuaauuaagcaacuagguugugccgggcauugggaauucaacagaggguaagacaaaaaagguuccuacccuuguagaguuuacauacccuccugaggaagacagagaguaaacaagcaaacaaauaauuacauauugugauuauugcuaugaagaaaauaagcauguauaauaaucaauaaaugacagaacuacuguagaggaaucauagaagggcucucuuuuucccccuuuuuuuuuugcgucucaauuuuucgcccaggcuggagugcaguggcacaaucucagcucaucacaaccucugccucucagguucaagagcuucucuugccucagcccccugaguagcuaggauuacaggcgugugccaccacaccugacuaauuuuuguauuuuuaguagagacgugguuuuaccauguuggccaggcuggucucaaacuccugaccugaagugaucugccugccucugccuccuaaagugcugggauuacagaugugagccaccacgccuggccagcaaaggucucucuaaggaggugcuauuuaaccuaagcucaaaggaggguggcauuuuauuuuauuucuuuuucuuuuuuuuuuuuuuuugagauggagucucagagucucgcucugucgcccaggcuggagugcaguggcgcgaucucggcucacugcaaccucugccucccggguucacaccauucuccugccucagccucccgaguagcugggacuacaggcgccugggagaguggcauuuuaaauaguugauaguaauuuccuuuucaugcucaaaguaguuucucugauacuuguaaucaggaaauuuuaauucagacacuguaauuuuuccuauaauuccucuucaggguuuuuuaguugauggacauuuaauggaacagaaugucuuaauauaccuaauuugauggauugauugauugauugauugagacagggucucgcuuuguugcacaggccagaguacagugccacgaucauagcucacugcagccucgaguucuugggcucaagccauccucccaccucagucuccccaguagcugagaugacaagcaugugccaccgugcccagcuaauuguauuuuuuguagcgacggggucuugauauguugcucaggcuguaugugcucuuuuagaaaacagaaguauggcugggcuuaguggcucacaccuguaaucccagcacuuugggaggccaagucaggcggaucaccugagguggggaguucaagaccagcccgaccaacauggagaaaccccaucucuacuaaaaauacaaaauuagccgggugugguggcacaugccuguaaucccagcuacucgggaggcugaggcaggagaauugcuugaacccgggagacggagauugcagugagcugagauggccauugcacuccagccugagcaacaggagcgaaacuccgucucaaaaaaaaaaaaaaagaaaacagaaguagacaauuuaaaguuaagcgucuuuaaguacauuuugcccauaccaaaguucuuauuuuuaauuuuauugauacauaauaaucauaauuucaugcuuuaucacgcaggcacaauaauaauuguacauauuuauggaguauaugugauauuuugauacaugcauacaauguauaauaaucaguaauuaggauagccaucaccucauuuaucauuucuuucuuuugggaacauucaaaucuucuagcuguuuugaaauauacaauaaauuauuguuaacuguagucacucuacugugcuauugaaugcuagaacucauuccuucuaacuguauuucauaccagaauucuuuauuugugguauaucucucuuuuuguuucuguuuugcuauucuagaaaggcagguagggcuagaucauauucuccaggcucaugucauuuagauuucauagaaacuccaacuauaaaccuuuccagauuucucugauuaaggugacuaaggcucuuucccuaauauuuuuaacugagauauaaauaauaaagugaaaugccuacuuuuuuacaucugcaaaaauauuuuauuuucuuguauaaucuuuauuuuauuauacacuuuaucuugguuuuacuuuugcuuugcagaggcaugagauucuaguuuugacacuaauguugauccuaauauuugugaacuugaucucuagcuuucaggaugccaacccgccccugaagguuauuccccaacacuucaauggcaacagcaacaaguggcacaguuuucaacuguucgacagguaagugucauauuuaaucuaauuaagccccuguuggauuuauuucuguucuuagacuguagcuggaaaaauaaaauuuaugauccuaaaguauacagaauauucaugaauuaauuaccaaauuauuuuuauaaucauuagacaugauacaguuugaaauauuuucuaaguuuuguuuauuuuuauuuguuuguuuauuuauuucaauaguuuuggggaacaggugguuuuugguuacauggauaaguucuuuaguggugauuucugagauuuuggugcacuugucacccaaguaguguacucuguacccaauacauggucuuuuacaucucacccccucccaccuuucccauuuuucaaguuuuagaugguuacaauuuugugcagaaacugauuucaguuauccauuuuuugaagaguaccaucuaaugucuaaguuuucuuccuuuagaaugugaacaaacauagaagucacuggaaaucacaacaguuggauaguaaugugacaaugguauguaaguuucucaguuuuaagauguacaauguauaccugauugaaagagucuauauuuacuuccagucguuaaagauucacuugccuagucaguguuacuuucauucucuucaauauaccauuaauaguaacaauucauuacauuaguagccuggaaaguauagauuuucaugacaaauuuuuuuuuuuuuuuuuuuugagacagggucuugcucugucucccaggcuagagugcagucauggcucacugcagccuugaccuccugggcucaagugauccucccaccaccgccuuccaaguagcucgaacuuaaggcauauaccaccaugcccagcuaauuguuaaaauuuuuuguagagacaaggucucccuguguuacccaggcuggucucuuacuccugggcucaagugauccuccugcccuagccuccccgagugcuggauuacaggcaugagcuacuguacccagccuuucaugucaauuuuaauucacaauaucuugggggacuuuggauaggugacugugaaacuuccacaaguuuuuaaggauucuucuagacauuuacuuucuaggaaauaaauacauuuucaauauuuacaaaaaaaauugaauaaagccuuaauggauuuuccugaugaggugauggugccaugcaguaaacucacauguuuacagaacuugugaauggauucugcuucugcuuaaugugaugagucugugucacaauuccagugacauauaagugaaaccugucauguauauugucaugcauauguccuauauuuuaucaguuuagauauaacuuuaagcccuuuaguagauauaucaggacuaccaaaugaaaaaaggaguuggaaagaugauacauugucucaggacaguaguuuuuaaccuuuuaggggacuucauauucuuucguagaaucuaaugaaagcuauuuaucuucagagggaaaaaaaaugcaccuaugcacaacauuuuaguuucagguaguucauagauuuuagauuuuagaagcuuccuuuaggcagugcuuccugauaucuuuuacauggugacacauuagaauaaaugacugcuugcauauucuuccugaaaccagccgaaagcugagagauucaguauauggcaucucuguaugcuucugcauaccauuuggaagcucugcuccaggaaaagcgugaagggaaguaacuuaucacuugccaauggucauuuaacuuguaaaagguauagcuaguccuucuaucaaagaagcaugcgcacauaaacacacaaaagguaugcuuaagguucaaacccaaguuggucugucucuaaagccugugugccuuugacuaugcaauggugccuuccuaguaccaaggauguauguauguaguagggacagggcuagguagguaaauauauuuuuuuucuuacuuagcggaaggccuuuugggugcaugcccacuaacuaaaaaagaagccacaucaguaacauuaugacuugauaaaauuuugucaaaaauggaaaugaccuaacauaauugauucaauaaacuaugguccaucagaacaguggaauauuauguagcaauuuuaaguguuugucauggcaaaugcaaacaucauauaaguaauaaaaugaaaauguuuuaaaguacacucugagccaggcacaguggcucaugccuauaaucccagcacuuugggaggcugaggugggcagaucaccugagcucaggaguucgagaccagccugggcaacauggcaaaacccugucucuauuuaaauuauuuaaaaaauaaaguacacugugauggcaacugugugaaaacauaaacauuuguuuauuaauugauccaauaauuuaagcaugugcuauauuuaauaaucaggauauucaguacuaacugaaacagaaacagcuucugaccuaauagaguguuaggaaaagguagauaaccuuauuccaagacaauaggguuuaacuuuguaguggucucauguucaucgugagguuuuauuuuauuuuauuuuauuuuauuuauuuuuuugagauggaguuuugcucuuguugcccagucuggagugcaguggcacaaucuuggcucacugcaaccucugucucuuggauucaagcaauucuccugccucagccucccaaguagcugggauuacaggugccugccaccacacccagcuaauuuuuguauuuuuaguagagacgggguuucaccauauuuccaggcuagucucgaacuccugaccucaggugauucauccuaaggauuuaaugaaagcuacuuaucccuagggggaaaaugcaccuaugcaaaguaauauacaaggugauauguacaaacaaagguuauuuuguuaaggagguuauauugagcugaaugcuucucccaaauaguccugcguccugcuuuuucugucuggcagcaugaguagaucuguuucuucuuugacuggacaacccuucaaauaugugaaauauguaaucaugucucuuuacaugggauaaauauccuucauucuauuaaguguucuuggugcauuuuuucccccauacuuauuucugucuuuaucauccucuuuuggacacaccauugucugucaguguccacuaaagucuuguccaaacuaaacacaucuuggcugggcacaguggcucacacuuguaaucccagcacuuugggaagccaaagcagaagaauugcuugaggccaggaguuugagaccagccugggcaacauagugagacaacuaucucuacaaaaaaaauuuaaaaauuaucaggcaugguggcacaugccuguagucccagcuacucaagaggcugagguggcagaauuauuugagcccgagauucaggcugcaaugaacuguaaucacaccucugcacuccaacuugggcgacagagcaagacccugucucaaaaaauguaauaauaaggaaaaacaacaugucccacauauuguguagccacuuaggcacuauguuugucagggcugccauaacagacuagguggauuaaacaacagaaauguauuuauuuucucagucuugaaggcugaaagucaaagaacaagguggcagcaagguuggucucuuuuuguuuguuuguuuguuuuuugaggcagaguuucgcucuuguugcccaggcuagagugcaaugacgcaaucucugcucacugcagccuccgccucccaggcucgagugauucuccugccucagccucuggguagcugggauuacaggugugcaccaccacauccggcuaauuuuuuuuuuuuuuguauuuuuaguagaggugggguuuugccauguuggccaggcuggucuugaacuccugacuucaugugaucgccugccucggccucccaaagugcugggauuacaggcgugaaccaccgcacccggccuaagguuggucucuucugaggcuuuucuccuuggcuugcauagggccaccuucucccuguuuucucacguggucuuuccucugugugugggagucccuggugucucuuugugaauccaaauuuccucuuauaaggacacuaguaagauuggauuacggcucacccuaauggccucaauuuaaauuaaucacuucuuuaaaggcccugucuccaaauacagucacauucugagguacuggaguuuaagguuuuaacauacaaauuugggggcagagauucuccccauaacuggcuccguaucuuuggguugcgguaaugggaauauggaaggacuuaacuucuuuuuuuuuacuguucaguguaaaaauuaauacacaggaauaaaucaguuuuuuuuuuuuucuuuuagccaaaaucugaagaugaagaaggcuggaagaaauuuugucugggugaaaaguuaugugcugacggggcuguuggaccagccacaaaugaaaguccuggaauagauuauguacaaguaagggcuguguggauaaacagaacaaaaagcauuuuaauuuuggugcaccacuuaauauaaggggucagcaaacucuacccugggccaaguccaguucauggccuuuuuuauauccaugagcuaaggauuguuuuuagguuuugaaagaguaaaaaagaaacaaauaauauguggcugagacuuuauguggccugcaaagccuaaaauauuugcugucugacucuugauagaaaauguuugccaacccagacuuaguuuauuagcucuucaaccuaacaaaacagcuuaguuucugaaacaauuuacugugacuuuuuuuaguuuggcuucauaucccuuauguuuggcuugguaaucauuuuaugaguuggauaagauucauaguuuuuuuaaaugaugaggcaucaggcaaacaguguuaugaguagccagggaaaaaauggaaaucgacacaauuagaugcuuuaaaaugcauaaucacaucuaucacuucaugggccuguaaaaaauaaaucacauauucuaaagaugaaauguugaggauaucuuuaaaauucauguggcuguaaucauaaguuauguagacaacuccuuguccuucaggauuuaccugcccccaaguuugcagguguuccuugagaauccagugcaugccucugcauuagcgcuuacucccuauagcauguaguucuuuucaguucaacagguauuuauuauuugcuauauggugccacauuguguuuuucacauuuaaaacuaauuuuuccuaaaaauguaaaaagccccaagaaucaauaaaaagaccaagaaucaccccuccccugcccaagaaaaaauagccaaaggauauagauaccucacagaaaggaaauaaaauuauucuuauaugacaagaugccaaaaaucacuuguaauagaaguauaacauaacuaugccaaggugcuauuuuucagguaacauauuggccaagaaaguuugauacaccauauugacaagagcuggggaaacaagcacucuuagacgugguacaggaguauaaauagacucaaaucuuagggaaguuaauuugguacucuuucuauauaaccaauugaucuuuuggaugauauccuuaacauaugcuacauuucaaaaauagcuauauauauauauauauauauauuuuuuuuuuuuuuuuuuuuuuuuuuuuuugagacagggucuucuuccgucauccaggcuggagugcaguagugcacucauagcucauuacagcuucaaccuccugggcucaagcaauccucccacgucagccuucaacauaccaggggcagcaggcacccaccaccacacccagcuaauuuuuaaauuuuuuguagcgauaaguuuuuuaauuuuuuaaaaaaauuuuuuuguagagagaaguuuucaccauguugcaagguuggccugaaacuccugggcucaggcaauccuccugcugggauuauaggcaugagcuaucauggcuagccaaaaaugguuuuuaauuuauaaagaauuaaaacuuacuuauuuagcuuauuuucagagaauacauacaaguaaaauacaccauguuaaaaaaaacccuuaaggaaguaagcguuuaauguauauccucuuaaguuucucacaaaucagugguauuuucauaauuagcaaucacagccucagacuccaaaguagacuuuuaaaaauugaaucaaauuagguuuuaaaaaugucauucuaauucaaguguccuuaauucuugaaaauauuagcuuuagcugaagauuuugaaaugguguauacaacauauuaaugucaucuuaucaauguuacaguuuuauuggauauacuuaauaaguuaguuuuuucaaguacuaucauguaaaaaauuuuuagucuuuaacauuuuacuuacuaaaaucauacuuuauuuaaaaauuuacaaauucagaccaggugagguggcucaugccuguaaucacagcacuuugggaggcucuggcagguagaucacuugagcucaggaguuccagaccaaccugggcaacauggcaaaaccucaucucuaccaaaaauacaaaaaaauuagcugggcguguugacaugcaccugugguccuagcuacucgugaggcugaggugggagcaucaccugagcccaggaagcagagguugcagugagccaagaucgcgccacuacacuccagccugggugacagagugagaccccaucuaaaaaaaaaauuacauauucaaaauuuaaggcguuauuuucuuccgcauuacaaacauaguaguuuccggaaugucucauuguuauggacaaugaaagaauuuucuuuuauuuguucuuuguuucuaaacaacaguguggcaagaaauucaccaguuugaaaaaaaaaaaugaagcuuauaauaccauuuaguaaaauucagucucauuuuuucuuucagauugguuuuccucccuugcuuaguauuguuagcagaaugaaucagguaaaauuaauaauagagauauaugcauucuuuuguuugcauugugugugaaaguauuugaauuguuaauacauauacugaauucuuacaguaugcaagacuuuguccuaagcucuuuaaugguucuuauuuaauccuuacuacaacccucuauggagaguuauuauugauaacuacuuuuuauagaugaggaaacagcauuugagguuaaguaacuugcaggugguuuuucagcaaguaaauggcaguacugagauucagugccagguagaucuaacuccagagcucaugcucugucuuaaucauggugcuagaguauucauuucuguagcuuucaguuauaagucuuagauucugggguuugaauuaaauacaaggucccugacuuacaaugguucaguuuaggauuccuuuuuucccaccaugccuggcuaauuuuuguauuuucaguagagagaggauuuugucauguuggccacguuggucucgaacuccuggccucaacugauccacccaccuuggccucccaaagugcuggaauuacaggcaugagccaccaugcccagccauuuuaggaauuuucaacuuuacaauguguuuaucagcacauaaccccauugcaaguucaggggcaucuguacuaagguuagauugcuauuucuaguucuagauguccuauacauucuauuaagauugaaauaugggccgggcgcgguggcuuaugccuguaaucccggcacuuugggaggucaaggcagguggaucacaaggucaggaguucgagaccagccuggccaacaugguaaaaccccaucucuacuaaaaauacaaaaauuagcuggauguggaggugugcacuuguaaucccagcuauuugggaggcugaggcaggagaaucgcuugaaccugggaggcagagguugcagugagccgagaucgugccauugcacuccagccugggcgacagggcgagacucugucucaaaaaaaaaaaaaagaaagauugaaauauaugauuucuuggaucaaaagggaagaauuauggaguuugguucuucaguuuuuuaggaguaaggacucuuauucauuuaaaaagcaaauaaaaauuuaauuuuaucuucacauagcauuggguaccuuuggaagccuuuuuuuuuuuuuuuggcagggucucauucucuugcccaugcuggaguacagugaugugaucuuggcucacugcagucuuguacuuuggggcucaggcaauccucccaccucagccuccugguagcugggaccacaggcaugugcuaccaugccuggcuaauuuuguuuauuuuugguagagacaaggucucacuguguuguccaggcuggucuggaacuccugagcucaagcgauccucccaccucagccucccaaagugcugggaauacaggugugaaccacugggcccagccaacaauuuuuuuugugggugauauucucuuggaaauaauacacaagcugacaguguuacuuaaucauuugcauuaagauauuguagcagucauacuaaauuccaucagugucauuuuuguuguaaccaucaacuguauuugaauaaaccagagauuauuuucaagaguuugauaaauccaucuguauaguuuaagaacagauuuuucuccaccuaaauuuuuauucagauuuguacuuugauuuaauuugaauuuagaaauaaacugaugguuuuuuuguuuuguuuuguuuuguuuuguuuuuugagagggagucucgcucugucgccaggcuggagugcaguggcacaaucuuggcucacugcaaccuccaccucccagguucaagcaauuccccugccucagccucccuaguagcuaggacuacaggcgcacaccaucacacccagcuaauuuuuuguauuuuagcagggaugggguuuaccguguuggccaggauggucuuugucucccgaccuugugauccacccgccucagccucccaaagugcugggauuauaggcaugagcccaccgcgccuggccaacugaugguauuuuuacaaauacaucuuuuuuuuuuuuuuuuuuugagacagaguuucgccuuuugcccaggcuguacugaagcggcaggaucucagcucacugcaaccucugccuccuggguucaagcaguucuccugucucagccucccgaguagcuaggauuacagaccccgccaccaugccuggcuaauuuuuguauuuuuaguagagacgggguuuugccguguuggccaggcuggucucaaacuccugaccucaggugugccauuguuuuuuuuuuuuuuuuuuuuuuuugagacagagucucacucuguugcccaggcuggagugcaguggcaaaauccuggcucacugcaaccucugccucccagguucaagggauuccccggccucagccucccuaguagcugggacugcauucacucaccaccaugcccggcuaauuuuuguauuuuuaguagagaugggguuucaccauguuggccuggcuggucucaaacugacaucaagugauccaccugccucggccucccaaagugcugagauuacuggcaagagccacugagccuggccacaaauacauuuucuuuuaaccuugugaagucuuucaaguaguuacaaacuaaauuauuaauaguuacaaacuaaauccuaggauuuaaaccaagguguuaguugauauuugaaagugugaaaauauuuguuuuaaaagccucacuggggcuaggcgcggugccucacaccugugaucgcagcacuuugggaggccgaggagggcggaucaccugaggucgagaguucgaccagccugaccaacaugcagaaacccugucucuacuaaaaauacaaaaauuagccggacgugguggugcacgcauguaaucucagcuacucagggggcugaggcaggagaauugcuugaacccgggaggcggagguugcagugagccaagaucgcaccagugcgcuccagccugggcaacagagugagacucuaucucaaaaaaaaaaaaaaaaaaaaaaaaaagccucauuggauaagccgccuaaucaaacuaauuagagucaaacaaauuagcuuucuuugaaaguuuaaagaaugaggccauuuuuaacaucagaguugcuuucuaaauaaacuuaaugaaacucauguugaauucauguuuuauuauuaauacaacucuucuccacccccucuuuuuuuuuuuaggcaacaguaacuagugucuuggaauaucugaguaauugguuuggagaaagagacuuuacuccagaauugguaguauugcauguuuuucuuuucauaauguaggcaaaaauuagacguuuugggucaacugugggccacauauacaauggugcuccuauaggauuauaauacuguauuuuuacugcacauuuucuuuuuuucuuuucuuuuuuuuuuuuuuuuuuuuuuugagacaaggucucgcucuguuacccaggcuggggugcaguauuacaaucauagcucacugcaaccuugaucuccccagcucaagcaauccuccugccucaaucuccugaguagcugggacuacaggcgcaugcagccacgcccaguuuuuuuuguuuuuuguuuuuuguuuuuuuuauuagagacaaggucucacuguguuguccaggcuggucuugaacugaguccaaaugauccugccuccucacccucccaaaaugcugggaauuacaggcaugagccaccaugugugcggccuuuuguguuuuuuaaauagagacgaggucucaccauguuccccaggcugaucucagacuccuaggcucaaguguucuucccaccuuggccucccaaacuguuuggauuacaagcaugagccacugagcccggcuccuuuccaguauuuaaauauguuuagaucuggccaggcacaguggcucaugccuguaaucccaacuacuagggagggcugaggcaggaggaucaccuaaggccagggagguugaggcugcagugagccaugauugugccacugcacugcacucuagccugagugacagagugagacccuaucuuaagaaauaaauauaugguuuuuuuggaugcacaaauguuuaccauuauguuacaguugccuacaguauucaguauaguaaugugcuauauagguuuguagccuaggagcaauuggcuaugcaauauagucuagguauaguagacuauaccaucuagguuuguguaaguauacucuaugauguucauccagggucaaaaaucaccuaacaaugcauuucucagaauauaucucccuucauuaagugaugcaugacuguacuugaugugaugcuacgguauuuauuuauuuuuuauuuauuuguuuguuuugacauggaaucucccucuguugcccaggcuggagugcaguagcgcgaucucggcucacugcagccuccaccuccugguuucaagugauucuccugccucagccucccaaguagcugggauuacaggcaccugccaccacacccagcuaauuuuuguauuuuuguagagacaggcuuucuccauguuggccagacuggucuugaacucaugaccucaggugaucugcccgccuccaccucucaaaguguuggaauuacaggcgugagccacugcacccagccaguauuuauauuuauauuuauauuuguauauguguguguguguguauauacauauguauaaucugaacuauacuuguuuguagucaaauaagaaacacuagaauguaaaucaacauacuacuuccuucauugagaaagucuuggagaaaaaaagucaaugaaagaguugauguauauccugguacaagguacaaacuccuuaucucauugcagacaaguuuguuuuuuuuuuuuuuuuuuuuuuuugagauggagucucacucugucacccaggcugcagugcaguggugccaucucggcucacugcaaccucugccucccaaguucaagcaauccuccugccucagccuccugaguagcugggacaaguguagagaauauuuaauuuaaauuaaauauuuaauuuaaaugcuagcuuuacauaguaaauguaucccuuaaaauuugagucaaguugaaacauauaauuuuuuuuuauagaaaaagaauuccacaauuuguaaaagaaaccuggauuugaaucuuuuucuguaagaaaaagucuuaacuauugauuugaguuugccugaggaacccauuuaguguguuguauaaauugcuauuuaaauuuuguccuaauauuuuuuagguuuccccgaagugauauguugcuuagaauaaacaaaguuguauauacuacugguggaaauacaaauuugguauaaccuuuccaggauacaaucuggugaucauaucugaaaaaccuugaugaauauacauacccuuugucaccauuuuacuugcaauacuuaauaaacuuuccccauguuguuaaaugagauuaaacaagggaauguuauuaaauacucuaaacaagacacuuaacauucccuuguuaaucccauuuaacuacaagggauggcugagugggguggcucacuccuguaaucccagcacuuagggaggccgaggugggcggaucacuugaggucaggaguucgacaccagccuggccaacauggugaaacccccaucucuacuaaaaauacaaaaauuagcugagcaugguggcgggcgccuguugucccagcuacucaggaggcugaggcaggaggauugcuugaaccugggaggcagagguugcagugagccgagauggcaccacugcacuccagccuggaugacagaacgagacuccaucucgaaaaaaaaaagaaaaaggacaaaaacaacaugguaaacauuuuauuauguauuauaaauaaaaaagauggcuacaagaugauauuacaacugaugaaauuguauugaaaaaagguuguacagccgggcaugguggcucacgccuguaaucucaccacuuugggaggcuaaggcaggcagaucacuugaggucaggaguucgagaccagccugaacaacauggugaaacccggucucuauuaaaaauacaaaauuagccggguguggugguacaugccuguaauuccagguacucaggaugcugagacaggagaauugcuugaacccgggaggcagagguugcagugagccgagaucgcgccauugcacuccagccugggcaacaagagugaaacucugucucaaaaaaaaagaaaguuguacauacgaauaggaaaaacaagaacauuuuuaaagugaaucaaaguuugaucuggaauguugggacugcagguuuuuucuugugcuugugguauucuucacaguuuuucugcaucaaauauguauucauuuuguagcugaaaaccccauuuuaaaagggaguggggauacauugagccugucaaaguauuuauaaaagugucaaaagauuauuucaucuguaguauaguuucuuuguauguccccagaggacaaaauuauacaauuauaaaaugauuucuauaucuguccauacagaacaaagaaaaaaauguaucuuaauuuuuuccaguauuuauauucaucuuaauguaguguucugcuuacaaaugagaacuuccuaucauaagaauaucugaaacaaacucuuuggagaucagggaauauuuugagguauccaauguccugugucuguaauuauaggauacaagagauaacaccuggcucuccaaaugaggcuuucuugucuauacccaaacauaauauaguuaaauguucuaugaauuuauucauagcagauaaucaggcauaacauuggacauuuaaaaaauaaacuucugguucaguauuugucuaaauauuaauuuuuugaauuuuuuuuuagggaagauggcuuuaugcuuuauuggcuugucuugaaaagccuuuguuaccugaggcucauucacugauucggcagcuugcaagaaggugcucugaagugaggcucuuagugguaaguugcaacuuacuguuuaaaauuaaaagcacccaccaauuuauauggugguaaagaaggaguucagugaaauaggaaaacacauggaauauuuuauugguggcaauuagauuuguaaagcccaaaauaauaguagcuuaaauaauauggaaauguuuucugagauaaagaagucugagccgggcgugguggcucacaccuauaaucccagcacuuugggaggcugaggcggguggcucaccugaggucaggaguuugagaccaaccuggcccacauggugaaaccccgucucuacuaaaaauacaaaauuuagcugggugugguggugggugcuugucaucccagcuacucaggaggcugaggcaggagaaucguucgaacccaggaggcggagguugcagugagcugagauugcaccacugcacuccugccugggcaacagagcaagacucugucucaaaaaagaaguagguaaaaaaauuagauuuuuacuaagauggcaguaacccacccacaccuuugaguuuugucauauguggcuuucauccucaugcucaucuuaugauccaagauggcugcuguagcuucagccuuuuuuuuuuuuuuuuuuuuuucuuuuauugugagauggagucucgcucugucaccgaggcuggagugcaauggugcggucucggcucacugcaaccuccgcuucccagguucaagcaauucuccugccuuagccuccagaguagcugagauuacaggugcccgccaccaugccuggcuaauuuuuguauuuuuaguagagacaggguuucaccauguuggccagacuggucucaaacugcugacuucaagugauccaccugccucagccucccaaagugcugggauuacaggcaugagcuacugcaccugguguguguguguguguguguguguguauauauauguguguguguguguguguauauauauauaucuuuauauauauaucuuuauauaauucaguaaugaauauauauaagaacaguaagaauccugugucuugacuguacagugauuaauauauauuauauauauucauauauauucuauauauauccucacauauauuguaugcauuauauagaggaacaauaagaauccugugucuugacuacagugauaaauauauuuauucauauauguauauuaauauauauuuauuauauaugaauacauauucacuacaguuaagacacauauauaauauauaugaauauauauauauauauucaucacuguacaguuaagacacaggauucuuauuguuccuuuaguaggaaccagggaaaaauuucccccaaguuaucccccuuagaucccucuuuauuuuuuuuucccuauucagaaucuuuauuuaaaagauagucuuagauguuucucaaggaaucauuaacucuacaguucucugcuuuuucuuugagggcuccuauuuccacaugaugauuacugucauauaauaaaguuuucauguuucguguuuuacaucuuaauagaaaauuuauuucaaaaguaauaggaacagacaauauuuaaauuuuucuuuuuuuuuuuuuaggauagcaaagaugaugagaggguuccugcuuugaauuuauuaaucugcuugguuagcagguauaguuaauccuuggcuucuuuauuauuuaucagugaggucagugagguuagaucguauuuauuacauuugguuuuuguuugguugguuuuuuuuugagucucacucuguugcuauaguuagggugcaguggcgcaaucacagcucacuagagcuuuaacuuccugggcuccagcaauccucccaccucagccuccugaguagcuaggaccacaaccaagcaccaccacaccuggcuaauuaaaaaaaauuguucguagagacagggucucacuauguugcccaggcuggucucaaaacuccugggcucaagcgauccucccaccuaagccuccgaaagugcagggauuacagguguaaagccacugcauucagccugcauuuuuguuuaauugccuguguccugcguucauuuucaguuguggcauauuuuuauuuaguaucuguuuuauuucauuucuuacauagaaauucuucuuggaauuuauuugaaaacuuuuuuuguuguuuuguuuugagacagagucucgcucuguugcccaggcuggagugcaauggcaccaucucggcucacuacaaccuucaccuccuggguucaagcaauucuccccccucagccucccaaguagcugggcuuacaggcaccugccaucaugcccggcuaauuuuuguaauuuuguggagacggaguuucaccauuauuggccaggcaguaaaacacacauauuuauuuuaggucuccuccuggacauauuuuuguuccauagaucaguguuuuuauuucauugccaguaccuuuuuaaagcuuuauaauauacuuaaauauugggaaggcaaguaaucuuguuuccauauuuucacauauucaauaucuaguuucuugaucuacaauaauuaugcugcugaugauaauuaacauuuacugggcaauuugugccaagcauuuuucuuagugaggaacccauuuaauccuucuaagguggguacuguuaacaguuuacagaugaggaaaccauggcagagagagguuaaauaauauuacuaccaucacaaagcuaguaaguguuagaguaaugauccaaacccaggcaacuuugacuccggagcuaaacuuuuaacuaugcugaucaaaaauuaagcuaauaccuaccucaucuguugguaguagcaguuaaaugagaugauauagcauugcccuacuuacuuuauguauaguaucucuacucuuuacaauagaucagaguuguguuuuuguuuuuguuuuuguuuuaauaaauuuuuuccuuucagcucuguuggacuugauuuuuuuccuuuuacagauaaugacacagauucagaaagguuaaguaauugguagcucagcaaaccaguaauuaaugaaaccucagacaaguauaguuucugacugccucaguugagauuuuacaguauuaugcaauuaugaaagcaaaaacauucaaguguauuuuuugcccucaaaaaguuagauaaaaauggaaaaaguucuagacuacaaaagguucugaagcuaacagcuuuacaauagaagacacaaagauuugaaaguuuaggaaaaaaaggaccgggcaugguggcucauaccuguaaucccaccacuuugggaggccaaggcggguggaucaccuuaagucaggaguucaagacuagccuggccaacauggugaaaccucgccucuacuaaaaauaggaaaauuagccgggcacggugguucacgccuguaaucccagcuacucgggauggugaggcaggagaaucacuugaaccugggagguggagguugcagugagcugagaucgugccauugcacuccagccugggcaacaagaacgaaacuccaucucaaaaaaaaaagaaaaaagaaaaaaaaaaggaaagcugggcacagugacucacaccuguaagcccagugcuuugggaggucaaggugggaggauugcuugaguccagggguucaagaaugcagugagccaugacaaaaucugauuagugauuuuccuuuuuauuuaaucuuauaauuacauaaaauaguuaccuugccaaaguuaaaauuauaauucaagguacauuuggaguauuuuagcauccaucuuuauccucauuauccucuuuuuuccuuucuccucuaguuaaccauuguauuacuaauuuuuguuucaucuuuucauucauuguuucuuuuuaaaaguauaaguaggccgcaugugguggcucaagccuguaauuccagcacuucgagagacugaggcuggagaauuguuugagcccaggaguucaagaccagucugggaaaugagccaugaucaugccacugcacuccagccugggugacagagugagaccuugucucaaaaaggaaaagaaaaauauaaacaaacacguauauuggcaguccuacacauacucacauaagguagcauacagaacaaucuguucuguacuucguuuuuuuucacuuaauaaauccuggaaaucauacuuuagcaguauaaauacguuccucauacuuuagcaguauaaauauuucccucauuucucuuuuuauggcuucauaauuuuccacuauguagacauacuauagcuuauuuaaccaguuucuuauugauggacguuuggguugcuuauggucuuuggcuauuaaaaauagugcuacaguuaauaucuuuauacauaaauuuuuuguuuuuuuuuuacuagguauuuugaccaacgugauuuagcugaugagccaucuugauguagcugaucucucagggauagaagauauuucucaugaaggcagccuaacucugaggaaaacaaugccaauucaaguacagauuucaacacaucuucaacacuaugugaaggguucacaucuuaaccugugcaauucagauugauacucagaauauggguugauuugaauaucugaaauaucaauggaaaaucccacucaguuuuugaugaacaguuugaacaguuuucuguaaucaagcagcuugcauagaaauuguaugaugaaauuuuacauagguucuuggugcuguuuuguucuuuuuuuguuuuuuguuguuuuguuauuuacuuauauacauauaaaauuuuauugaaaauauguuuugguuacuaaaauuuuguuugacuccuaacaaaagacaauggauggccuuagcaucagaauuaaaauaaucuggauuaaauggcaauguguucauagucagcaauaaaauuaaacauuuuucccuuuaa

SEQ ID NO: 192355 - RNA, 36128 nt, Homo sapiens
ucuuccggaagucgcgccggugcgcgccggacuccucccaccagcggcgacgucaaacucagcuccuaccacuucucugucucugccgaccggcgcagggagggcugccuuuuccuuacaguacgccuugaggcuuccgggccgcugaaguuuacgagcgagggcagugcaguuacucagugugccggccucggacgcacgugaguagaguuugagaagacagaggcuggcucccggcaggccacgcccgcagaggccuuucccccucuccacaacuuguguucuacuugguuccgccgagacccacgacgguuccgcccccuucuuccuagucauugauguuguuguucuugucagugccgcagccccgaccgccgggagcucgaacccgagccggggccgcccggguggcgcgguggcggcggcugcggcugcagcagcugcgacggcugcgggggcugcuccggguacugcgggggcggccgggagccggcagccggcggcggggccggauggcucugugcgggcaggcggcgggcgcugcgucgcugcccagcgagcugaucgugcacaucuucucuuuucugccggcgcccgaccggcugcgggccucggccuccugcucgcacuggcgugagugccucuucuauccggcccuguggccccagcuccgcaucugccuccgcgucucgcccgcggagcagccucggcuggaauuccucaugcgcaagugcggcugguucgugcgagagcugcguguugaauucgccgccgagaacuaucugagcggcgguggcccaggggacggagguggcgcggacaccgggacuggaggggaggaagucgaggcccugcagcucucagcucguuggcuggaagugcugcgcaccuacuuggagcuggugcuuugcgugcuggucagcauccggaacaacagguaggcuugcccugagccccgccccgcccgguaacggggggucgcuccguccccgcaccccgacacagauucugugcauaauacgugcccggccaacuucaguguugccuuccucagugacggagaguguugguucuaacuaggcgguuuccuugagcggaaaggcauaacgggacucaucacgauacuuuauaaacagugguggacgggguguuuaacagacaccacuucuggcgccuuccaggcacucauucauccucuugguggccgugggauggagcugacaggcgcugucacuuuucauuuuauauaugggagcguuaagacugggagggugaggccugugggugagccuuggaagaaacaaaacauacacauaacacgauuuucugacucugaaucuguuagaaauaguucauggugagggaaggaguagguacucauaggacgcugccuaaaagaaauuuuguaacagccauuuucuuaccagaaauaguuucggcuaacugaacaaggcccgaagaggaggaggaguguuuguuaaagggauuggggaagaaguugaucuucaggguugaaagucccuccccauacaccaccacacucaacuucuccccaguaguucaccuaaaaguaacagucgggcggaggaggcgggcgggcagcgagggaguuggccagggucugcagaggguaagcacauaacuguucugguuuugcaucaggacuucacuguaauuccagaacuaacgccuuauauucugacccaguaucccucccaaucaucauuuuucuccaucgccaccuccaaaacccuauuaauuuagaucuucuuuauauggauauucuaaagaaccuuacaguaaagcucuuauuagaagaaaguuuagacguucacaaaaggagcaccuuacauaguaaaaauacuucagcaguuucacauucacuguguuguuugagccucucaguggcacuaugaggcaggguaaugauaaauaacccuguuuuacagaaaggaaacugacccuuuauaggaucaagugauuugcacauugcuguacggcauuguuuuucuccgaaagcguguccuuuugcaguaaauauacugaacauuauguugaacaagguugagagcagucccugguuuaaugcuaggagauauauauagauauaagguuauauauauauauguaugcgccauuaaucugugucuuaauuuagaagucaagagauaaguuauagcuccaaguuguaucugggauauggcuccauuauuccaguugccugugcguuuccacagcuuuucgcaagacauucuauuuccuuacuuugguuuuaucuggcaggagaggccauugaagcuaaaaacagauuagguuagagacuuucucagaguugaauguauggcuagaggaccaacugacccaaaaguugcaaaguuucagucagugagcacuuacuaaugagaccaagguugagggugaauucaaugagugaguaccaauuagauuuuucuguacugagaucaaauugcacuuuuaugcaaccaugcaaacacuguaugugccuuugacccaaguaagaacaagacuugauaagugucuaguuccuuuuaaguauuuuaauaacugguugguuggauggguggauaacauacaggcaaaauggagauauuucacaucuuugcuuuguagcuuaauucuccuguccuucucuuccuuaccccuacaauuuuuauuagcaucccaaucugcuucucuauaaggccaccgaugccugcccuucugggucagcuaucacuucuaugcaaaaacaucacacccgucaucccuaauuuuaagguuugcuugucaucuacuauuagcaugguguuguaugucaugcugcuuugguagcauauucauucuguuugucucaaaauguaguguaauugcauguuguuuguacuaaugauacaucaaaggguuuuuggaaauaaguuaaucucaucuuuacuguugaaaguguuuugagauacucugugauauuggaaaaguuaauaugaauauuaaauccauaaauaagacuaguuuccuuuaaauuuuaacaaaucugaaaauguuuuaaaccacauuguuuaucagugacuaguaaagccuauuauuucuuucuauaaucacuuaaacuauagacuugggacauuugacauugcucuuuacauuuccaaguuaaauuuacaaugguuuugcuuuaugauuucugccauucuauaaguagaaaagagggggugugaaucauaccagaucauaagcauucugcuuccaggcuuugugcugaauuccuuuauacaguucauacaauucagacuguuauuuuguuuuguuccaguuauuuucaugucccucaggaaaauaauuaaaaguauaaacuugaauugugugaacuuuucaagggugcugaucuucagagaggacaauuggcauuuuguuuugcuugguuccuggguuauauauauacauguauucucauagugauuauaguugccauaccuguaucuuagguuuuaggaacaacuaauaaggauaaagaaggugcauaagugccucucugaggguaacacacaguccuucacguuucagaaauuccuucucuacagggcacuaggauaccugucuucuucauuaauaguaagaacagaggggcaguaaguacucauucaacuguauuuuaggucacauaggcugaauuucucugcagucguucuauaagaaauuguaccuagaagugcaaacaacaaauagauauaaaugcauuuuuagcauuuaauccaguugucagguuggguacugccuauuaaaaugcuguauuucagacuccuuaggaaaaacgagagcucaugguaagauuuaugauaauagguaauagacucagucacuaaaaauaccugaagaguagccauaggcacauugucuucaucugguuuaugcuucuaugggcuguauaaauguuuuacauaagcuuuucuuggguggaaugcuguuaggggcaguacuuuuuuguuguuguugagaauucauaucguuggccaggggugguggcucacaccuguaaugacagcacuuucugggaggccgagacggguggaucacuugaggucaggaguucgagaccagccuggucaauauggcaaaaccccaucucuuuuaaaauacauagccggguguggcagugcaugccuguaaucccagcuacucaggaggcugaggcaguagaaucgcuugaagucaggaggcagagguugcagugaauagagaucgugcuacugcacuccauccugggugacagagccagacuccgucucaaaaaaaaauuuaaaaaaaaagaaugcauauuguaacagaccagagaaauuuuguacaagauugauuuucuuuuuaagauucuggguacagcucuaacugcuuguauguagauugaccauuucaugacugugucugcuuauauauccuguaaguuaaaaaggaucuauuaauaauacuuagauuugggucuuguugauuuggcaugcacagugaaggagaaucuuaccuuuguauuguuuccuaccaagaaacaauaauaaagacauuuaaaaauauuuugagacagagucuugcucugugacucaggauggagcaaucaugaucauagcucacugcagccucaaauuccugggcucaaaugauccucccaccccagccucccuaguagcuaggacuacaggcaugcaccaccaugccuggcugauauauauauuuuuuuaauuuuguguaaagacaggaucucacuguguugcccaggcuggucucuaauaccuggccucauaugauucucccauuucugccuccuaaggugcugggauuacaggugugauccccugcacccugccuaaaaaugcauuuuaaaauggguuaaaaauucccuggacauuucagauuacuaccuaagaugguagaaaaugccuugaagguauuaucuccaacaguuuuuagccuuauuuuucuugaaauauuucuccugugguaguauaauaaauaugucuaacaauguuucaucucugagaguuuacuuuguuauuauuuacuuuaaaaagcccauuuacagaauaaauauauuaaaauauacugggccugugaccaaucugcccuguucaagaauuaguuuccugugacacugcauucccagcaggcuccuuaccuaaaaacugaaaaagaggcuccuuagggauagccucaaaguuacugagaaggaaagcuaaagaaacuaaccuccuggaaggcuguuaugagagguuuuaggacuuuuuauuccacagcuguauuggcaacugauagauggaauaggguguaaaacucaaggaaaaaaaaguuaaaauuuuuugacuguguuaaaugaggguguuaagcagcuuuugaguggagugauuaaauaucuccauuuuaauuuguuaguucugaggcagccuugggagaguucaccaaacuugaccaauuuauuuaggagcuaaaaugauaguuauagaaaaucuaggguuuuuuccuccaauuauugagagcguacuaugugccaggcggggaagacaugcuucccguucucacggagucauucuagaggaggaaggaagacagaaacaaguagacaaaggaaagaaggauuauuucagguugugaaaauaaaaucugaaaauaaaacagaaggauguaauagucacuagguggcaacauuagguaaagugucagggaaaccucuuuugagaaggauauuugagcugcagcaugaauaacaagcguugcccaucugaagaucugagcaaauagcauuccacacacaagaaacaguaagcgcuaaggucuugagccagacaaauuuuuggucuguucgagcaguggaaaagaaagugugacagggcuguggcaagugaggaugaaaaugaugccaugaugaguucugagaaguagaagaaggaagaauugggguuagguaggcuuauuuaaugaaguuuggaauauauuccaaggauagaagaagucacugaaaaaaauuuuaaggacaagaauaaugugauaucauuugcauuuuaagacaaucacccuggccauuuuaugagcgacuuagggaccaagagagaaaguagggggacaaguugggaagcuuuuacuguacucuaagcaagagaugaugguagcuugaacuaugauggaggcaggagagaugaaaaaaaguggauggauuuuggaaguauagcccagaguacucaccaguuagauguggguaguaagacaaaaggaaaaaacaauauuuuuucaucauuucuuucucacucgauuuucuuguccuuauuauuguuaaaauuaucuuuuaauagcauguuaaaaaaauaaauaugaaaaaauaaaauaaaaaauaaauaaauaaauaauuuuuaaaaauagcauguuaaauaacaaccgcaaguguucauuuuauuuaaauacaccuuuuguguguaaccuucgggauuuggggaugguaguuauucuuagauuaggggaugguaauucuuagauggaauuguaaguucugggaaauaacuucugguuaaugggucccaaagcuaauacggaguacuguuauaggccgguuauuuauuucuggguucuaauguuguacugucaaauauggcagccaguagcuacagauagcuauuuaaauuuuaaauagauaaaauuaaagaccccauuaguuccacuagccacauuucgagcgcucaauagucacauauggcuagugacugcuauauuguacaacaaagaauaguacacuuccauccauagaagaaaacuacuggacaacacaucucuaaacuauuuguguucguuugauuuggcuaugaccguucauuagcauuuuugaggaaaggaaauaauguuauuaaaaaaguauaauguggauguuaaaacaugauacugaaaguggacuaagaagaauagaaccagcccaagagaauuucaugcaaugaugguggauuauuuuagcuuuuauuaauuuaaaaaaggaaaaaaguuauaugucauuaucucuuuuauggcauuggaaaagauuuuaauguuuuuaagagcaucuuuuuaaagaaccauguucuuuuauguuuccauaacuaauucuucuuagcuguaauaacucuuaagguggcugcauuuugcauuuuucuauuguuccuguguauuaaaucaaagaaauaauuuuggauccucuggaaugaaaagaaacuuaacaaaguuuacuaccauagaugaaguuccccaauucugacccacagaagagagaacaaggucaucaggccugaaaucucaagcacugggucacaauugugcuaaacaguccuaacaggagucugagaagaauaauaagacaauaaaaaauugugaugguuguuuaauucauaaggaaauucuugugcaguauagaaaacaagauaucucauuucaguggaauuuuaauaaacuuuuuuuuuuugagauggagucucacucucucaccaggcuggagugcaguggcaugaucucggcucacugccaccucugacucccagguggaagcgauucuccugccucagccucccaaguagcugggauuacaggaugcaccaccacgcccagcuaauuuuuguauuuuuaguagagacgggguuucaccauauuggccaggauggucucaaucucccaaccucaugauccgccugccuuggccucccaaagcgcugggauuacaggccugagucacugcacccagccuuaacauacauacuuaaguuguauguuuucuauuuucuguuuccacagcuaauuagacuuagcuauauuaacucucauauaagguagcugcauuuugcgguuuuccacugguucuauuuacuacgucaaagaaauaauugagaaugggauuuuuaguuuucugggaaaauauguuguuucagagggauuccuaauguauaauguaacugaaaacuggucugcccccuaaauuuguggugugugagauguagcuaaauagacuuuaauuuuuuuuauaaacuaagguaaauacacuauucaacaaauauuuuugaaugccagacccuguguuaguauuuggagauauagcaauaaucaaaaggcccugccaucauagagcuuuuucuuauggaaaagaagacagaaaacacguuaagugaaauuacaguaucucaguugguaauauaugcuacgaagaaauauaaagcagugaagggagaugggaaugguggacuuaggaguguugcuauuuaaaauagggaaguuaaggagggucucaacuacugaagugguauuugaagguagggagggagcaagccaggugucucuuuggggcaagugauuccagacagaaguagcaguaaguggaguagcucuguagugcaaguaugacuggcauguuuuagagacagcauggugaagaccauuauccuaagcuaacacagaaacggaaaaccaaauaccgcauguucucacuuauaagugggagcuaaacauugaguacacguaguuauaaaaauagaaacaauagacacuggggaauacaagacuggagagggaggcagcaggguaagaguuggauacuaugcucacuaccugggugauggauucauuuuuaccucagaccucaguauuacacaauauaccuuuguaaccuguacaugugcccccagauucuaaaauaaaaguuauuuuaacuuuuuaaaaagaaacagaacauuacuagagcccuagaaguucccuuugugaccccuaccaguuaccacucccuuuccucaaagguaaccauuauccugacuuaacacuguggguuaguuuuaccucuuuuuggacuucauauaagcaagauuauacaguauguuaucuuuagaaucugaccucuuuugcucaauguuguaugucugagaccucacuauaauaguuguucauuaauuuuuauugaugauuagacuguaauuuaucuauucuauugcugauggacauuugaauuuuuuccaguuuuuguauuuaaugaucauugcugcuaucugcauacauauuugugcacuucuuuuuagugcauuuaauguaggcauucauauugggcuuauaccuaggaaugaaauuucuggaucauaccguauacauaugcucagcuuuaguagaaauaaccaaaaagcuuuucaaaacggguuguccauuugauacucucauugguaauauauaugaguuccaguuuuuccacaguuacuaacauguuagcaagugucaguguuuuuaauucaaguguauuauauuguacuuuuaauuuguauuucucugauaacuuuuuguauguccuaaaugaguccuuugauaguucugaguauuacaaaauucucccuuucauuauauuaagcuuuuuguuuuuuuugagauggagucucacucugucacccaggcuggagugcagugguauggucucagcucacugcaaccuccgcuucccagguucaagcaguucuccugccucagccucccgaguagcugggacuacaggcacacgccaccacaccuagcuaauuuuuguauuuuuaguagagacaggguuucacuauguuggccagacuggucucgaacuccugaccuugugguccacccgccuuggcuucccaaagugcuaggauuacaggcaugagccacugcacccggccuuaagcauuuuuuaauauucagaaguucuuaauuuuaaaaaauuccaauuugacauuuuguuccuuuauggguagagauuuuuguguucuacugaaacaaaaacuuuguuagaaaaaaaucugcaaagucaaaaagauauugucuuaugucaccauuuagaagcuuuauuguuuuacacucuaccuaguaauaaauucuuaugaagggugaaaaaagaaaaagacacagcauggaaagcaaugaaauguagaagaagucagccagguaaggaggaaggugauaaggaaaucuguaggcacuugugaggcucuuguaaggacuuugacuuuuacucuuagaugaggugucaucagagaguuuugagcaaagacagugaugugaucugacauuucaaaaggaacagucuggcuacuguguugggaauagcuuguaguagggcaaggguggaagcaaugagcagaguuaggagauuguugcaguaauccaggcaagaaguaaugguggcuuagaccagggcaugagcaacagaagugaugaguaguaugauucuguuuauuuuguuuuuuguuuuauuauuuuauuggagauggagucuagcucuguugcccaggcuggaacacaguggcacaauauuggcucacugcaaccuccgccucccagcuucaagcacuucuccugccucagucucccgaguagcugagacuacaggcacacgccaccaggccugacuaauuuuuguguuuuuaguaaagacgggguuucaccauguugcccaggguggucucgaacuccugagcucaggcaauccaccugccucagccucacaaagggcuaggauuacaggcgucagccacugugccuggucuguauuuauuuuuaucuggagguuuucuagaaguggaauaaaguacaaagaauuagauaugauguucuaacauuacaaugcccuucuaauugcuauucccuaaauacaucuaaaaauauuuuuccccuuuuugguuauucuuacucgugcguguguuugugugugugugugugugugugugugugugugugugugauuuguacucaaauagcuaggguuuggauacaguuuauuaugugaaaacauaacuuacuuuguuguuuaacucauuuaucaccaagcacuuguacagcaguguucuguucauaucauguuauauaaauuuggguuagucuguuuaauugcucccagaaacuuuguggucuuccuuacuauggucaccugaaauuuuuauuuuucuucuuuuuucucuuugacuuuucugcuucguauaaacucauuaugcccugaaauuugccuaggucuaaccuucauaugagcuauggacucauaugaaguccauaugugguaggacugagcagaaaggaagaagccagugguacucccuaugcugauuuuucccuccccuugcauccaaaucaguggucuaaucaccugugguacuagaccaagguaaauaugucuuuccauguagaugcucaucacguauacuccuuaaggugaacaaaaaaagggaagaaauaagggccagaguugggcuaccuuuuaaucugguuuguuauucaacuguugcugguaacuucaaaaaugaauccuacuuuucaaaaccucaaaaggagaauuuuuguucaaggaaaagaagaaacauagucaccugaggcaagagucuuugaucuuaaugccaccuucucaagccacccaccuucauaccgauguccuauuagaaucuacacauagaccacaggagucaccaccagggucacagggcuggguaaugccuguucauagugccaugcuucagagggcggaguggauguguucuugacauccccuaaaauccuaaaccagcuuuccuauauuaacagcaguauucagcaacucuaggaguuaggcuucucuauuauuucuauuuuacagauggugaaacugaagcacagaguaagugaaauuauuaggguuccacaauuagagaagugacugccuuguuuucuaauuuuacuugugaaauuuuuaacacacacuaaaacuagacacaugaacccccauuaauaccaucacccagauucaguaauuugaagauuuuugaagauuuuaccacauuugcugcuugcuugcuuuuuuuuuugagacagaguuucgcucugucccccaggcuggagugcagugacgcaaucucggccuacugcaagcucugccuccuggguucacgccauucuccugccucagccucccaaguggcugggacuacauacaggugcccaccaccacgccuggcuaauuuuuuguauuuuuaguagagacgggguuucaccguguuagccagguuggucucgaucugaccucgugauccgcccgccccggccucccaaagcgcugagauuacaggcgugagccaccggcgcccagccgcuuucuucugcacugaaguauuuuaaagcaauucccagauaucauugccauuuuaccuuuacuaaaguaugcaggucugaaaauuauggacauuucuauguauaaccacaauaccauugauaacagaguuaucaguaauuccuugguaucaucugauuuuuaaaaccaaguuuauuuuuaaaaccuuuauuucuacuccaagaaucuaauaagcccacagauauuuagaacuuaaccaccauaacuuuucaugucauuggcacacaauauacauauuuuaguaauuaaauaagcaaaaaguaggagagcagucuguaggcuguuucuaaguuguaagugcuuaaggaugugcuuuagcucgagaucuggaacucauuacuuuuaaaaauacuguuaaggacaaaauuaaguagaagaaauucauucucuuuugaugauaguauauggccuuuugcaugcuuuagaaagauuaucaagcacuguuuaugacuuugugauauuucacaacacauuuuaggauuuacauagggacuaguaaauagcuuauauccuaucaguauuaccaaaggaaucaaaguacauuaauuugaagaauuaagaugaaagaagaaacuuucuagccaacuguaauauuuuuccaguauuuuuuguuacaugucuuuuaagcaaguguuauuuguggacauucugcgggaaauaacccuauugauuucuuuaguucacuugcuauucaacaauaaauaaaugaaugaguaaauaaacucagguuacugaguucaccuuaauuaaaaggauuauguagcacaauucccuuauuuauuacugguguagucuccuggccucaaaaugagacaucuguuuauuaccacagcccaguagguucuguuccaguguugcugccuagauguucuucucagucucuuuacuaucugaaacaauaaugagccaccuagaggcuauaugcaguuuccuuggcuuuaccauguggucuauaaucuaauuucaacaccauguauuugaaagcugcccuugaguugucauuuuuuuuaugguuuucuaacuuuuaaaguuacuguuuuccauaucacuuaauacauuuucauuuugaauugaaaaauaaguaccuaaaagcguuuuuugcaaauguucauccuauacugcucugaaauacgugaguuauaauuuuuccuaucacuugaaugaaagcauuguauucaaacaccuggguuaauuacaagaaauaucacuuaguggaaguuaaaaccucgauucucuaccuugcuguacuuuaguguuguagucugaaacaggucacuucaauuucuucaucuacaacaggagaggaaugaauucgauaaucccacaaaucuucuggcuuuaaaaguauaucucucauuacauauauagggaaaguuugugcauguauugugaaccauacuguaaagggauuauuaccauuuuguugcugcaauuagaauuuuuguucaguucccuuugaauggcauauuucuaacauugguagaacauuuuaaauuauuauauagcuggaacuauuccagagaguaucuuuacauuaacuuguuaaguuuuacugugaugcaguuuguuuuuuuuuuguuuuuuuuuuuuuuugagacggagucucgcuuugucacccaggcuggagugcaguggcgcgaucucggcucacugcaaccucugccuuccggguucacgucauucuccugccucagccucccgaguagcugggacuacagggacccgccaccacgccuggcuaauuuuuuguauuuuuaguagagacgggguuucaccuuguuagccaggauggucucaaucuccugaccucaugauccaccugccucagccucccaaaguguugggauuacaggccugagccacugcgcccagcugcaguuuguuaauuuuuuuaacgauuuugaaguaaauuaaguucuuaugaacuuaaaggcuauguaaagcaaauuugacauguuuuucugaguucuuaaguaauaugugcuuguaauaauagaaaauuugaggcugggcacaguggcuccggccuguaaucccagcacuuugggaggcugaggcaggcggaucacgaggucaggagaucgagaccauccuggcuaacacguugaaaccccaucucuacuaaaaacacaaaaaauuagccgggugugguggcaggcaccuguagucccagcuacucgggaggcugaggcaggagaaugacgugaacccgggaggcggagcuugcagugagcagagaucgcgccacugcauuccagccugggugacagagcaagacuccaucucaaaaaaauaauaauaauaauagaaaauuugaaaauuacaaaaaaaaaguccaccagauaugaucacuggguaaaaugugaugcauccuucuacaaaauugggauaacagucuguguaugguuuuauaccuuuuuccauugauuauaucauguauuuuuucacauacucaaaaauccugucaugagggcacgaugacagaguaggaaguccuagccuuugcucucccauagaaacaucaagauaacaauacuugggccaggcgugguggcucacgccuguaaucccagcacuuugggaggccgaggcgaguggaucaugaggucaggaguucaagaccagccuggccaacauggugaaaccccaucccuacuaaaaguacaaaaauuagcugggcaugguggugcaugccuguggucccagcuacuugggaggcugaggcaggagaauugcuugaacccaggagguggagguugcagugagccaagaucgugccauugcacuccagccugggcaacagagcaagacucuguuucaaaaaaaaaaaauaacaauacuuguacuaaaauaccuuuauaagaaaugcagaauccaguuaauaaguuguagcacccagccacauacauaacugagaaaccaugauagguaaggagagcaaauucacuuugcccacaucagcuucucccgcaaacuagcuuaguucagagcaaagagaaucacccaugacuucucccacauugggaaaggaaagaauggagcuugcacuuggccaucuggccuccuggcauuucagugcaccccugccaauuucugucucaccucauauccagugcugaaaaacugauagagcccagaugccugaaacaacugagaacaaaagaagggugaguggccuccuacagauggcacuguucugcaagauugggaaaaggcuuggaaccuuucccuuuaggagggaaaugaagugagccuugucucuaaccuuucagugugguacccaaagggcucguuuccaucucaauucaugccaccuacuaaaggacugguggagccuggaugccugugacaacuaggaauaaagggaaaugaguggguacccucuacagcaaacaguacucugugagacuggaaaaaguacuguuucuucaaaggcacagacaacaaugcagccauacaaggaacauggaaaaucaagaaaacaugacagaaucuaaggaagaaaauaauucuuuaguaaccaauuuaaaaaaaaguggauguauuaauuaccuacaaagaauuuaaauuaauccucuuaaagaagcucacugaguuacaugaaaacacugguagaaaacuaaaugaaaucaggaaaagaauauaugagcaaaguaaggauauuaacaaagggaaacaauaaaaaagaaacaaauacuggugcugaagaauacaguaacugaaccgaaaaauugacuacaggaguucaauaagcagcugacaaucgaucaagcagaagaaagaaucgaaaacaggucauuuuugaaauuaucaaauuagcagagcaaaauaaaaagaaugaaaaggagugaagcuguggaauucaaucaagcaaagauaaggaauggacaacccagaaguagaaaaggagcagaaagcuguuucaagaaauaaugagugaaaauuucccaaaucuggugagggaaauggauauucagauucaugaaggucaaagagugccaaacaggaugaacccaaaauggucuacaccaacacauauuauaaucaaauugucaaaaaucaaagacauaaagguaagugagauaagcgcugaaagaaaagaaaaaaaaaacugucaaccaagaauaguguacccagcaaagcuaucccucagaaauggagugaaagauuuuaccagauaaacagaagcuaaaggaguuuaaucauuucuagaacugccuuacaagaaaugcuaaugggaguucuucaacaugaaacaaaggaacaauaaauaacacaaagcauaugacaguaaaaaacucacuagugaauauauaaacaaauagagaauaauauuguauuguacuacugguuaauaaaucacuguaacucugauauaaauguuaaaagccaaugguauuaggccggacaccauggcucacaccuguaauuccagcacuuugggaggccaaggcagguggaucaccugaggucaggaguucaagaccagugugaccaacauggugaaaccuugucucuacuaaaaauacaaaaacuagucgagcaugguaggggguaccuguaaaccgagcuacuugggaggcugaggcaggagaaucacuugaaccuaggaggcagagguugcagugagccgagaucacaccacugcacuccagccugggcaacagagcaagacucugucucaaaaaaagaaaaagccaacagcaugaagaauaacuccaauaauuaauugguggauauguaauauuaaaauacauaaauuagaacaucaguagcaacguaugcaggagcaaauguguacaguuuuugcauacaauuauauuauuaucuuaaaaugcacuauuauauauaccacaugguaaucauacagcaaaaacacauacaggcauaccuuguuuuguuaugauucauuuuauugcacuucacagauauuauguuuuuuuuacaaauuaaguuuguggcaacccugcaucaagcaacuauauuggcaccauuuguccaauaucaugugcucacauuguguuucuuguuauaucuuuguuguucuuguuguugucgucgucauuuucuagaaacagugucuugcucugacacccgggguggagugcaguggcaugaucauggguaauggcagccucaccuccugggcuaaagagauccucaccuuggcuucccagagugcuuggauuacagauguaaaccaccacacugagcccacccuuguuauaucugauaugaucuguuaucaguaaucuuugauguuacuauuguaaucauuuuggugccccacgaaccacaccuguagaaaauagcuaauuuaauuauaaauuguguguguguucugacuacggaccagcccuucccccauuucuugcccucacauugagcugcccaaaucccuaagagauaauaauauugaaauuaggccaauuacaguugcccacaccuguaaucccaacagcaggaagaucacuugagcacaggaguuuaagaccagccuggggaacauagacccccaucccuacaaaauauuuuaaaauuagcugggcauaguggugugcaccuguguucccaucuacuugggaggcugaggugggaggaucacuugaaccugggaaaucagagcuacagugagcugugauugcaccacugcacugcagccugggcaacagagcaagacccugucucagaaaagaaagaaagaaaaaauuaggcuuauuaauaacucuacggugaccucuaauugcuaagugaaaggaagagucccacgucucucacuccaagucaaaagcuagaaaugauuaagcuucauaaggaaggcacuucaagagcccagauagaccagaaacuaggccucuuguaccaaacaggcaaguugugaaugcaaaggaaaaguuuuugaaagaaaguauaagugguacuccaucuaucacaugagugauaagaaagggaaauggccuuauuacugauaaaguuuugguggucuggauagaagaugaaacuagccacaacauucccuuaauccaaagucuaauccagagcaaggcucuaaugcucuucaagucugugaaggcugagagaggugaggaagcugcaggagaaaaagcuugaagcuaguagagguugguucaugagguuuaaagaaaaaagucaccucccugaaaaugcaagcugaaucagcaggugcugucguggaagcugcagaagaucuaguuaaggucauugaugaaugugguuacaguaaacaacagauuuuucaguguagacaaaacagccuucuauugcaagaagauaccaucuaggacuuugauagcuagagacaagccaauaccugacuuuaaaagcgucaaaagacaggcugacucucguuagagguuaaugcaucuggucacuuuaaguugaagccagugcucauuugccauuccaaaaguccuagggcccuuaagaauuaugcuaaaucuacucugccugugcuccauaaguggaacaacauagcguggaugauagcacaucuguauacagcaugauuuacugaauauuuuaagcccacuuuggagagcuacugcuuacaaaaagguuccuuuuaaaauuacaucucaucgacaauguacauggucacucaagagcucuggugcagaugaaccaggagauucauguuguuuucaugcuugcgaacacagcaucuguucugcagcccauggauccaagaguuaauuuugacuuucaagucuuaucauuuaaggaauacauuuuacaagauuauagcugccauagauagugauuucucugguggaucuuggaaaaguaaacugaaaaccuuauaaaaacgauucacccauucuagaugccauucagaacauucaugauucaugggaggagaucaaaauaucaacauuaacaggacuuuguaagagauugauuccagcacucauggaucauuugaggaguucaagacuucaguguaggaagucacuguagauguggugaaaauugcaagagaacuagaauuggaaguggagccugaagauuugacuaaauugcuacaaucucaucauaaaacuggaaugcaugagaaguugcuuuuuauggaugaacaaagugguuuuugagauuagaaucuacuucuaaugaagaugcugugaauguuguugaaauuauaacaacagagacuuuagaauauuccguaaacuuagcugauaaaguagcagcagaguuuaaggggauugaguccaauuguaaaaacaaucucuccuguggauaaaaagcuauuaagcagcauagcaugcuacagagaaaucuuucaugaaaggaagucaacagaugcagcaaacuucauugucuuauuuuaagaaauugccagucacuccagccuucagcuaucacccugaucagugaguagccauccgauauugggacaaggcauucuaucagccaaagauuacaacuugcugaagacucaggugauuguuagcauuuuuuagcaauaaaguguuuuuuaccuaagguauauguauugcuuuuuuagacauaacgcuguugcacacuuaauaaacuacauuacaguguaaacauuacuuuuauguuaacuugaaaaacaaaaaauugugugacuuucuuuauuucaauauucacuuuauugcaguggucuggaaguaaaccugcaauaucugcaaguuaugccugugguagauacacaaaagauaaauacauagcacuacaaaaaaaucaucaaaucacaaaggaagacagcaagagaagaaaggaaugaaaaaaacuacgaacaaaaugacgauaguaagucuuuaccuauuauuaauuacuuuaaauauaaauggauuaaauuccaucaccaaaagucauugaguggcugaaugaauuaaaaaacaggauccaaccaugugcugccuguaagacacucagcuuuaaggacaaauacagggugaaagcggggaaaugagaaaagauacuccaugcaaauaguaauuaaaagagcaggagugucuauacuuauaucuuagaaaauagacuuuaagucaaaaacugacacaagagacaaggucauuauagaaugauaaaagggucagucaggaagacaaaacaauuauaaauauauaugcauccaguaugagggcaccuaaauauguaaagcaaauauuaacauaccugaagugaaaaauaaacaacaauacaauaauaaaauaagacaucaagacacaacucucaacaauggauaaaucaucuggacagaaaaucagugaggaaacacuggauuuuaaccaaacuaugggccaaauggaccuaacagacauauacagaacauuccauccaacaacagcagaauacacauucuucucaagcacacauggaacauucuccaggauaaaucacauguuaggcuacaaaacaagucuuaacaaauuuaagaagauugaaaucaugucagauaucuuuucugaccacaauaauauaaaacuggaaaucaauaaaaggaaaauuuacaaauauauggaaauuaaacagucaauaaauauuaaaagggaagucaaggccaggugccaguggcucacgccuguaaucccagcacuuuagaaggccaaggcgggcggaucacgaggucaagagaucgagaccauccugaccaacauugugaaacccugucucuacuaaaaauacaaaaauuaucugugcaugguggcaugcaccuguagucgcagcuacucgggaggcugaggcaggagaaucgcuucaacccgggaggcagaguuugcagugagccaagaucuggccacugcgcuccagccugggugacagugcgagacucuugucucaagaaaaaaaaaggggggggaagucaaauaauaucuugauacaaauaaaaauaaaaaacaacuuaccaaaacuuauagcaaguggcaaaagcaauacuaaaaggaaaauuuauagcaaaaaaugcccuauguuaagaaagaagaaaaaggccaggcgcaguggcucacaccuguaagcccaacauuuugggaggccgaggcauacagaucaugaggucaggaguuugagaccagccaggccaacauagugaaacccugucucuacuacuacaaaaaauuaguuggguguggugguggucgccuguaaucccagcuacuuaggaggcugaggcgggagaaucgcuugaaccugggaggcggagggugcagugagccaagaucacaccacugcacuccagcccuggcgacagugcaagacucugucucaaaaaaaaagaaaaaagaaaaauuucauacaacguaacuuuaaacccuaaugaauuagaaaaacaauguucaaagccccaaguuagcagaagaaaggaaauaauaaauauuacagcagaaauaaauacagacuagaaaaagcgguaguaaggacuaacaaagcugggcauugcuuuuugaaaagguaaacaaaauugacaaaccuuuagaguaagaaaaaagacucgaagugaaagaggagacauuacaacugaugccacagaaauacaauaagauuauaagagacuccugugagccuucauuuccaacaaauugaauaaucuagaagaauaaauaaauucauagaaacauaaaccuuccaaaacugaaucaugaaggaaauauaaaauaccaucagaccaauagcaaaugagagugaauccauaauuauuaaaaaccuucccccaaaaaagaaaagcccaggacuggauggcuucacaggugaauucuaccaaauauuugaagaagaauuaaugccaguccuucuucaacucuucgaaaaaguugaggaagagggaacgcuucuaaacucauuuuaugugacuagcacuacugugauaccaaagccagacaaggacacuaacaauaaaacuauaggucagugucucugauaaacauagauaccaaaauccucaacaaauagcaaacuaaauuugacagcacauuaaaaggaucguauauccuaaaugggauuuaucccuggggugcaggcaugguucaccauaugcacaucaauaaauauacuacgccacauuguaacagaauggauaaaaaucuugaccaugucaauagaugcagaaaaagcauuugacaaaauucaacauucuuucaugauauagcacucaaaaaauuaaccauaggaggaauguaccucaacauacuaaaguccauauauggccauguaugacaagcccacagcuuaauaucauacucaauagugaaaaaccggaaccguuuccucuaagaucagaaacaagauauggaugccugcucuugccacuucuauucaacaaaguauuggaagcucuagccggagcaauuagggaagaaaaauaaaagcauccaaaucugaaaagaaaaacuaaaauugucugcagaugacauggcauuauauauagaaaacacuaaagacaccaccaaaaaaaaaacucuuaauaaauucagcaagguugguggaugcaaaaccaacauacaaaaaucaguugcaguucuauauauucaacgggaaauuaagaaaaucccauugacaguaacaucaaaaagaacaaaauauuuagggaauaaacuuagccaaagaggugaaagucuucuguuuuacugauaaaagaaauuaaagcagauacaaauaaauggaaaaacaucucauguucaugacuggaagaaauaguauuguuaacaucuccauacuacccaaagcagucuacagauucaaugcaaucucuauuaaaaucucaauggcauguuuuacagaaauagaaaaacaacccuaaaauuaauauggaacaacauaagacccugaauagccagagcagucuugaaaaagaacaaagcuggaggcaucauacuuccuaauuucaaaauauauuacaaagcugcaguaaucaaaacaguauugugcuagcauaaagauggauguauagaccaguggagcagaagagagaccccauaaauaaacccacucauuuaugauuaacugaucuuugguaccaagaacauaaaauggggaaaggauagucucuucaacaaaugguguuguguaaacugaaaauccacaggcaaaagaaggaaauuggauccuaucguagaccauggccagaaaucaaagcaaaauagauuuaagacuuaaauauaaauucugaaacuguaaaacuucucacagaaaacauagggggaaagcuucuuggcauuggucuugguaaugacuuugugguuugacaccaaaaacaaaggcaacagaaccaaaaauaggcaagugggacaucguaauaaaagcucuguacagaaaaggaaacaaucagcaaaauuaaaaagcaagcugaagaggccgaggcaggcagauuccuugagcccaggagcucgagaccagccuggacaacaugauaaaaccccaucuguacaaaaaaauacaaaaaguagcugggugugguagcaugcauguguagucccagcugcuugggaggcccaggugggaggauccauugagcccaggagaucaaggcuacaguaagccaugauuacaccacugcauuccaugcugggaaacagcaggacccugucuaaaagaaaaaaaaugugagauaaaaguaaggaggcugaggcagguagaucacuugaggucaggaguucaagaccagccuggccaacauggugaaaccuguaucuacugaaaaaaaaaaaaaauaggcaugguggugcacacuuguaaucccagcuacuugggaggcugaggcaggagaauugcuugaaucugggagccagagguugcagugagccgagauggugcuauugcacuccagccuggaccacagagugagacucuguguccaaaaaacaaagagaaauggaaguuaaauauuagcaaaccaucuaucaagguaaaagguuaauauccaaaauaugguaacucguauaacucaauagcaaaauaacaaauuuaaccuaauuuuaaaacaagcaaaagacuaauagacauuucuccaaagaagacauacaaauggccuccaggcauauggcaagaugcugaguuucauuaaucauggaaaugcagaucaaaaccacagugagauaucaacucacaucuuagcaugucuauuaucaaaaauaaauuuaaggucaggcaugguggcucacgccuguaauuccaacacuuugggaggcugagaugggcagauugguugaguccaggaguucaagaccagccuggccaacaugcugaaacccugucucuacuaaaaaauacaaaaaaaguuagccaggcaugguggcgcacaccuguagucccagcugcucaggaggcugaggugagagaaucgccugagccugggaaguugaggcugcagugagccuagauggugcccugcacuccagccuuggcaacgagagugagaccgucucuaaauaaauagacauuugugaggauguagaaaaauuggagcuuuuauacaacuguuugugggaauguaaaauggugcagccacuauggaaagcaguauggagauucaucaaaaauagcacugccguaugauccaauaauggaauauuucuggauauguauacaaaaagaguguaaucaggaucucaaagauaucugcacacccauguucacugcaccauuauucacauuagccaauauaaggaaacaacccaaauguccaucaaaagaugcauaaagaaaaugugauauagacaugcaauggaauaauauuaagccuuuaaaaaagagagaaauccuacuauauucaacaaacuggaugaacccacaggacauuaugcuacaugaaauaagccagucacagaaggacaaauacuacaugacuccacuuaugugagguaucuaaaauagucaaacucccagaagcagagaauaaaauggugauugcuggggcuguaaggagggaaaaauggaaaacuguuaaucaaugaguauaaaauuucuguucugcaagaugaaaaauuucuagagaucuguuguaaagcauaguaccuauuaggauugugugagucuguugaucaauuuggggagaauugacauguuaacaguauugaaacuuccaaccaacagacauggcauuccauuuacuuagaucuuguuugauuuauuucaacaauguuuuguaguuuucaguguauaggacugauacuucuguucaguuuauuccuaaauaucuuguauuuuugauacuacuguaaaaaguuguuuuuuaaauuuuaauuuccaaauguucauugcuagcauguagaaauacaauugauuuuuauauauugaccuuguauccugugaccuuacuaaacuugcuaacuuuacugaacucauaguuauaguagcuuuuuuuagauuccuuagaauuuuuguguaaaugaucauguaauuggcaaauaaggacacuucugcuucuuucuuuccaauccauauucuuuuuauggaugaauaguuuuauggaguauaguuuuaauagcugauuuaaguucuuucccuaaauccuucaucugccauuucugaguauauuucuguugauggauuuuucuccuaguugugagccguguuaccuuaccacuguguggacucuacugcuuuccagcgguucucucuucagacuuguaguuuugcccaacacauguacaaaucauuacucagccaaaaaccuggguaauaugaagucuuugcaaaucugugaagcucuuucuguacaguuugucucugguacucugcccuaaaauucuagacugcaaacuccccaaaaucucuugucuccucgauucagggagacuaccaggcuauguuguaaccugaaaacucucuccagaccauaaucggaggcaauuuauaauacacaccucauuuuuuccccaucuuucaggaucacaguccuauauugcuuauuguccaaugucugaaaacaauuauuuuguuuucucuaguuuuauaguuguuuacagagggaaggccguuguccuuaguguuucuuuguagaagaaguaaaagucucuuacauguguauuuuaauaccaccaaauaaaugaaaguugaguugaaaggagaaaaauacugagacuguaugacuguccccucugaguauuauuagaaauugugugacauauuuuuucuacuuuauauaauaccuuauauucuccaaagccaaauauccauucuuuuagaagccuuuaauuuuuuuuauuuuucuuuuuaagaaaacuuauggaaaacaaauuaacgucuuuauaauuuauggauaugguagcaacuuuagaauaaagaaaggauaaaaaccuuaaaagcagacauacuuauauauguuaguaauguauucuuuggagucuaauauggaagccauucucacaagaacaguuuuauauccuuucuguaacagaaaaaaauacgguuuuuuuguucgaugucuccuugaaauguuuuuuaaaauacaguuuagaaucacaugucaaguugauuagauuuaccagagugacuaaaacuuuuuaaaggucaagaaaaauuagauuauuuccauuaguaauuccugugauguuuuccuugacauguucuacauuggcuguuuuauaaccuuuuccuauuuacuacuuggauucuucauauuuuucuuauguggggugauuuuauauaugaauuuuuuaaaauguagcauuuguuacacauuuuucucacaauguugguuugcccuuuuuagugagguaugcuguuggauaucaaguuuuucauuuuuauauagucaaaaauguaucacuuccuaauuuauugcuauucuaagauuaggaagacuugacuaucuuaaaagcaccucagguucaacaugugcaaaauagugcucauuguuuacuucaccaccaugccuccacacccccccaaaaaauucccugauuuucauuucuaauauucccuaucccaguaagaaagaaacuguaccauguuaacacaacccagaaaauuuaggaguuauucuugccuacuguccccucacccccuauagcuaauccagcaccuauuccuguccauuuuaccucugauauguagcuugaggcuguccauuuucucuacauugaccaacaaaacuccaguucaaggugccaguaucucucaucucuauuacuaaaauacuuucuuaacucaucuccccacuuugguucuggcauccuuccagacucuucuaaugccacaguaacauuuucuagacagaaauuuaaucauuuuauuccuuuuuuuuuuuuuuuuuugagacagaaucacacgcaauggcgugaucucggcucacugcaaccucccaucucccagguucacgcgauucuccugccuuagccucccaaguagcuggaauuacaggagcacaccaccacaccuggcuaauuuuuuguauuuuuauuagacaugggguuucacuauguuggccggacuggucucgaacuccugaccucgugauccacccaccucagccucccaaagugcugggauuacaggugugagccaccgcgcccagccuauucuuuucuuaaaaugauuguugagcagcuuacaaaauuuuuucuuugacauagaacccugucuaccucuacgucaucauuucauguucacuuacucucuguacuccagucacucuggauucuuuucagcucgcuuugaucucuucaagugcugcaaaugcuuuuccuuuucccuauaaugcugucucccuaccuuacuucuccugguuaacuuccacuuauucuuaagauccauuuaaagccgggcacgguggcucacgccuguaaucccagcacuuugggaggccaaggcggguggaucacgaggucaggagaucgacaccauccuggcuaacacggugaaaccccaucucuacuaaaaauacaaaaaauuagcugggcaugguggcgggcgccuguagucccagcuacucgggaggcugaggcaggagaauggcaugaacccgggaggcggagcuugcagugaaccgagaucgugccacugcacuccagcuugggcgacagagcgagacuccaucucaaacaaacaaaaaaaaagauccauuuaaaucaauuuagggacgccugcucucccuuacagugucaaauaugcccaugauauguagcaccauguacuuguccuucacagcacugaaucacuauugugucucuaguauauagcacaguuccugguacuucguaggcccucagggaauuguugguuaaaugaauaaacgaauuaaugauuauuccucaagcuaaauuuuagaaucauugggcuuuuccgugaaauuaaggugauuuacuugagaaaaugugacauaccaucaagaaaugguguuuuucaggccagacaugguggcucauacuuguaaucucagcacuuugagaguccaacaaauacaaaauauuuaaaauuauccacauaugguggcacaugccuguggucccagcuacucaggaggcugagcuggaaggaucacuuaagcccaggagguugaggcugcagugagccgugaucauaccacugcgcuccaaccugaacaacagagugagacacuguguccaaaaaaaaaaaaaaagaaaugguauuuuucauuuauuuaaaucuuguaucacuguuguagaugauacauuuuuuaauugaaauuaucccuaaguuuuauguuauaaaugaaauaucuaguucguuauuauuggacuuaggaguuuucucuucauccaguuuucuccuauuuuauuuacaauuuuacuaucagaaaacuauauguuuuguagcuaaaauuaucuaaaaccaaaagauuuuaacauaguuuucuaguuuucuuagguagagucugucucccaggcuggagugcaguggcaugaucuuggcucacugcaaccuccgccucccaguucagcugggauuccaggcauguaccaccacgcccagccaauuuuuguauuuucauuagagacaaggucuugccauguuggccaggcuggucucgaacucccgaccucaagcgauuccccccgccuuggucucccaaagugccaggaccacaggugugagccaccgcaccuggccuuacauaguuuucuacuucuguuguucauaagcuguaugguuugaucauaaaacuggagaagguucucuuuagauuucaguuaaggaauauuucuuaacugaguagauaucuucagggcagugacuuacccuggagcauuuaacauguugacuaaauuaacugguuugagacauguuuauauuguaauuaucaucucuauaaaauuuagagcuuacauaguuugucauauaucauugugucauuuauccuuaaacccuauaagguagguauuguuauuacugaugaagaauugagucucacgcacauuaagagacuuuuccauggucauuauaaauuuaguuccugaaccaaucuuuauacccugguccuuguucuuuaaagcuuaugccacuucuccuguaucauguugcuuuguauguauaaagaaaucugaaccccaucucuacuaaaaauacaaaaaaauuagccgggcaugguggcgggcgccuguagucccagcuagucgggaggcugaggcaggagaauggugugaacccgggaggcggagccugcagugaaccgggaucgcgcuacugcccuccagccugggugacagagcaagacuccgucucaaaaaaaaaaaaaaaaaaaaaaaucugaauauauguauaaagcaaucugaaaguacuuaacuggauucuaauugaguuauaaaauagaaaccuuccuagaauauccccuuugcauauucuuauuuuuuauauuuauauuuuuuaaguauaaauuauuuagcaaaucauuuuaaaugauuguucuuguaggaaccuucagaaguuuagucuuuuuggagacauaaguguucuacaacagcaaggaaguuugucaaauacauaccucagcaagguggacccugauggcaaaaaaauuaaacaguaaguuauaugguuaauggaaaggagguuguacuauuaauaauauguuuuuccuaagaaauuaugagauacaaacagaagaguaaugauuuuuuuccuaaaaggaacauagguccuggaaauguuuuaauggugaaauacagugaucagcaucugccauuccaucucauaaaucuuuaagaaaaaucaaguaacuuaguggauaauuauugcuauuuaaaauuauuccucuacuugccuuugcuauaacauaaauuguauguuauccuacuuuucuacuaaacggguauaaguggugcuuuucuuggaugaggaacauauuucuacguguuuaauagaucuuuauguuuaauauaccuuauucauuauauuuuaaugugaauuuuaaugguauuuacuguggguugaaucgaaauuaccuaaugaggaaaaauagaucucaaaauugcaugcuuuucauugccuauuuucaaaagucaguguuaaaagauuagaacuaaauguuaaugggaucacuguggcauguguuuuccuuauagaauucagcaacuguuugaagaaauccugaguaauaguaggcaacugaaauggcuguccuguggguuuaugcuggaaauaguaaccccaacaucacugucaucucucucuaaugcuguugccaacaccauggagcaccucaguuuacuggacaauaauauuccugguaacagcacucuuauuacugcaguugaacuggagcgauuugugaaucugcacucacuugccuuggauuuuugugacuuuacagcugagauggcaagagucuuaacugauagcaaccaugugccuuugcaacgacugucucuucugguucacaauguuucuguaaugcacaagucucuggacaacaugccaaaugaugagcauuggaaagcccugucacgaaagagcaccagcuuucgggucuauauaauggcuuuugauaucaagagugaagauauguuaaagauucugaaacccaguauaccacuagagaggauucauuuugauagcuauaucacuuguguuucaggggcuauuguugaucuuauauccaggcaauaugacaaguuccucacucauuuuauuuuaaugaaugaugugauugacacaucugguuuuccagaucuuagugacaaccgaaaugaagauccguugguuuuauuagcauggaggugcacaaagcucucucuucuggcaauucaugguaggugaucuuguucauuguaaucugauacuggaauuagaccgaaaacauuuucugccaguaaagagauagcacugaccuuuauaguaucaagaaaucuuguaucaaguugauauacagauucuuaugcuuuuuaaaguuugcaagauauaucacuuacaaaaggaaaaucauauucaaacccaaguguucugcuccagcuucccuguuacuuuuuuguccaucaugugaauggcaguauuucauaaaaaaucagugaaauuaauuuagcuaagaaagcacacauaccugugguagauauauuuccucuaaucacacgaccccuuaaaacauagugcgggggaagagaauguaugauuucuuucaugcucacuaccucaucuuuuagauucuugguaucaaaguauuaauguauauaauuuuuuuaacgaugguuccauugauaugcuucuuucauuuuaaugugaccuguucucauuuggaucuagaguugguauucugacaaauaaauuuacuuccuuuucggauacuuguaagauaauuacaaaguagucuauaagaaugucuuaaacucucuuauuagcuauccuacuagcacuguuucauuauuuuuuuuuuagugugcauuuguauuugggaauguaugccuugcuuuucaagucuugcuuuaugccagucaucagagguagcagaaaagacuagaucaauacugaaagugcuaaacacaaugggcuaaagacauaucagguuauuuaaaaguuaauuuaagccagucuuuuuaaagccuuuuucuucuuuaugcuaaagcuccccguauucauuccucuuuauuccuucccagaaguaguuauuauucugaaguuggugcauaucauucacaugauuguuuuauaauuuacguauuugcuacugacaauuaacaguuuaccuuuaaagugucacuacauaacuucgcaaagcauuauaggagaugauuuuucacaaaugaaaaauacauuuaccacgugugguuaacagauacaugcauauaugaacuaaaaauuucauccuuaugguacaucuuuacccaaagcuauaaaauuuauuuguauauacuuuaaaugucuauuuuacugaaugaaguagugucauaaaggauuagaucaccugccaauucaccaccuauagcgguaacucuugaacacaacuucuagccuuuuuuuuucugggcuauacaaccauguuuccuuuuccaauuucaauauauuucuaaaggaaaaagaccaaaacgguaagugagauacaaauuugaagcuucucuagaagcuuugaaugaggaaaagacagacuuaccaaagagaaaaggaaaugcaaggaaauuacaguguugucuuuuguuuauuuuucagguuacacggugugggcacacaaccucauugccauugcucgucuucggggcucugaucugaaagugcuugaagucaccgaagaaagcauugauuuugaccaaggugaacuggccgaccaggauguagauccagugcauaaccuuauugagcagguaucccugggccugggucaaccuuggcaugcagucauggacaucgaaucacucagugucuucacugaaccaaaucgucauuuuuacagagagaugcaaagcuucagugaagacauuuagcuuuuuuuuaauguagaauuccugugguuacauaugcaaguaggguccuauuauguuuuuuuuucaguagugugaauuaauccuuuugugcuguguuuaaucaguauuagcuuuauagaauuauauauguauauucuacuucuugaucaaagaacguagucggguauugguuuagaaguucaaagugacaauguauagggcuuucacgguuaauggacuuguuaccaaaccuuaaggauauacagccgaagauugucugagguugcuggcuaacuuuauuuuucacugaguuacucugccuuuuugacguuuuuauucuuugugugucagaguucagagcucaggagccaaaauauuuuuauacauauauagauauauauccauagccugguagauuuauaugcaaugcacugcauccaugcauucugauagcauuucauuaauuuugauuucaaauggaagauaaauaauaucccaaaugaauuaucuguaacagaaaagccaagacuuuaacuuucauuacauaucuaauaguugauaucaccaguuaccauuuugaauuuuguauaguacuagguuagaacauugcuuaauccuuuuaaaaaaaaugcauuuacguaaacacgaauacugaaauuguuggauuuuuuaacuauaucugacauaauuuuauucaucaauuacauuacacauucauuuagcccagauuucaaauagugggggaagaaagaaacuguauuucagaguaaaaucuccuaaaggaaauaaaaacacagaguuguaaauacacaugcuugcaaaaacauuagucgugaaaucccuagcaacaagucacuggauuuuucucugucagcacgcgugucagcugccaaagaauagacuuaaugaagaagugcccacaugcuggcaggggccggcccacucuggccagccagauacugcuagauuguaauauuuaaggucgaauuucgaccugugguacacagcugugcuguggcucagucagcaaccucagaacucugaaaaaacaaaacaaaaaaaaaaaaaaaagaaaaaaaaaacaugcaccuguuucacugugaauagugaauguaaaggaaagaaaggaaaaacugaaagcuuguucuaucacagguaugagcugcuaugauacaugaagaacauuccaugaaguauguuuuaaaaccuuguuauaucugagaggcuuuaaaagccuauuaacuguuucagggcaaccgcgguacagacguggucucugugagacuuccaccugaccccaguuuuaagugguacgaauguugugcauuuaauguuaaaggacagucugcaauaauaaaguaaguagccaaccugggugcccagcagugcugagaccuggcugcucuauuguaagcuuuggaaacacaauuuaugcaacagauguccagauaugauucuauuuauggaaaaaaguuuauauguguuuuacaaaugguuuuaccaucuuauauuaaaaugaccuuuugacaggugugcacuguuuugucuccagugagcacauaccaugcggauuuuauauguacaucaguagugugaauccacuggcacaguguguguaaaugccagauguggugagauuuuaucuuauaaaugugaucagauaaaauaacuccugacagaaacuguaaggaaaccagcugaauguuugaccugaugacugauguuguaugguuuauguuaaauguauauucuuuuaaucaaugaauaaagcauuaaaaaugaucauuguaauauauuuuauuguauaugaagcaugacuacuuuuaguguuaaauaaacugcaauaauccuuauauuguguauaauaauguguuaguauucugguuguauucuggugcagcaaagcuuaaauuugagauacauuauaaaaagucuuagcugaauaguuuggaagauuuuuuuacagaaauucacuuugacaaaauacaagcuuaaaagcaaacaaacacuggauuucuuagcacaaaaucucaguauauuaugcaccuagaauacauuacauuaucaauaugguaaaacuuaauuuauagacuagaggggcugcuuuuuuaaaagaagauuccuauaccaaaugcaaaaauacuuagauaugccaauauuaaauucuucauaaaccccuauauuccuuuauuuauuuugguauucugaucucuguucuugguuguugagacucacagcucuuauucauaggaaacaaaaggacuucuuuucuuccuuccaucuucccuuccuuaucauuccagacauugacucuuccaggcacugcuuuaucuuggaauaaucugguguucacaaauaauuguccuuauacuuuuuacuuaccacuucguuacuuuccuggacacaucugaguccuuugaaugaaucaacauguuuaaguauauauuuaagacguacccaaaauguacgaaaaaggaaagucuacuaauaugaauagcaugcaaguuaagguuauuguaguaaagcucuaaauuugggaggcuugacaucuguuuucuagucuaagcucuggcucuacuugagcacagacuccucuuucagcuuugguuuccucaucucuaaaaugaaggauuggucuuggcuagcuaaaacuccgauucuucauugaaauuuuccauugcuguuagcucaguagcucacagauacacaagaucaucuuuaaaccaagguauuaaauauuuucaaaacauagcuuauuaaacuauaugaaauuuacauaucuaucuaaaauuacuuuccauuuccccaccacaaagaugcagaaauugaacacaaagauggggaaacuugcuugggacuuagagcaugagucauauuggauccuuaugaagccaguaacauaacacagugcuaauggaguaacacagcagaugugaauaauacccagggaccauaccacauuguaucaauguuucccaaccuuugucauguuguagcacacauagaaaauauuguacagcauacugguauaaaccagaaagaauuagagaaaaaaauuacuuuuuuuaaauuauauaauugaugaaaaaauguagaagauuugaggaaaaauacugaauuuguauggaacuuucaaauaaaaucuugccagauguuuuaauuga

SEQ ID NO: 192356 - RNA, 50213 nt, Homo sapiens
caacuagaggagcucgcccccugccugugacagcuuagggucgccuacuuuuuguggacacacugccguccacggagugcagaggccgccugcaguuuucuugcgucccugugagacgcacgguggcgcaauucccgagcgugccaaucccgggcuggcuggagggcgggcucuucaaauuugaauugcggaaguguuuuguguguuagagaacgucgcggaggagguaagcgucgcuuggcgccuggccgccgcgggcaggauacaccgugggccugaggcgcgagcccggcggcgugcggcccucucuccgcgcggagccgagccggaacugcggcagucucucccugccaggcucuucauccaagguacguccuccccgcgcccuccgcuaaccuccuaccgcggguccccgcagauggugggcgucugcccuuuaagcaucucggcucacgcgguuuuauuuauuuuuuuuguagauuucuggcuuugguacggauuuuauacuucgcacucgauguuuacuuguugcgugucuacuguacuuaagagaguagaacacgauugcucaaauuuauuucgauggugagcguucuaggucuuuguucuaaaauaaauuuuuuuuuuuuuuuuuuagaauaccaagugggaaaauuguauuccucaguacccaacucuuccccuugggaccccaggacccacagggcuauagaagcaguugaucauucagcuuauguuuucuucugguuaaauugcaugcuuguugcaaacaucuuuagauguuaauaaaauuauuuagaaaauggucgggcgcgguggcacacgccugugaucccacacuuugggaggccgaggcggguggaucuuuugagcucaggaguucaagaaaaugguaggccacuucauccuggccuucaaagauaaacacuguuuacaauuugguucaccgcuuccagaguuuuucucuaugccuguauguguuuuauuuauuuacuuaaaaauuuuuuuaaacaaaugcaauucuauguuguuacuuucuuuuucaauuuaauguuucuuggauacuuuuccauauaaguacauauauaucuuuuuauugaauacauagaguaaauuguauggauguggcgggauuuauuuuguccuuuauugguagacaucuggguuguuucauuucauuuuaugcugcagugaacuucccuguguaguggguguguagacuguugccuguugguaaauaacugaagcuauggagucggguagaaucgguuccucuuucucacuuauugucaagugaccuugggcagcuuacuuaaccaccuuauaccuuaauuucucuuuuuucaaauugggaguaauaacaguacuuaacucuuuagaguugcuguuagauuauauaguggcuggcauguaaauauucaguaaauaucggcaauuaugguacauauauauuugcauucuuacgcagauguuucuauaggaaaaaacaaguuagaaguggaauuuccgugucaauaguaugcauacuugcauuuugaaauuaauauuuaccaaugugauaugaaaaagaaaucucacuguuuuaguuugcaucuccauuuauuaguaaaaucaggugucacaacucguuuauuggccuuuuguauucuauuaaucaccuuucaugucccaugaccauuuucuguuuuguauauuuuuuaaaguugauuuauuaggucucuuugaauguuauuuaaauuagcccuuugucauaugugcugaguauuuuuuucaaguguaucauuugccuguuaacuuaaaauucuauuuucccccuaauucuaugucccaguuuugguuagugugcucugggauuuuugacccauuccauaguaauaguuauuacuacuaccacuacaguaaauucuuacaagaacuuuccauguuuuuugggaggaggaggaggaguaguuacauucaggaucauauacauaauuguuuagcuucaguucuguauuuauauaugucacuuguaacugacugggauacguucugagaaauacauucucagguaauuuuugucauugugccaauaucauagaguguacuuauaaaaacccaggcuauauauuauaaccuauucugggcuucaaaccuguacagcauguuacuuuacugaauacuguuggcaguuguaacacaaugauaaguauuuguguaucuaaacauaccaaaauauagaaaagguacaguaaaaauaaguuuaaaaaaaagguacaccaaaauaaucuuaugggaccacuguguaugugguuugaugucauuaugcagugcaugacuguacuauaaaugcuuauggccagcccuuuuuuuuuuuuuuuuuuuuugaggcagagucuugaugucucgcccaugcuggagugcaguggcgcgaugucggcucacugcaagcuccgccucccggguucacuccauucuccugccucagccucccaaguagcugggaauacaggcgcgugucaccacgcccggcuaauuuuuuguauuuuuaguagagaccgguuuucaccguguuagacaggauggucuccaucuccugaccucgugauucgccgucauucgccucgugaucacuuggccucccaaagugcugggauuacaggcgugagccaccgcacgcggccuggccagcccuuucauccaaugguuuucccauucccaugucuuuauguugaaaacaauuuuuuuucccuaguacaucaacauuugucaguuuuuagaauaaguuuuaaggauuagauuuuuccaaacaacuuuaagcaguuaaugaaaacggaaacauacuuucuccagucugagaggaacuaacaauuucuuguuagugaccuccaucuguuaggucaacaaaugugcuuggcuucaggacaggcguucuuuccuccacuugcggguugcuaguuacuaaaucuccacuaaugucuguguuucaucagaggcugauuucuuuguuuagcuguuuugacuaggaaggaaauggagcuucagauguguccuggauuaucuagacccagugguuuuucuuguuuaucuauucugcagagccucuguggucagaggaaauuguagacgauuuuuuucuuggcuuauauugaguugcuguuuaucacauggugggaaaaaggucuccuagagcaacuuucuguuucuuugggaggggaaguggaauuugaggauuuuuucagaaucuuggcuaaucaccuuuauccuacuacuugccugaauuaggggcagggacauuaggaaacagaaagcucuguuuugguucuuggagccuuucaacgugaccacaauuaucugacuuuaaaugaagacaguucugcauguccauuacagguugguucuguuuucagugcugcucgcuuauuugcauuuuuuacuuucuguuuagcauuucauuaggcucugaggaauugagauuguguaaaccugaacauucuuugccauuuuguuuugcagucuuccaguuuauuuuuauuauuauuauuauuuucaguuggagucucacuccgucgccuaggcuggagugcagugguggugcgaucucagcucacugcaaccuccgccucccagguucaagugauucuccugccucagccuccugaguagcugggacuacaggcaugugccaccacauccggcuaauuuuuacauuuuuaguaaagacggggauucaccguguuggccaggcuggucuugaaccccugaccucaagugauucuccugccuuggccucccaaagugcugggauuauaggcgugagccacugugcucagccgaguuuauucauuuuugauuuugagagauuguauagcuuuauugccuuucuuugaaaugaacagcuaagccagacaugguggcucacuccuguauucccaacacuugugggaggccaaaucagaaggaucacuugagcccaggaguuugagacuaaccugggcaacauagggaaacucugucucuacaaaaaaauguaaaaaaacauaacucagguggcucaugccuguaaucccagcacuuugggaggcugaggcaaguggaucaccugaggucaggagaccagccugaccaauauggugaaaccccgucucuacuaaaaauacaaaaauuagccgggugggguggcaugugccugugaucccagcuacuugggaagcuaagacaggagaauugcuugaacccaugagguggagauugcagugagucaagaucgcaucacugcacuccagccugggcaacagagcaagacucccucucagaaacaaacaaacaaauaaguaaaaaaaaaaaaacauagcugaggugcaguggcacacacuuguggucccagcuacucuggaggcugagguaggaggauugcuugagcccaggauuucgagguugcagggagcccugaucacaccacugcacuccagccugggugacagagacacugucucaaaaauaaaacagaaaugaagugaacggcuaauauuauaacuucuaauacagaaccccuggaacuagcacaucauaaacauauacaugcaugcguuaauauguauuugcaggauucguauguuaugaaagaauuauagugguuuuuaggaacuccagacucccaagauagccuucuuuguuggcuguuguaauuuaggaauauuuuccuucuuuuuuucucuauuaucauaaauuauuggauuaaauaauacuuuguauauuaauugcuuauuucucacagaaguugcuguagauaaagauacuugauauuuuuuggucuggcuauguuagaauuuucugugauaguuuuuuuuuauguuuauaugauguuaacuaauuggaauaguuauaaauucagcuauaagagaugcuguaaaucuagacuaguaaguuccaggcuccuuggauugaaauguuuuauuuauuuaccaaauauuaguuaaugcaacuauaugguuccuuaccuagaaccuuaauuucuaggugugaauaauaaaauuuauacauaagaaacaaguuguggccgggcgcgguggcucacaccuguaaccccagcacuuugggaggccaagacaggcagaucaccugaggucaggaguuugagaccagccugaccaacauggagaaacccugucucuagcaaaaauacaaaauuagccgggugugguggugcauacauaauuccaauuccagcuacucgggaggcugaggcaggagaauugcuugaaccugggaggcggagguuguggugagcugagaucaccacugcacuccagccugggcaacaagagggaaacucugucuccaaaaaaagaaaaaaaaaaaaaaaaaacgaaagaaacaagacuaaaacuacguaaacucaaguacaguauuucugcuaaaaauucuaaauagcacuacauuaaaaaaaaucagaaugaaaacaauuuaccauuuauuugaggauuuuucaacuaagaccuuaaaauguaaaugcucuggagcauaaaaaaucaggauuggguauuauuaacuaauugaauaguauuuuuuuagcuuuuauuagaauagaucuuguaguugcugccuuaaaauuuaacugccuaaagggaaaaauuauauuuguggaacuuuaucuuuuguaaccuaauguagugccauaugcauauaucuuuuauuuuguuuuauuuuauuuuauuuuauuuugagacaaggucuugcucugucacccaggcuggaaugcaguggcacaaucaugacucacuguggccuugaccucccaggcucaagugauccucccugcucagccucccaaguagcuaggacuacaggcguguacaccaucacacccagcucuuuuguuaaggagacuuuaacaaaaauaaaaucuuagucugauuugugauuaucuaguauuguuaugaaccaguuaaacauuuuaauuaguauaauguuguggaaagcaaauaaacuuuaaacauuuucugcaccaaagcaugauaaaggcugauuuuacguugaacuacagguuucuguggaucccuucugaaguucuaucugaaaauugcgcuuaagugaauuuucuguuagaagaacuugguugcuacuuucuugucaagaugauugcaacaccuuugaaacauucaagaauuuacuuaccuccagaggcaucuucucaaaggagaaaucuacccauggaugcaaucuuuuuugacagcauuccuucaggcacacuuacuccuguaaaagauuuggugaaauaucagaacuccuccuuaaaauugaaugaccauaaaaagaaucaguuccuaaaaaugacaacuuuuaacaauaaaaauauauuucaaucaacuaugcuaacagaggcuacuaccucuaacaguucucuugauaucagugcuauaaagcccaacaaggauggauuaaaaaauaaagcaaacuaugaaucaccaggaaaaauauuucuaagaaugaaagaaaaaguacugcgugacaagcaagaacagccaucaagaaacaguaguuuguuggaaccacagaaaaguggaaauaaugaaaccuucacuccuaacagaguugaaaaaaaaaaauugcagcauaccuaccuaugugaagaaaaggaaaacaacaaaucauuccagucagaugacaguucacuaagagguuaguuuuauguguuagcuaaaaagcuguaaugucuuaaguguuuaauguuucagacacuguuuuaggugcucagaauauagcagugaacaaaauggacaaaaauccuugcccuuguguagcucauauucacauggugggaagacauaauuaacauauuaaauaaguaauuuuuauggcuuaguagaagaggaaaaguggaaagaggaaaaagcagaauuaggaugaugggaagaguuggagggggauguaauuuucagugcgauggucagaguaaucuucaguaauuugaauuugggaauuugagcccacaaaauugaaugagaugacagauacauguaucuugaggaauggggaaggaugaucuaggcagcuguuauaaacgccuugaaauagcaugccugacauguugaaggacuagcuaugaaguuagugugucauggagugaguagauagagcucagaaggaagggauaaauaagagugggucagauaauauaagggccuuguagguaaauguaagaguuuuggccuuuacugugagcagaauaagccaucggaggguuuugagcaugugaaugacaagaucugacuuaugaggguuuuuuuguuguuuuuuaguuaaccacuguguacaaugacaauguuuuuaaaaugucacucuggcuguucugaaauagaguuacugcaguaagccagaugacagccgguguuggcuugguucagguguuaguagugcagauaguaaaugugcagaugguaaauggcuggacucuaggacagacggaaggaggaauggagugcgggcucauuaacuaagauuuuguuauguuaauuuugauaaccucuauuaaaaaucuaaguuuagguauuaggguguuggaaaaaacuaguuggaauuuagagaagugaucaaggugagaaaaguacauuggggaaucauuagcaccuaaaugguauuuuaaaagcaaugagauuagaugaggucaucaaggaguaaguguagaaagagaaaacauucaagagcuggguccugggguacuccagcauuuggaagguagaauaaagaguagaaaggccggccgggcacgguggcucaugcccauaaucccgucacuuugagaggccgaggcaaguggaucaccugaggucggggguucaagaccagccugaccaauguggagaaaccccaucuguacuaaaaauacaaaauuagcugggcuugauggcgcaugcuuguaaucccagcuacucgggaggcuaaggcaggagaauugcuugaacccgggaggcagagguuguggugagcugagaucacgccauugcacuccagccugggcaacaagagcaaaacuccaucucaaaaaaaaaagaaauaaaaaagaaaagaguagaaaggccacugagaagauugugaggaagaagaaaaaccaggagagugauacugugaaagccaagagaaugaaguacuuuaaggugggaguugacagcugucuaaugcuccuaauuggucaaguaggcugagauucuacugcucguuuuagcaaugugaaggucauuggugacuuugauggagggcagcuuugguggaaugguagcaacgaaaacauugcgugaaaggguucaagagauaaugugacaagaggaauuggcaauagugaacauagacagcucuuuuugaggcuggcaaagaaauaauggcaauuguaguuuaaaguuuuaucauuuuuaauacuuggugaaauacagcauuuuuauaugcuguugggaauaauggaguaggaagaaaaaaaauugaaguugcuaguaugaugcccuucaguaguugagaggaaauauaaucuaaugcaucauuagcgguuugaccagaacacagacagaccaauuguuaacugaaaagaaagccguuuacacagauguugguggauuauuauuuuaugacuucacaaauaauuugaaauaaguaaagucaucagcugagcaauauggaaaacagguauugaaguuugaggagguagagauuugaauaguuugggagaggccuaaauuugauuuccuggguaacacagaagagcuguuuaagauuugugaacaugaauuuaaaauggaaccaguaaauauggcugugaguuuuccuuuagcccuguuuugcugcuaagaugcugguguagaauuggggggaguuggauuuaacuggguuguaauuuugccaaauagaaugaagugacagaaggacaaaggagggugugugugaaggagucauaaugaaauuuaagcugauuaaugagggcaaaggaucugaaggagaugagggauugugaaguguauauuuuauuuggauagucacuggauuugagagaaugaucuggaaagaugacacuacaacaauuaaaauugagauuuuaaugaguuucagucacugauaaugaaagauauuuuacauguauuaucucuuuuaauccuuucaacgaacacauggguagaugcccauuaguggucuauaaauggggauuguaaagaguguaaguccgcuugcucuaugucucauagguagcaaguaauaagcugauaacugaauauagguaucuguuagaaagcccauguucuuaaccacuacacaguagguuguggguauauuguugcauuuccaagacagugacauauucuaacacagaguuuucuaagggaguuuggggguagaaguggggagacucacaaagucaucuauuucucauauagccugggagaaaaggaagaagcaaaugaaauaauacauauuaaaguuuuuaaauauaauaagguagcauuugagaguaagaaauaccugaccauuuugagaaucuggugacccuuucccccagaaaauauaaacacaaauagaaacacaaauuuuguauauacuuuuagaaaccuuuuagagagucuacaugaaccugggacucccacauaagugaauaaauauaacuuauugcauuugauugaauuacuacugaauugccuugccauuucuuguagaaugaguuaaagauauagaaacuuauuguuucuuuuugugacacguuguuauaaugaaaucuuuaucuuaagauuucugagaccaaaguggcauacuuauuaaagcauagucacuaccaguuuuuucaaguauaaaauuuaaaauuaaacauauaagauaauucuucucaggcucaaauuuuaagucuauuaucauccccuuuuugugugaaagaaacuacauucgagaaacauuaaacuuuaaaaaucuaggagguaaagcagaauaagaugcaagcagugcuauuaguccuuauuuaucuaguugagaaaccuacaacuucugagcauuugaaggccuacuaaaaauugucuaaaggauauaaauuauggcugagucugcuguugcaucucaacauuuuaauuuuuaaagaauaaguuacaauucuucgacuaucuuucaugcuuuagaaauucacagcaaccagaaacagaaucggaauuuucaagacugggugaaacuuuauauuguaaucuuaacauauacauauccaauuuguggcagcaccagaauuucagaucucuagguuucuaaguccaauacuuuugucuagagcuggcggguuguguucagagaagguuuuaaaaaauucuuccucaccguaauguugguauagagaaugggguaaagguaugagaagauaauacagccaaaaauauaaaaauauauguaacugucauauauugcaaaaguacuauacuggucugaucauuacuaaaucuaagugucuuuauuucaagaauuuuaaaagcuguuuuuuucuuagugacuaauacaauucaacuucuucuuucuuuaaaaaauaaaaccuuagccucaguccaaggaguuccucuagaaucaucaaauaaugauauuuuccucccggucaaacaaaagauucagugccagcaggaaaagaaagcaccacugcacaauuuaacuuacgguaaacuauuuuugguuuguuuucaguuuguuacuuaaguauauuguuaaauguucuagguaauuacuuuccuugugugggcauuaaacuuuagcuguggacaaaagcuugaaucguaaaagagacacucagagaaagacugggcaggaggguggaacguuccuaaccuaaauuuaucucuuuuaauuuccugugauccuucuauaauuguuuuguuuuguuuuguuuuguauuuuuugcagaacuuccaacucugaaccaagaacaggaaaauuuuuuggcuguagaagcccgaaacaagacauuaacuagagcucaguuggcuaaacaaauuuuucacucaaaggagaguauaguugcaaccacuaaauccaaaaaggacacguuuguuuuagaaagcguugauucugcugaugaacaauuucaaaauacuaaugcugagacucucaguacuaauuguauuccuauuaaaaauggcagccuguuaaugguuucugauagugagaggacaacagaagggacuucgcaacagaaaguuaaggaaggaaauggaaaaacagugccuggagagacaggucuuccagguuccaugaaagauacauguaaaauuguacuugcaacaccaagacuucauauaacaauaccucggaggucaaaaagaaauauuucaaagcuuucuccuccaagaauauuucaaacuguuacaaauggacuuaaaaaaaaucaggugggaaaacuuuuaagacagauauuuauuucuauuuuuaccccguucuucaagagcuugagcuuuuaauguucucucauuauuuuuuuucuagcuaggauuugaaccuguaugcuucauuauuaacagugucuucauuaucauguuuuauuauuuacugcagugacagugugacauagugaaaagaacagugaguugaauguaagaagacccacauguuaagucuuauuuugcucuauuacuaguuguguagucuucaauaauuuacuuguuccuuuuggugaugaacauugaauucauuccuacucuuuuuuuucugauacuuacaguacuauuaaaauaguuagauuaauuaagauagaaaggaacuguagcaucugaagauuugagaauuuuucccaaauuaaauacagaguaaucaaugaaagacuuuagagcauuaaacuguuacauuaggacaaauucucugaaggaaguggaauggaaauacaagcuuaaggaggaagaugcaguguaaaauuuccaauuguuagagguuugcccauuaauuaauuaauuauuuuugagcuggagucuuccucugucacccaggcuggagcacaauggcguggucuuggcucacugcaaccuccacuuccuggguucaagcgauucuccuacuucacccuccugaguagcugggauuacaggcgccugccaccaugcccagcuaauuuuuguguuuuuaguagagacgggguuuuaccgugcuggccaagcuggucucugacuccugaccucaagugauccucccgccucggccucccaaagugccgggauuagaggcgugagccacugcauccagccauuaauucuuaaauguaugauggugguuaucaaguugagaucauguauaaauuccaucuaaauuuuaauuaauaauuaauuuuuuaaaugaggccuuacucuguugcccaggccagccuuuugggcucaagcaauccucccacuuaagccucccuuguagccaucuaaauuuuaaagagugacauaccaguuaugguuuuauaucucaauauauucgcuagaaaucccauuauuggaaaauauuuaaacuuuauuuauuuaucuaucuauuuauuuauuuauuuuggagacagagucucacucugucacccaggcuggagugcaguggcacaaucucagcucauugcaaccuccgccuuccagguucaugcaaaucuccugccucagccuccugaguggcugggacuacaggcacaugcugccaugcccggcuaaauuuuuuuuuuuuuggauuauucucauuaacauauaaacauguugaaacauggccugcauuuuuuaaaaacaugcaaacaaaggcccaucuuuccuuuauccccuguccaacuccagcugcuacacuacuuuuuguuucccuuauauagcaagacauuugaaagaggucuguguauucaugguuggaguugagaagaauauucugugcuggaaacauauuggagagcuaucagcauagagauggaauuuaaaacuaugacacuggaaauacagccuagagagugcguguagguagggagaaaauugagggggcaauugaaagggcaauguccuuaccaccuaaaguaaaaggaaaugauuacaggugugagccaccacgccuggccccaaaaugucuuucuaaagaaguguuacgcuuuauauuuuguauuccaggaucguuccugauuuucugcuacauugcugcccaucccuucucaguccucuuugcuauuuccucuuucuuuccccagaaucaguccuaaaaauguuggaauuacugcagaucagcccuagaaauuguuuuucuaccuacacgcacucucuaggcuguauuuccagugucauaguuuuaaauuccaucucuaugcugauagcucuccaauauguuuccagcacagaaaauucuucucaacuccacacucaugugcaguugucuauaugacuuuucuauugauaucagauaggcaucucaaauugaaaaugugagaaaaugugagauucuuauucuugauuucuuuaccauaccuucuccauuguccuguauuaguacauuguaauaccauuggccccaguauuuaggcaaaauuuuagauucaucuuggacucuuguuucucucucaugcuccacauccaaaccaugaagaaaucccauuggcucuacucuccugaaugcggccucuucucacuguucaaccacuaccuccuaguccagggaugacugucauagccuaguggucucccugcuuccaguauugcuuuucuccuuuuucagucuguuuuccagacaagcuaaaaucuucauauagucucaucucuacccaacagucccuuaaaauaucaaauuuugucguucuguucagaauccccaguaacuugucaucucaauagaaaacacuaagccuuuaccaugguuuaccgagcuguacuuaguuaauccuggagaucuccaaccucaccacuuauucccucucacuuacuccuuucaaauuaugccuuccaugcugccuaccuggaucucugcgcugacucucugugcuuagaagaaucuuuuugcugauauccaugugacucauugcucacuuuauucaguucucucuuccaagacguucccugacuguuuugucuuaaaaagcaccucauuuaucuaaugccuuuuauuuauuuuucauaguaauuaccaccaccugacauuuucauauugguuuagaugccauuauccugcuugccuccacccccaacccuaacacacacacaagaauguuggcccuaagaggggcagcuguuuacuuucucacucaaucuccacuaucuaaaacaguguguagaacucaacaaauauuuguugaaugaauaaugaaugaacauuuugauaucuuauauaagcaguauaauaguaugguacaggauuauuaucuccaucugacuggugcguugauauaucucagguaguuccaaaugugggagaaggcaaaaagagaguauuauuuacuguuacuuccccaaguccuaccuauaauuuuuuacuuuuuucagaaagaaacauuuaaaaggggcuuaaaaacagaagccauauuugugucuugggugaggguaagacaagaugguggauccccucgccauuacuacugagacccauggcuuauaaacuauccuacuuauaauuuuuuauuuuuauguauuuacuuuuugagacagagucuuguuccaucaccuguugaggcucacugaagccucgaccucccaagcucaagugauccucccaccucugccucuccaguagcugggacuacagguguguaccaccacacccagcuaauuuuuaaacuuuuuuuuggaaucuuacuauguugcccaggcuggucuugaacuccuaggcucaaacaguucucccgacuuggccucccaaaguucugggauuacagguuuaagcaacuguccucagccaucaccuauaauuuuuuaaaugaacauaaucaacaugugccauaacaaagacugucccauuuuaaugucuuuuccugacucaguauaaaacuaccacuggagaauuuguuuuuauuuguaaauguguaacuuuacauauaaaguaaauugccacucaaauuauuccauaaauuuugacuuuuuuucucaucagaaguaguucaaucuuaaauuuuaugaaauuuauauucaagaauuucuuugcauagauugucauaaaauguuuuccauuagaaugauauuuuacuuguaguaagauaauaaagaguucucugagcuauucagauguuuacuuuggaauaaaauacuguuaaaucuagauuaccagcaguuaccuuuuuaguuuguagaaaauuggaauacaggucuaaacuuuacaaaaaaaaaaaaaaacucuuaauuuuuuaaggacaaaacauagcuaacuccuuuucacuccaaguuacugggcuuuuugcaggacuugguguuuuaaucuguaccuugggauuuuacaugauuuuuguccccaccaguugagauuuggugauagaguauuugaaguauaauugcuucuugauuguagaacaaaugcaauacaaccugaauucagucuuuucuuuucuguuucauuguauacaagaauuuuaccuauugcuauuuagaauagaaugugaaucuuacaucgaugacacuaaggaauauuuggauuacuuagacaaguuuuuucuuuuaauguaaguuaauuuuguaaugcuugugcugcaaguaauacaggaaauauguucuuuguuuuauacuugauuagguaguucagcuacaggaauggaugauuaaaagcaucaauaauaauacugcuauauguguagaaggaaaauugauguaaguauacuauuucauuauucuuuuaauaaaacuuuaguuauguguaagcacuuaagaguuaaugcaugagaaauagcauccuccacaaagcaaagaccuaacaagguuaugaacugaaggcaaaaaaguaaaauuacugugcagguccuagccauguugauugcuaccagcuuucuuguuuuugcauguuuacucaaguuuuucuuaaaauaaugacaguucaaauuuguauagugguuuauuuuuuucugaggugcuaauaaguggacugguauuaucugcuuaauuauauaugaucaguuaauauuuacuacaugcauuucaguccagauucucacaucuaaauugggacaaccagauauaaauuacugauccagaaaaggaaucaaaauuacuuaaaacuuugccauacggcuacauauuaaguaaucauuggcacuuucugguucucccuaaagugagagcaucaccagguaagugggcuuuaccuaauucugcuacucuauuagcaccauuuccuauucuucaagaccaguuucuuagugcuacaaauauuuguaauaaaagguuauaacuguucuccagccugggugacagagcgagacucugucucaaaaaaaaaaaaaaaaaaaguuauaacuguuuaagguacucauauguaaguuuauaagugaauguguaaaaucuguauuguccauucuuuaucugucugcuuuaugcccauuuccuuacuauuaaagaugcaguguagauugccuuuguuggaauuccauugcugcugccuacuaucuguauuaccuggacaaguuauuuauccccugucagucucaguuucuucauuugugcaauauggauaaugguauuacuuaccuaguuaguugugcugaggauuaaaugaaaggcuagagaacagugcuuuuugaguguuauuuaaaaguuucuuaaauaaguaaauaaagcaaaagagaauugaagagaaguaauacuguauuaagguauaaugugugaguuuaaucccaguugaccaaagaaaaguaacuugauuuccuuauucgucaugcuuaucaucaguauguuuauuauuauuaguuaucugaugaaugggacaguguucaucauuuaucuaauacaucuucauauuuuuuucuauuucauauucuuuaaagaaauauaaagaauagauuuaugggucagugauuugauacaguaauuucuuuuuuccccacuuaaaccucauuugguaccuuccaaaaugaaagguaaaaacauuuggcuguauagccagggugaaaaaacaccagauuagcuggauccaaucuacuuucugcauaaaagcuaacacaguauagacccugaaggagaggaacagggagaucauucuuuggaagcuuagcaucaguuaagcugaagcugcaaguauuuauugccagcaucagauacugagacaaggccucugcucccuuacuaauaauauuuuguaggagggacaugguuuggccacaguauaguuuuuuugguacauaaucugaggauuacaauagccaagcaguugaguucugcuguaauguuuggccuucaaauauuuuguaauuagacuaauaacauucuuaguguugcuguagcuaaaguguaaaauuauuuucuguuagaaauuucuauaugaauauuuugaccuuaccaaaacuauuuuuuuuuccuagagacgucacuaacauauauuggcacaguaauguaauuauagagcggauugagcacaacaaacuuaggacuauaucaggcaacguuuauauauuaaaaggcaugauagaccaaauuuccaugaaagaagcagguaaaugacugucauuauugauaaguuauuuuaagaaguaaagcaguuaaccauguuucucacaguaauacacauuuuuuuaacuuuuaauuagguauuuuuaaauuaugaauaaaucaaaacaacugauauuauauaaaacugguaauuuuuuuucugauuuuuaucacucuuauugacaauuucuaauaaguuauguguuuuuguuuuuuuuuuuuuuuuuggaaauggagucuugcucugucacccaggcuggagugcaguggcacgaucucggcucacugcaaccuccaucuccgggguucaagugauuguccugccucagccuccugaguagccgggacuaaggugccugccaccacacccaacuaauuuuuguauuuuuaguagagacgggguuucaccaggcugguccugugcaugaccacuuccaacauggcacaaaaaaaugaugcaauagcaacugcagguagcuguggauaaauaagccuggaacaacaucgugguuuccuguggccaguccuuuucaugcacaggauccacauaugcccccagggaauggauacagaaguguuaagaggcuugggguuguuuuuuuuuuuuuuuggagauggagucuugcucuguugcccaggcuggaguguaguggcgugaucucagcucacugcaaccuccaccuccuaaguucaagcgauuauucaugccucagccucccgaguagcugggacuacaggagugugccacagugcacagcugauuuuugagacagggugucaccauguuggccaggcuggucuugaacuugugaccucaugugaucugcccaccucagccucccaaaguguugggauuacuggcaugagccacugugcccagccuaauuugugugaguuuuaaaauaucaaaugaaauacuccuuauuuacaaggaauuauguuauaagaauaucauuuaacucccugauuccucucuuuguugaacccaccuggcaccaccccaguccugguguaaccuaauuuuccaccuaugccuugcacacagcugaauauaacuggagaaaaacacauccaaguagucuaaauuuauguuuacuagcaacaaguuacagucccuuagugguuucuuggugcugcuugguauccuaccauauuucccuaauucauucacucucccaaccuuccugaugacuccuucauauuuugacaaaucuccaauaccuccuccuuuuuacccucucucagaugggcaaaguaggggagagggcagagcaccugagcaagaggaacaaucaggauauuucuuuaccacaucuacucaccugcuuggauuaacaccugcuuuuauuauggaugaacuagcacguuacugucuaugucagccucuccauuuguacacuagcucucauuuucucuuuuacucaaggauguuauuccaguaacacucccuucuccuuuuuuuuuuuauuucucuuuuaaccacauuucuccuuuuagccaguauugcucucauuuauagcaaaacaauucauauaguuuguuuacauuuacuucuguaaaucuaauuucucuugaauuuucuuuuuuuuuuucuugaauucucuuuaaccuccaguucuucaccaaaacaaccuguaucaaagucaccaguggccuccacauugcuacauucaguauacacuuugaacagaguuaaucauacuuaccuuuuugaaauacuuuacuuagcuucucuaauaccauauuccaauuuuuaugcugccugacugccucuuccuucuuaguuucuuuguguauuucuccauuuuuucuaauaaugggguagcuuggggcucuuucuuuuaauacacugcgugguaugcugauuccuuuuagucauuaaauauaauuuauaugaugaugaaugccaauuuuauaucucaaaccaagaccucuccccuuaguacccaauucauuuuccaccugcuuauuugacaucuccacuaggaugucuguaggcauuucaaacuuaauaaaucuaaaaccugaucuucucccuuaaauuugcuuaaccuauauucuuccccaucuuuccauguguccaguagccagaauucuuggaggcauccuuaaauucucaguuucucucauacccacaucagugugugugugucaguacauccuauuaauauaucuccaaaauauaucccaaacucagaccucugcagcaucacuguaguccagacuuuccucauaauuuguuuguaucauuacaguggccuccuaacuggucucauucuuucuucccuugcucuuccacagguucuucucaaaauagcaguuugcuuuagcaguccaguuaaaguaaauuagauccuguagcuccucugcuuggaaucuuuccauagcuucucaucuuguccaaaguaaauggucaguucuauaaaaugacucuaaggccuuauauuauaaucucucaugcuuccuacugccucuguuacccaucugaguggccucccaaguucuaacccccuccucaugccacuucaaguauacuggacuccuaauuguuucaaacaggccagguauacucuugccuuucccuuuauguuuuguuuccaguauucuaacccaauauugccacauagcucaaucacuuuguucaaaugaugcuauuucauugaagacuucccugauuauccuuuuuuaaauugcuguucaccccuuuacucccccauggacauaucgauacaccuguccaccgucccugcauagccaucuaacaaacaagauauuguacuuauugguuagcuacuuuuuuccacauuagaagccaaguuccaugaggauaggaguuuuugucugcuuuguuuacugccgaauucugaauaucuauaauaguaccuggcacauauuaagcaauaggugcauauuucuugaaugauguaaugaauuaaugauaucuguuuaaaauucuaggcuuuuaaauacuuuuuguuguuguuuauccuuaaauaggauauccaaauuaucucauaaggaaauuuauguuuggauuuccagaaaauuggaaagagcacauugauaauuuucuggaacaauuaagguaaaauguuguuuuauguuuuuagaagucaacuuuauugagauauaauuuacauuuaauuaugugugugccaccauguccagcuaauuuuuguauuuuuaauagagaugggguuucgucauguuggccagacuggucucgaacuccuggcuacaagugauccgccugucucagccucccaaaguguugggauuacaggcaugagccacugugccuggccugagguacaauuuacauuuaauuaagugcaccuguuuuagguauuuguuugaaaugccaguuuuuuuguuguuguuuuuuuuuuuuuuuuuuuuuugagauggaaucuggcucugucgcccaggcuggagugcaguggcgcgaucucagcucauugcaagcuccgccucugggguucacgccauucuccugccucagccucccgaguagcugggacuacaggcgcccgccaccacaccuggcuaauuuuuuuguauuuuuaguagagacaggguuucaccauguuagccaggauggucucgaucuccugaccuccugauccacccaccuuggccucccaaagugcugggauuauaggcgugagacaccgcgcccgccugaaaugccaguuuuggaguuugcuuuggucugugaagcauuucagaagcaauaacauuuuacuagaacuucuguuguauuuaguaaaucucaaaggaaaauaaaacuuuugacauaugucaaagaguaauucuaaucauuuacccuucagaaggcaugcaguuauuaaauacuaaugugcaguucuuccuccuuuuuuuuucauucauuuucucaguaguuauggagugucugcuacuuuacagacacuauaguugaugcuggugaaagacagaagaauuugauuuauucuugcccuuguggagcucauaggggauacggacuuuaaacuuaaucacagcacaaauauaauaacugguaacgggggcuggcaguuuuuuucuguaaagggcauauucuguaaagauaauauucuugcaggcauauugccccuauugcagcuauucaacucugccuuuguagcagaagagcagccguagauaauauauacaugaauuagcauggcaguguuuuaauaaacuucauuuacaaaaacaggcaacuggcaguuguccuguaguuuuccuauaauaucaguuuaaguaggaauuauaagagcauauaguaggaagcaguuuggagaucauauuugaguccucugacuuaagauguuacaccucaguucuuugugaaggaagggagugaaagccaugaaggauuaauaauguaagauuaaagauacccugccuggguggaaagagcuuuaugugagggguuuuuauuuauuuaugaagauuuuuuuuguuuuguuuuuuugagaaucaguauuaaggaaaaauaaaauaauuguuuuuaaagggcuggugaaaagaacagggaaaagaccaaacaaaaacagaaaacuggaagaucuguccgugacauaaggaaaucaaugaaaaaugaugcacgagaaaaccaaacagauacugcucaaagagccaccaccacuuacgauuuugauugugauaauuuggguauguuuugucuuuacuucucuguugguacagugguuaaguucuuacauggucuacauuguuuaugguuuauaauguguauaguaguaauguguauaguauaguauucuuugacuuauacugcccccacauuccugcuucuucacuacuauaugagaaguaacuauaauacagauuaaucauggucaggauucagcuugcuucaucaaauaccaccuuugccugggcccagugacuuaugccuguaaucccagcacuuugggaggcugaagcgcaaggaucgcuugagcucaagaguuugagaccagccuggauaacaugacgagacccugucucuacuaaaagucaaaaaaauuagccacacaugguagugcaugcuuguguucccaucuucuugagaggcuaaggugggaggaucgcuugagcucagaugguugaggcuguaaugaaccauguuugugcuacaacacuccaguuugggcaucagagugaggcacugucucaaaaaauaauaauaauaauaauuaccuuuuuauuaaucagaauaccaaagaacacugguaaacaaauuaaugaaagaugauuguucuuuuaauuuccuugacccaaaguauuuaagcugccaaccuaccgcaaaccuguuguaaagacauauauuauuuuuguacuaaauuucauuccuacggauaggcaaaaucuguuuccuuucauggaagaaauggaauucaagaaaaugcuuuucuugaaugaccauugcuguaacgacagauugcagaacuguucuuuuuuuccucucucuuuuuuaauaaggagaccaacuugccagagcagaacuguucuguaucagcucuuugccaacacuauaaucugcuucacuuguauaaaaauguaugaacauuaacuuacagcucuuucuaaacaauauagaugaguaaaaguuacuaaaauauguuguaaacauuucugcugauuuugccuuaaacuuguaacuaagagcuuuacagaacuuccaaaacuugaaagaguucaggaauccuucugccaaaaacauagcaccauacuggauauaaauguaccuguauccuauucuaaccacuccccaacccgcauuugaacuuccacccuugaaacuuugcuuauccuuucuaaugcagagaaaggaauacguuaaauauguagaugacugcuuccccagagcuagcaaaaagucacuuaccauugcccuaguuccuucucaacccuuccucuuuuuaucaaaagucauccuauuuucucuaaauuaggcauauugccuauuuuuauugcuggagcaucuugaguaugcuggaaccuuggggcuucggcaccugcucucuacuuuuuuacuccuaaaacaagaaaauccuugacaguauaucucacuuuuaaucauuuguuggucuuuagucuugguucuuaccucuuccuguaccccauuucacuuagagccagcacuuauuagggauuugaucuuaauugcaaauauuaucaguaaaguguuuaagaaagcuauugacaagagaaaugaauacaaauuuaaaagacuaaaguuugguaaacuauuuuacauaccagcuguguccauaggaaaaucacucagcaauuuuuuuuuuuuuuuugagacagggucuugcucugucucccaggcuggaauauaguggugcaaucauggcucacugcagccucaaccuccuugguucaagcaauccucccaccucagccuccaaaguagcugggacuacaggcauacaguacugcacuuggcuuguuuuuuauuucuuguagagaugggauccuacuauguugccaggcuggucuccuacuccuggccucaagcaguccucccaccuuggccucccaaagugcugggauuauagacaugaaacauggcaccuggugucaacauuuuuaaagugcuuuccaugaacccuggucuauuaaguuuuaggaacuuagagaugaauaaggcaugauuccccccacccccacccccagggaucuugguuuaggggcaaauauuaauauauucuguuaugauugcaucauuuuucuaguguaauucauuagaucuuuucuuaaugaaacuguuagacacuaucuucauaucacguaaguuauuuugaguggugguuggggcuguuauuaauuuuauuauuaucauugcacuuugcaugaaaaaaacaaaaccacaucuaacauuauauagcuaagguuauguaaagguaccaacccauguuaauuuaagauaauguaauuuuauguauguguuuuaaugauuugccuaaaaaguacuuguguaucauaguauugcucuuaaagcacuuuaucucuguuauuacacuuaccagaguauaugauaaaugaccuaucauaauagaagcuuccuucauuauaugguaauauuuucaagagcaaggacuagucaguacaucuuuaaagaauagcuucuagaaaaauaacaaaauguuuuuauacuuuuuaugaaucuguuuuaacuuaccuagaauuccagcuuaguaacuguuuguugagcauauauuauauacuguauaauuuaguuuugcucaaaauuuuaauuacagaaauuuaguuauacauuggaguacauaaacuaguugaaacauaauucuacauacaugaagaaauagaagaagaacaguuauuagcuuucuauuuaguugaugugcaguuaggaugaacaggaauuuuuauuuacaaaauggauuaaccuuacuauucugucuuuagaugugacaaaggagauccaaaacagauggucgugaauaauauggcugucuaggcuuuuuaaauuuuuuuugaaggaaaaaaagugauucaaacaaaauguagcguagcgcuauacagagugauucuuuccaaauaaaauugcuuuauauccuagucaaauuauaacaaauauuuaugacagagggauuagacagauuaucauuauuauuucugagacaggguguugcucugucacccaggcuggaguacaguggcacaaucacggcucacugcagccucgaccucccuggcucaagugauccucccaccucaggcucccaaguaucugggaccauaggcuugcaccaaccuuuuauucuuuguagaaucaguguaucacuauuuugccuaggcuagucuugaacuccugggcucaagcaauccuccucccucggccucccagagugcugggauuacaggcgugagccaccacaccuagcgucaaaguuaauucuucauguagaaaagcagcuucucuuuuauauaaccauuuauugaaaucuccaucuuuguauucauagaacugaagaguaauaagcacagugagucaccaggagcuacagaauuaaacaugugccacaguaauugccaaaauaaaccaacauuaagguucccagaugaccaaguaaauaauacuauucaaaauggaggaggagaugacuuaucuaaucagguaaggcuuuauuguacacuguauaguucaaguugauauuuagaagggugauuuacuacugaaaagguuugggaccauaucagggacgugaguucuguuuuuuuuuuuuuuuucuuuugagauggagucucccucuauugcccaggcuggagugcaguggcgugaucucggcuuauugcacccucugccuccuggguucaagugauucuccugccucaaccuccaccuccuggguucgagugauucuccugccucagcuucccgaguagcugggacuacaggcaugcaccaccacgccuggcuaauuuuuguauuuuuaguaguaacgggguuucaccauauuggccaggcuggucucgaacuccugaccuugugauucacccaccucugccucccaaagugcugggauuacagucgugagccacugcgcccagccaagaguucuguuuuucaaguaucagcuuuucauuuacuuggggacugaaugucuugauauuuauuuucccugucucucaaugaaaaaaugcaggcaacaauaaaaguuuuagcuuuuagaguaaagcuuaaauaaagcauauuuuuaaaagcacuugaaaaaccacaaaguauuaaauuaauguagaaaauauguaggauaauggauucccagauguugcucguagugcucaaggucuggcaaguaaguuucggaauguguccacuaaugaaauuugcggaacuguaaguaccuagaaauuuguaugcuugaugcauacuaugaaaaugcuucagaucauguuuugguaguaguuuuaaaauaaaaccuagguaucuuuuuguuuugaaggaauuaauuggaaaaaaagaauauaaaaugucuucaaagaaacuaaaaauuggugaaagaacaaaugaaaggauaauaaaaagucagaagcaagguaauauaucuuuaaugguuuuuuaaucauaagcagaaagcuacuaugugaaauguuuuuaauaugauaaaagugaucuuguaaauuuccucauguaaaauggcaaauuauuuaauguuuuuaaauguuugguuuuguuauuuuuacauaagaugauuuucauaauaaaauagcccuuuuaaaaaccaccuauacuuacagguuugccuucuuuaaucuggguacuaaaauauuuguuuagaucacaaaacuauauaucauuuaacauaugcuuacaggaauguguaaagagugaauccuuuuaugaauuuaguacaauaauuuaguuuuaaguguggauuuucagagugauuuaauuggaauccugcaugccauaauuuagaggcuuucgucuaaauguuagcaaguuuacaauuucauguugagcuaaauccauuagcuuuauagcauuuuuuuguguuuuauuuccucuuauaagugaaaagaagugaaagugaagaacauuuauuuguuugaagaagauaggaaagcagugcuacuuauacuuccgaguucauauucgguuuaaguauccaagauagcuggaucuuuauuaaauaauuuauuaaaauuaacaaauacucugaauggaaauauuguucaaaauuauaauguugaaaauuuucaaauucccagguaaacauuugaauuggauuuauaugaggaguuagaagaaaauacuuuucucauaauuugaagauauaugaugccaguggaaaaucuuguagacacuuucuaaauuauuuugauuauuaccuuuuuccacggauuguaauuuagaggcuucuuuucuccccagcauucaauauuaucuaucagucucauucugucagucaucuuguaaacaauggcacauaauauguggaggugguuguaauauguuucuaugacagugggaugauuugcaguuuauauguauuucuaauuacaguuggauaguuucaguuaguuugacuucucauuacuuagguuuugaauuggugaauuguucucauuuuaauuugcuuucuuuagugacaagauauaagauucucagguuguucucuuuugcuuguuuuguacuucaugguguuuggggggauucauuuugaguguguuucuaugaccaccauuggcaaugaaaguggaaccaugcagauggaguuccauguccuccuaacuagcacagcucauauaauacuuaguaagguuucagugacuacugguuuucuuauaucuucugaauauuuuaccuccagggcuuugauuuaacaaguauuuacuuauugccuacuguauaugugaaaggcucuguacuaacuccagcaaaaaaaaaaaucaaaccauacagauaaaguucuaaccauuaauuauuuuuuccagucugauugaaagacaagugugcaauuauaauacaugucucacugucaaacauggcauuauuuaaaguauucuggaaacuugaaggagagcuuucauucaguguagggaauguguacaaguuuguacacuagguggguuagagaauaaaaucgaagcagguagugauuuuguuuauagaugaaugaagaacaucuucaaagcagaguggacaacauuauuaaaaguggagaaccaagaaaaucugagaaauagcaaguggugugguucugaacauagaauauaguugagauuuugacaacagugagagauuggaacuauguggaaggccaggcagaggagcuuauuuauaugucuacuaaaagacugugagaagucacugucagguuuguauaaacaauaguauauguuuacaguugaaggggcaguggucugaauagaccugggcuucagaaagauuaauaugacagguggguauacaguguagcucguggauaaaaauaguaucuuuuauuugugaaaauauauuuucugugcuuauauuuguuuauagcuaauuugagauuuuggucuuugguuuugucuuaugaaauuaaagagacaacugaagaauuggauguauccauugauauucuaaccucaagggaacaguuuuucucagaugaagaaagaaaauacauggccaucaaucagaagaaagcuuauauuuuaguaacaccacuuaaaucuagaaaagugauagagcaaagaugcaugagguauaaucuguccgcuggcaccaucaaagcaguaacagauuuuguaauaccagagugucaaaaaaaaagucccaucagcaaguccauggggacuuuagaaaauacauuugaaggucauaaaaguaaaaacaaggaagauugcgaugaacgugacuuacuuacugucaaccggaaaauaaaaauaucuaaccuugaaaaggaacaaaugcucaccucugacuuuaagaaaaauaccagacuauuaccaaaauugaagaaaauagaaaaucagguagcuaugucauuuuauaagcaucaguccucaccagauuugucaagugaagaaagugaaacagaaaaggaaauuaaaaggaaagcugaaguuaagaaaaccaaagcaggaaacaccaaagaagcagugguucaccugagaaagagcacaagaaacacaaguaauauuccagugauuuuggaaccugaaacugaagaaagugaaaaugaauuuuauaucaaacaaaagaaagcuagaccuuccgucaaagaaacucuucagaagucugguguuaggaaagaguuuccaauuacugaggcaguaggaucugauaagacaaauaggcaucccuuagaaugcuuaccugguuuaauucaggauaaggaauggaaugagaaggaguuacagaaacuucauugguaaguaguuagauuucauuccgaaauaucuacagagcagccacaagacaguuaaagacauaaaaauagcaauaagggguuaacauggaagaugucauuaaaaaaaagggagaaauuauaauuugcacagggaauggagauagacuacacauaacuccuagugguauuuuuguggucaucucuaauacgaggaaaguacgaggaaagccuaaguaugaggaaaguaaaagugaccuuuucauucccauguaauauuucaagauagccaaauaguacucucucacguagcuucauauuuuaagaaaugcauuuuuuuguuuuuuguuuuguuuuguuuugauugagacggagucucgcccugcugccccgucuggagugcaaugccacaaucccgguuacugcaaccucugccucccggguucaagcgauucuccugccucagccuccugaguagcugggacuacaggcgcacgcugccacgccuggcuaauuuuuauauuuuuaguagagaugagguuucaccauguuggucaggcuggucuugaacuccugaccuaaugauccgcccaccuuggcuucccaaagugcugggauuauaggcauaagccaccgugcccggccuaacaaguguuauaaauaguaaaguuuggugccccacaagugagacucaaggauacuagaaaccuagaagugggcacugaaggguaacaaagagaguuuaaagaggagcucuccaguucuggguugaggagcagaaagggggacuucugacacucagaaacaguagaggaaauccccaguguuugguuugguuuguuuuuguuuuguuuuguuuuguuuuguuuuguuuuugucuuuucucuuaacucaguccccaugcaauccugcaggggcuacagucacagcaucagcuggggcugagauauaucuaaaacucugagagaugagaaccuucucuacaauuaggaaugguugccucaaaguaguggggcaaguaccuguugcuucuguucucuuucuguugucuguugcuugguacuggacaaaaauucaguugugugaggcauacagcagagcagaguaauaaaagccccagcuuucuggccagagcacugacaagggaaacuccagggaaccagaaaucgcggaaagagaggaaguaggaaaagcaaccccauaaaguuguuuaugaacuucuaugccacccaggaguuguacauauguggacaugguccuaaagagcauauaaaagacugagaacugaacuaaacaguagaccacacccaguuucuaggcuagcuacucagugucccacacacaggaagauccuaacagcacugcagagcuuugaaaaaugaaacugacauugaaacaacaaugauaguagacugaacguauagcuugggauaccaccagguugaugaccugcuaaaauaaaaauauuaacauuucacuugaagcaguaaaauauugauucuaaguagacuguugaaguuaaguauauuuaaugucaucccuagagcaacuucuaaaaaaacuauacaaagaaauaauuucaaacauaaauuaaaauacuggaaaaucaaauagcccaaaagaaggcaaagaagaagagaaguggaggauuuuuuuacauggaacaagcagaaaacaaauaauaaaauuauugaccuaaauccaacauaauuaaauuaaauggucuaaacauaccaauuaaaagacauauugucagaaugaauuuaaaaacaugaucuaacuauaugcuguauacaacaaacucacuuuaaauauaaugauauagguagguuaaaaggauagaaaaauaccgucuaaacacaaaucaaaagaaagcuugaguggcuauauuaauaucugucaaaauagacuuuaguaggaagaaaauaaccaggaauaaagaaagacauuacaaaugauagaagggucagucaccaggaaggcaugaaauuccuaaguguguaugcaccugacaauaaaaccucaaaauacaugaguuaaaaacugacaagugaaagcagcggacuaaacuacaaggauagucaaauccacaguuauaggaaaccacacugcuccucucuugguauuugauagaacugacugaaaauuagcagggauauagaacugaacaacaccaucagucauucguaugauucacauuuacagaacauuccacccaauaauaagaaaaagaauagguuauuuccaaggauagguugaucauucaucaagauagaucauaaaaccucuuaacagauuuaaaauagcugaaaucauacaaagcauauucucugaugauaauugaauuaaacuacaaaucaauaaaauaaagauaggaaaauuuccaagugguugaaaauuaaauaacuuauuaauacguauaacuaaucugugggucaaagaagaagacuuaaaggaaaguagaaaauauucuuuuauuuuauuuuauuuuauuuauuuauuuuugagacggagucuugcucugucgcccaggcuggagugaaguggcgcgaucucugcucacugcaagcuccaccucccagguucacaccauucuccugccucagccucccgaguagcugggacuacaggcgcccgcgaccacgccggcuaauuuuuuguauuuucaguagagacgggguuucaccguguuagccaggauggucucgaucuccugaccucgugauccucccgccuuggccucccaaagugcugggauuacaggcuugagccaccgcgcccggcuucuuuuauuuuuuuucuuuuuggagacagagucucacucugucacccaggcuagagugcagugguacgaucucagcucacugcaaccuccgccuccuggguuuaagcaauucuccugccucagccucccaaguagcugggauuacaggugugugccaccauauccagcuaguuuuuguauuuuuaguggaguuaagguuucaccauguuggccaggcuggucucgaacuccugaccucaagugauucaccugccuuggccucccaaaaugcuaggauuacaggugugagccaccagcccggccagauauucuuaacugaacaaaaaugaaaauauaucaaaauuugcagcaugggccuaggaguucauaaacaacuuuaaaggguugcuaugccaagcuccucccucucccugauuucugucguacuuucuacauaaacaaauuagggugcauucuuucaguggauuacuaagcaguaaaaaggaagaacuauugauacauacaacaaccugguugaauuucaaaggcauauugagugaaaaaagccaacucaaaggguuauacacuauaugauuccauuuauaugacauucuggaaaagugugcuacacacuuuuaaaugaccagauuucaugagaacuccaucagaaggaugguaccaagagggauguugcuaaaucauucaugaggaaucuaccuccguuaaccaaucaccucccccuaggccccacuuccaauacugggaauuacauuuugauaugagucuuggguagggacacauauuuaaacuauaucaauaaauaagaauuauuuaagccaaggauucaagacaaauggaccuuagaauagcauacacaaaaguauaaagaaagagggcauauuuggaaauacugaaagaaugggugugggguaugugccuguagugccaaccacuaaggaggcggagucagggggaucgccugagcccagaaguuggaggccacauugagcuaugauaaugcccggcacuccugcaugggugacagauugagacccugucucuuuaaaaaaaaaagaaagguaaauaaagaaagcuagaaugaauggaauacugaaaguugaccaaagagcaguacaagaugagacuagagaguugggcaaggaacaauacagcguuacacuaaggauuugggguuuuaugcuaauaaugaaacaaguuuuaaacauggugugauauguuuaaguuugucuuuuuaaauuaucuggaauaaccuagaggagauguguuaaguacuaauuucuuauuaaauacauuauuauuuguguuauguaauaguuauuuuagacagucguagauuuagaaauuagccacacacacaaauagagaagcuugaguucccaaguccuucuaguuguucacuuuagaacacuguggaaugauuaauuauguaaaagaauucauuaacaaguauuuaaugcucauaaguauuaugcuuuucugcauggaauaauaugcuguggucagcugguagcuguucacaagagcugauuguuaaauuuuggagaauuuuacaaauugaguguuaaagucauuaaaaaauuauauaaacuuaaauuauuuaaaacaaagauaaugcuuaaaacucauuacuuccuaauuauuuuccauuuuauuauauauauaugcucuugagacucuucaccucugugguaugguggaaauacuauguaauugugugcuaucacacguguuuuaucaacuccacagucagugacauguugguagcuugacaucaacuacaaugggaguauuuacccuaugaaagucaucagacuuuauaaaucaggacuguuuaaccccgagagaacugauuaaaaacuuucccacauacugcuacaugaaaccuauaucuauuaauuggaauccaaguagaaauaaaaauauuuugccaaagaaacagauuaaaaauaaagacuugguguaguugaaaugacauuguuaauaucacuuuuaggcuaauugaugaguuacauagauguuuucuggcuaaauugucaaucuaaccacaaugcaugaaaucuuuauggggagagugggggugguaauguguauaccagguucuaaaucauuuacaaaggaacuuguagaaugcaacucagauguuaaauuagggacuuccuuauaguuuucucuauuucaauuuucauuuuccuuaauuaagagagcauauaucuaaaauacugaguucuacaaaguauaguagaaugaaagcaagcauaacacuuuuuaauagcuuauaaccuagacuguauaagagaacuaagagcuuauuguccaauauacuuagcaccaauaagauuuaagguaacagugaagaaaauuuggucaugccaaaaucuccuaaaaaaccguaucaucgauuaguuggacuuagaaaaaaaaauguugaaaggcugagggucauuuuucaggcuuaauaaaacacaucagaauaguuagaagacaucuacuagauagguaaaauuacaucuucauauuuuaagcacuagaguuaaguuauugaggggaaggaauaauaucuuucuuaauuguuauccagaaugauuuugauaaaacugauuccuucaucucaguaaaucucaucaauucaguguuaugcuuuuaagagguuauugucauugguuugaauuucuuauucuuuaauugguuuugaucuuccauagugcuuuugcaucucuuccaaagcacaaaccugguuucuggucagagguagcugcggcuguagguucucgaucuccugaagaaugccagaggaaauacauggaaaaucccagaggaaaaggaucccagaaacaugucacuaagaagaagccagccaauuccaaaggccaaaaugguaaccuucguaguaaauaguuuuuuuccuaguacucaguguugauuucugaucacugaaaucagauauauuuuauauuuauccaugaauauuaauagguauuuucuuaaaauuuuaaagcuagagagaauuucagaaaucaucuguuuaauuuuuaagucuuaccugggucucugcuuccaucaguaguaguuuaguagccuugugcuucgaguuuuaggaauucugcaguuagauccagagauuucaauaucugaauuauuguucuaaggguuuaauuaaagaccacuugggucagauccccaaguaauuuaugagaaagcucagaaaauauucaguuuucauagucccaugauuacauacuccuguucaugaguacuaguaaaagguugauuaugccagagaauuucuauaauaagcauuagcgagaacccaauacccugucauaauucaguaagguuuauauauuuuggcaaaaucaauaaauuaggcauucagcaagaggcaauguagaggcagucauucuugcaguguaaagaucuuuuuggccaggcacgguggcucaugccuguaaucccagcacuuugggaggcugagguggaccgauuacuugagcucacaaguucgagaccagccuggacaacauggugaaaccccaucucuacaaaaaaaaaaagagaagaucuuuuuaaccucacccugccuaaucuuagccucuucaugaguauccuaugggcuaaucauauugcacaaaucccagaucccaguguagaaauaaucauuuguucuauaggagacuuguaaaauaacaggcuaaguuuucuuucuuuuuuugcuuuaucuauaucuguauuuuuuuagagauggggucucacuauauugcccaggcaguucuugaacuccugggcucaagcauuccuccugccuuggccucccgaagugcuggguuacagggaugagccacugagccuggccaaggcugaguuuuuugguuuuuuuuuaacaugaaugcacaauuuagacuuugcaaagguuguuaacuuuauagagcaguuacuauaaauaaccaaauccuuaucaaaaugguuugcugacucuuaaggcaagagaggugaugcugaucagaaacaaacuauuaagauaacugccaaagugggaacucuuaaaaggaagcaacagaugagggaauuucuggaacaguugccaaaagaugaccaugaugauuuuuucaguacaacaccuuuacagcaucaaagaauacugguaagaggcaugaaaucauuguuuuccuuaucuguauugacuuuuguaucuuucauuuuuauguaugguaguguucaucacuaauauuuaggccaaggaucaguagccuccguagacaugaucauagucuuauggcaaacaaugugcugauauaugccauucuuacuaguuucuagagucugcacuucaguugguucaaagguaauguuuguagaaccaaacaguaaaguaaaccuagaauuaggugaaacauauauauuuaaaguuuaauauacuaccuagcaaacuuuuuuuaaaguugauaaaagauacuguguaguaauugaaaggagggauuaagugauaguagcacaguauuaaaagauuugaauguaugaaagaauuuuugucauaugaagaguagaauaacuaaaaauuucagugauuggaguaaaauauucacagcaaauacaaccaagcuaguaguaucugugauaugaacaacucauucaaauguuacuggaauaacaaaaaguaccaagaucacaggaaaagugugaauaagaagaaauucaaaaggcugaauaaacacuuggggaaguggucauuuuaguuaguaauccaagaaaguaaaguaaauuauauuuauguacuuucugaauuauagaaucuuuuaaaaaaauaaguuaaaauauccacugcuaacagaagcaauggugauacugauacagucauacaucagugggcauacaaauugaauuguaccuuuuaguaagaaagcauuauggcaauauauuauaaaagccauaaagauuuauucuauucuugagaguuuauccuaagaaauccaaaagcccaaaaucuuugcaagauacuuauugcaguuuuaucuucauagcaaaaaacuggaaacaaucuguauauccaauaaagauguuuuucauaaacacagugaaauacaauacaaauauuaaaugcacauuuaagacuuucuagaaucuaaauauaaauguuaagaauauuaagauuagcugaaggacaggugcgguggcucacaccuauaaucccagcacuuugggaggccgaggcgggcagaucacgaggucaggagaucaagaccauccuggccaacacggugaaagcucgucucuacuaaaaagacagaaaauuagcuaggcaugguggcggccgccuguagucccagcuacucgggaggcugaggcaggagaauagcaugaacccaggaggcagagcuugcagugagcugagauggugccacagcacuccagccugggccagagugugagacuccaucucaaaaaaaaaaaaagccgggugcaguggcucacaccuguaaucccaacacuuugggaggccaagaagaguggaucaugaggucaggagaucgagaccauucuggccaacauggugaaacccugucucuacuaaaaauacaaaaauuagaugggugugguggcaugcaccuauaaucccagcuacuugggaggcugaggcaggagaaucacuugaaccccauaggcagagguugcagccacugcacuccagccuggcgacagcaagacuccaucucaaaaagagaaaaaaaaauuauuaagauuaaaguaaugcagaaauguguggauaacagacaauuggacuauugaguauaaaaauucaaacaguuguguuagugagcuagacauaaggguaauuuuuucaucuaccaauuucuugucauaaaauuaucuucaauuuaaaaaggcuacacaaugcuuuauaaaguuuaauaacaucauuaacugggcccccuuuuugcuuacacugauuauagagggaagucuuuuaagagagccaccagaggcccugacaauguuuucuucaaaacgcuaugguccacuagggguuguacccuuuaucccaccaucauuucagguucuauauauguauauuuuagccuaaaugcaauaguagcaucauaaagaacagaacugccgggcaugguggcucacgccuguaaucccagcacuuugggaggccaaggugggcagaucaccugagaucaggaguuugcgaccagucuggccaacauggugaaaccccgucucuacuaaaaauacaaaaauuagcuggcaugguggugggcaccuguaaucccagcuacuggggaugcugaggugagauaaucgcuugaacccaggagugggagguugcagugagcugagaaggcaccauugcacuccagccugggcaacaagagcgaaacuccaucucaaaaaaauaaaaauguaaagaacagaacuaaaguagaaauagacagcaacaaauuauaucauuuucugugacauaguuugaagggguggccugccccuccacaccugugggcauuucucgacaggugggacgacagacugggaaaagaaagagacacagagacaaaguauagagaaacaaaagugggcccaggggaccggcacucagcauacaaggcccccugcugaggccccgggcggcgccccuggucucugaguucccucaguauuuauugaucauuaucucuaccaucucagagagggggauauggcaggacaguaggguaauaguggggagagggucagcaggaaaacauguaaacaaaggucucugugucauaaacaagguuaagaaaaggugcugugccuugaugugcacauauagugcauuaaagagcaguauugccacuagcaugucucaccuccagccuuaaggcgguuuucuccuaucucaguaaauagaacauacagucggguuuuacacugagauauucuauugcccagggacgagcaggagacagauaccuuccucuuaucucaacugcaaagaggacuuccuauuuuacuaauucuccucaaaacagacccuuuauggguguggggcugggggacaguaaggucuuucccuucccacgaggccauaucucaggcuaucacauggggagaaaccuuggacaauaccugguuuuccuaggcagaggucccuguggccuucugcaguguauugugucccuggguacuugagauuagagaauggugaugacuuuuaacaagcauacugccuucaagcacuuuuuuagcaaagcacauucugcauagcccuaaauccauuaaaccuugagucaacacagcacaugucucugugagcacaggauuggggcuaagguuacagauuaacagcaucucaaggcagaagaauuuuuuaguacagaacaaaaugaaaucucuuaugucuacuucucucugcauagacacaguaacagucugaucucucuuucuuuuccccacaaugguuaacacugcuuggguuccuacuaacggcuaagcauaauaguaagugaauuagaguuuuguuuuguucuguugauacgaagggucagauuuguuuguauauugucuauggcuacuuucaugcuacggugcagaguugaguaguuaggacagagacuggaccacaaaaccuaaaauauucccuaucugauuauuuacagaaaacauuugcugaccucuggucuacauaaccuucagaaauagguguuauuaucucuguuuuacacaagagaaauuaagucuuuuaaaggcuaaggcucuguccuuguccuuguuccuugaccuuaaaauuucuaacagacauagccuaaaccugugcaaccugcagacccccaucauucuuguuuaucuucugucagggagagccucagcaccuuagaccuauacaguguaggaugaaucccuccuguuacuggcagcaaauccauacgggucugcagaaaccacaauucuuaccuccucagaagaaacaauucuggccgggugugcuggcuuaugccuguagucccagcacuuugggaggccgagguaggaggaucccuugagccuaggagcuuaagaccagccugggcaauauagggagacuccgucuccauuuuuuguuaaauaauacuuauaaaaauuuuuuaaaaagagaauuugaccaaggaaacauaaggcagaaggagaaacugaggcaaguuuuagugcaggaaugaaaguuuauuaaaacacuuuaaagcaggaagcaaaggaaagaaaguacucucagaagagggccaagcaggugacuugaagcaugguuuaacuuugugacuugggguuuuauauguuggcaugcuucugggggucuuguguuccuucuccccggauucuaaccuuggggcgggcugucugcaugcccaguggcgugcuagcacuugggaggggagcaaguuacaguguguuuacuggauuuauacacaggcucacuugaggcuuucucccuuaccagucggauguccuuaggaggucauauaccaguuaaacuccuccauuuuuccucuuaaugcacaugcuugagcccacuugcccaguuucugagaucuuaugaggaagcugcugaucaccaauuuuagguguuucuguuuauugagagauugcuuuucccuggugcuggcugcgauuaaguauuauuuuagagacacaguuaacaaccaccugaccaucacaggauggucgccuaacaacauuccuggugggggguggggaggcccucucauuccuugcuuaucccugacuaguuaaccugcuguaacauucccacuucugcaagucaccagucaagguuagcuauuuccagcuggaggaagcuaacgguguuuauggcccaggggaguuuaggcuguagauggcuuguuuccaauuuagucagugggauggagcugggaggaauagaaaagauggaggaagagagagagagauuagggcccauacacacauuaagguuacacaccuacacugcaaacaaauggugcacugccuccaaacaaauccccaguuaagagggcuggguagaguuccaaacuccuugccucaguuucaaacggcccuccccaggggacaguccaaugugagcaaagcccugagggugccacaaauacaaaugcaaaaaaauggccaaauggugacaccaacagcuaagucuaaacagagcagagccccagcaacacccuaaaagaggcagagggaggcugggugcacaucagcagcucaccugguuccaacauuugucgacuucuucaaaaugucacauucucuuuguaucagugaagcuuuggaagcagcagaugcugugacagaaauagaaaaggagguucugcaagacaaaggcaccuuggcuauugcuggaagcuccccuaauguucuuacuacagggucagcuagccaugagcagcuggcacucacagguggcuccauggcccuauccaacagaagaucagauaggugugucuggagccuccugugaauacacagggcucccuguaugggccaccaaaaauuguaaccagcaauagggguccaacuacuugccgcuuguaaaaagaagccaauauaacaagagcaaggugugauagaguuuuauuaucugugccagcaaagggaagugugggugaaauuccagaaauuccagucuucaauuuguggagugaacauaggaguuuuuaaagagagaaugauuuggaaugcaggagaggaggggguuaggagguguuagguggcucaaucugcuccaacagcuuaucuugaaauauuauuccauuuggugaaggggccagcaccauccugggcucaaccagguuacaaauuaauuguaguaaaucuugcaguaaauuucuagaugggagugaguuuuggccuugacuggggagagaauucuggagguauccaguuuaugccaggauccggccccugaagcuucuaaggaaauacaugaccagauaaaugagcauggugugcacuuaaaaagcgucuagguaaaaacaugugcauaaggcaugggagcauagaauggguaaagaaacggagguucacauuuugaggcuguauuucaagaugaauggaaacacauguaguuuaucucaaaguuauaucuuaaaauuggggagaaagaaagaaaaaaguuuuaaaacaugguuugaagccacgcuacucgguuacaggcugaauaaagagggugacaaauccaguuucucagaaacauuuaauagagacuuuugagcagaagccaucucuuggguggccucaagaugguggauuugggcacuguuauccccccagacccaggguuuauauaccauagggaauuugccuaagggcuguauuuaugguaaguauguguuuacgauaacaccaagguuguuuugaccuaaggacaagauuuccaguaaguauauggagguagaaaucuuagaggcauuuccagauccagguuuaaucagaagucagcauggugaauuagcaucuaaaauggaguuccucuagccucuacuccucuacguacuacuguuuuuaauuaucuaacuuggaaaguuacaagaagaaccaacuuaucaguccuccaaaacuauuuugugauaaugagaaaauaccuuuuauggggugccugcugauaauaaauacuuguuuucuaguugccaaguuuccaggacagugaagaugaugaugauauucugccaaauauggacaaaaauccaacaacuccaucaucaguuaucuuuccauugguaaaaacuccucaaugucagcaugucaguccuggcaugcuagguucuauaaauagguaaauauucaugcauaugauauguuaauucucugcaucagaguagugaggaacauuuaaacauuucaugaggaccauagaugccaguaaugggaagaggcauuauuuaaaaaaucaagaauguguaguuucuagaaguuaaggauggacaaguucaucaaaucggggugcuauucaauaaacagcauugugauauaacccacauuuacuucuggaucaauucgaaauggaucaagguuuuacuuguaaaaaacuuuaaaaaaaaaaaacuaaagaaaccuuggagaauuauuuuauaauaccagauuagugauggucuuucuaacuauacuauaaaaccuacaagccauuaaugaaaagaugaauaaagucaacuguguaaaaauguuuaacaaauuuuaccugguaccaaccacuacaaacaaaagacaaccugagaaaagaauauaugcaacuugucacaggcaaaaggcuaauuuccguaauauauacagcauuccuacaaacuaacaaggaaugcauuguuaauuuuugugcauugcuagugagaagguaaaguagugcgaucuuugcagcaacaauuuguaaguaucaaaauuauaaaugcacaugcccuuugacuuaggaauuuuacuuauagaauugugaauguacagcuuauucauuguagcauuguuuaaauggcaguaccucaaaaaucuaucaguagggacuaauuaaaugaacucugguccauuauauagucauagaaauuaaugaagagccaggcacaguggcugaagccuguaaucccagcacuuugggaggaucacuugagcccaggaguucaagaccagcaugggcaacauaggaagaccccauuucuacaaaaaaaacccaaaaauguuagcaggaugcaguggggcaagccuguggcccuagcuacuagggaggcugauguagaaggauugcuugagucccagagguguaggcugcagugagcugugauugcaacaauugcacuccauccugggcaacagagugagauccugucucaaaaaaaaaagaaauuaaugaagauauuuuuuauugcuauuaugauaaaaugccuaagauauauuaaaugaaacaaagguagaugcagugaauaauauacuacuguuuguguaaauagaagcuauauguauguaugcauauauguauauacuuguguguguguguguguguauaauugcuuuuauuagauuaagucuuuauaaaaggaugcauaagaaaccaaaacauuggugauccuuagggagaacuaagguagcuggaggaaggagaggggggcuuuugaauuuugaaccaugugaauacaagaacaauuugaaacauauaaauaaauaaaauuaagaaaaaaguaggggugacuaacaauaaaaugucaccaaaaaaagauggaaaauaguaagaaugaggccugaaaauaggcuauuccauuuggcaaguaagaggccauugcugaucuuagagcaauuuccacagaaugagaggcagaagcaagauaauagugacugagaaaaaaacuauucaguacucucaggaagcuugcuaaauugcuaaaauuuuaauuugcacuuauuggauaaaaauauaauuuuccuaggcaucuaaaaauuauuuuuaguauuuagugcaggggaaagcauacugagaauacuauuuuggacaaauuuuuugauaagcacuuugaccaguucaucaaaagccuuaaaauauucauccguggccgggcgcgguagcucacaccuguaaucccagcacuuugggaggcugaggccgacggaucacaaggucagaaguucgagaccagucuggccaacauagugaaaccccaucucuacuaaaaauacaaaaaauuagccggaugugguggugugugucuguaauccuagcuacucagaaggcugaggcaggagaaucaccugaacccgggaggcagagguugcagugagccgagaucacgccauugcacuccagccugggugacagugcgagacuccgucuccaaaaaaaaaaaaaaaaaaacaacuucauccuuuuggccguugaauuuuauuagacacuuuaaggaaauaugagauuuggaacacagauguucaucauaaaacauaauacugaaaguuugagaaugaccaaaacauccaaaaauaaggaaaguuauaaauuaagauuuauccauauaauggaauaugaaacaaaucaugucuucaagaauuuaaugacagaaaaauguccaguggauaguaguuuucaaaagcuaggaaaacuacauucagcaugaucccaauuuuauguaacaaauucguaaggaaggaaauuucuuaacuuacacaucaccagccauucuuucuagguuguagaaugacaccaguguggguuguggguuuuuguuuuuuguuuugggggauauuuucuguccauuuaugucacuuuuacaauuaaagaaacacgauagauucacuuauguuaugaaucuauauugucugaaacuuuuuucuuaaaaaaaugauuuucuuaggcuucuucacucucucugacuuuacuagcucuaguaauugacguacuuuucauaacaguuuuaaguaaucaaacaguuauaucacuucagaagugaaaaacucuuugucuucaaagacaucucuuugauaauagacuuaccaguugcugauccugaacaacuggcuaggccuguucauuuguuuuuuguuuguuugugagauggaguugcucagguuggagagcaguggcacaaucucggcucacuaccgccuccaucuaccagguucaagcaauucucaugccucagccucccaaguagcagggauuacaggcgcaugccaccgugccuggcuaauuuuuguauuuuuagcagagaugggguuucaccauguuggccaggcuggucuugaacuccugacuucagguaauccgccagccucagccucccaaagugcugggaucacaccuguucauuuguuaagcaauuugcuaaaaacugacgagguuuauucauugcuauacagcaguguuugauucagauaaauaucuuaauagagucacauuucuucaugucaugccuuuaagguuguucccaaauagucauaaagaacagaggauacucagguauguaagaucuuagagccaagagagaguauggaaauggauguucagcugguauuuacugucauaagugggauuaggaauuguggguuuagggaauuaaaaacaaccaacaauucuacuuggcuuuuaaucucuucaguuaugagugaagcauauuugcuuguaagggaagagauaagguaaaggaaaugaaauaaagaaaaaaaauuuggugguugguauggggaauucaagaaagauaaaauuuuguagaaauaaaaggcuugaugagcuggauuagaaacccagcacaguuggaaaaauugacaguuuucaaucaccaggcauaucuuuaaagugaauaaacugagauucaauuaggacagggaaggaagugaacaggagagauaaugguauagcaaaagggaguccaaggagaagaagucucagugggaguuuuggaaaaccaagagaggcagcaagauaccggaaagagcguagacgguacaaugaacgguaagcaaagcauaauuucccaaaauagucuugaucaguauuuccuguaaaauguuugauuuaagcauuuuguccaucuccauaggcacauuuuauuguccucuuuaaaauacagaauguacuuuuuaaagauggaaauacguuugaggucaggcgugguggcucacgacugucaucccaacacuuugggaggcccaggagggcagauugcuugaugagcucaguaguuugaaaccagccugggcaauguggugaaacccugucucuuaagaaaaauacaaagauuagccaggcaugauggcacgugccuguaguccaagcuacuugggaggcugaguugggaggaucacuugagcccaggagguugaggcugcagugagccauuaucauguuacugcacuccagccugggcgacagagugagacccuguuucaaaaaaagaaauacauuugaaauuaauuuaggcaauuguuguucaaccugugguuaaaaguaugacaguuaacuuaaaauuauuagguugacuuaaaaauauuguugacuuaaaauuauuucguauucaaacaggaaugacugugauaaauauguuuuucguaugcaaaaauaucauaaaaguaauggugguauugucuggggcaacaucaagaaaaaauuaguaaguauuuuucuuuauccaauacauaucuaugaaacaacuuuaauaugugauaaacugugguaguuguaagucauguaacagucccugucccugaggugauuauaauguaacaaguuacaauaaugaagccaugaaugagguaagcacauaaguacuguaggauuacagauggcaucacauugacugaaacauuggagcaaggggaaaauggcuaaaaacuuugauuuuugggaaaugaagggugggaaaaauauacacagaggucugggaaggauauuucaggcaaaacacaaaaacacaaaacacaaaaacaauccuguucaaggauugaagaauaauucagacugagucacaauucucauaaaguaagaaauuucaucaaauucuauguagcuuuaaaauggcuucagguguuuuucagauuuagcuacuuaauuuuauuuuuuuacuuuuuauuuuuuuacauucuaacauuuaaaauccaacuacagaaaaauuuuuaacugaaagaugccuuaauagaaugaucuauaucccuuagagaaaagauuaggacaguccuuuauccccuugaauuacuuuuuaaauuuuuaauuuucugauuuuaauugcaauaacugauuaucauauauaaguacuaggauucuggaaaaaguauuucaucucaaauuuccucuaaguagcuaaucuucgagaaugguaacuuaugggaacccccuugauucccuugcuuuaugacacugagcaaguuacuugagcuuucuaauaccauuuuauucaugugugguaugacaauggggaucaugauuauauugauuuauguuaccaaaugauuuugaggucuaaaugauauaaugcaguguuuuaccucaucucagaaaaaaauacauuuauaucacagucugugagcaugaauuuguaucucaaaaauuucuuaaaacaguacuuacucuaagggcuacuauauuuucuguucuguuacuuuuuauuuuuaaaagauuuuuaaggauugccagccauggccaauaguuugauaagcauuguaaugugugugagcauguacuucaaacuugccauuuacuuuaccauuuuagccaagaauuucaaguacagagaauuaaaauucugcugguauaaaacauuguacuguuauaauaacagacuguagguaaaaguaauacaguaauuaguauucuguauaguaauuacuauacuguaauaguacaguauaguauuguaauuauaauuacuauauauaaucaugauaaauuguguuuauauuuuaaguuuaccaaaccaguauauucauuacuuaauuacuuagcacauuuuggcaacuuuuggaggcccauagacuauccuuuaacugcuauagcauuaguuuauaauaauuucuuagaggaguguuugccagcacugggaaacaacauugaguaagucaugguucuugcccuggauaaacccaaaagagaauuaugcauuucacagauaauuauaaugugauuaaauguuguuauaggcauauguucaaaguaaucuggggauaagcaugcuuaauuuugucuagauuugagguagacuucaccaggagguaccauuuagcuauuaauaguaacucuuuuauagguugaaacugauuucucaacuccaacaccaagaaggaaaaccccauuuaacacagguaauacacuuacagcuuucuuuuguggcucaguucuauuauaagguagguucuuuauuuaaaugguauuaaaauuaauugcucucaaguggacagacuuagcauuuuauuccuuauaguuguuuucaguuuuauugaaaguacuuuuagaaauuuauuaucuuuuuauuaaacuucucuuuacagacuuaggagaaaacucugguauuggaaaacuuuucacuaaugcuguggaaucuuuagaugaagaagagaaagauuauuauuuuucgaacucugauucugcauaguaaaaugagaaaauaugauuccugggauuuuuaccauaaagcagacaguguuuguauuuucaacuggaguacauguauuuucuuuguaaaguagcuuccuaugaaaauguggacuuuuuugaagguuucauauguuuguguucaaaguaaaauauccucauugcugcagcuuacuaaaaauguaaagaaaauuguuuuugcucguguagauaucuguaaauuuguuuuugcauauuaaaauauauauagauaauuuuuuaauaagcauccaagucuguuuacuuuaagaaaaccauuucccaaacagauuuuuuuuuauuucaagaaaauuuugcuaccauuuaaguaagagaaggugagaaggaugacagagguuguauugguagcuauugaauucaugaaaacuuuuaaguuagcauuuguuagcaguuauuauccaagccagaguaggauuuguuaccaguuguuauccaaaccuaauguuuaaauuacacauuguugaaauuaaauuacacauuguugacaugcuucucuccugauuguuuuuauuuuaaacuugugauaggcauaucuaugaaaccuuuguaaauuuaguuuauugcuuuaccauuauuuuacuagguaaaauuagagaacagauuuuguucucuaauuuuuaagccuuauuuacauaugcagaaacagcuuaaauauuuugacuagauuagacaaacaguuaauagauccaccauuaggaaucaauauauuaugucauaauaaacauccuuuuucuuucacugaaauuucuuuuagaaauaaacuuauuuuugcuuguuauguuuugaaacuugacauaggauauuuucccucuggcuacacauucaccuacccuuguucucuauuuagauuauucaaauaaaguuaguuugcuuuuauagua

SEQ ID NO: 192357 - RNA, 60048 nt, Homo sapiens
guucgugcguggagcagucggggcuggaggcgaggccgccgggcgggcagggguuguggcgcggcaagcggcgggccagcgacggcgcgaauggcggacucucagcuguucuguguggcggaggaacgcagcggccacugcgccgugguggacggaaacuuccucuacgugugggggggcuacgugguaaggggaagaggcgggacgggguagacucgcgccgggagacccucggccugagcggacgcagcgcccgccacacccgcucccgaggcugcggcccaggccuggcgcgcccggcgccugcagccccccagccccuccgcuggccgccgcccccacagccgcgccagggcuugacgucgucccgccguugcuucuucuauuaaagccucagacccggcuccgggccucuuaccacucuccgccccucuuugccagcaauucaguaaccacgguuugcccaaugcaaaggcaguuacagcgcgauuaauuauuauccuuaaauacuggcgcagaccuagaaggacccgaggacgccgugcuguaucauuuuguauauauuuccuuauucccacggcgcgauucgaaauaaaauaucgaaaucacugaagcauuuaaauauuuauuuucuuuucuuuuucuuuuuuuuuuuuuuuugagauggaguuucgcucuuguugcccagggcuggagugcaauggaacgaucucagcucaccgcaaccuccgccccccgccccggguucaagcgauucuccugccucagccucccuaguagcugggcuuaccggcaugugccaucaugccuggcuaauuuuguauuuuuaauagagacaggguuucccauguuggucaggcuggucuugaacucgcgaccucaggugauccgcccgccuuggcuucccaaaaugcugggauuacaggcauuagccacugugccuggcuugcauuuuaaauauuucuaagcuauuuuuaguggcguuucuuuacuaaugacuauuuuuucuagucucaaaauagacgcauguuagcaauaauaugcuaagaaauauuaugcuuuaaaauucuuacuacaauggagguuugagcguauguguguguuguguguccauaaucacagaauuauagaagcaagaaugguaaagcuggaaaacaggaauacuauaugccaacccucuuaguuuacagauuuuuuuucuuaagccaucuggaaguucuacugauaguagaaccuacaucuucugucucccuaccauuaugugacagaccuguaacgugacugaaucauauugaaaugaccaacauacaggcauaccucgaaguauugcagaauacuucguaugacugcaauaaagcgaggucauacgaauuuuuuugguaucucagugcauauaaaagucauguuuacauuguaguguguuaagcaugcaauaguauuauguguaaaaaaaaaauguacauaccuggcugggcgcgguggcucacacccguaaucccagcacuuugggaggcugaggcggguggauuaccugaagucaggaguccgagaccagccuggccaacauggugaaaccccgucucuacuaaaaacacaaaaauuagccggacaugguggcggaugcuuguaaucccagcuacucgggaggcugaggcaggagaaucacuuggacccgggaggcggagguugcaguaagccaagauugcgccauugcauuccagccugggcgacagagcgagacuccgucucaaaacaaaaaaacaaaaaacuguacauaccuaauuucaaaauuauugcuaaaaaaugcuaaggauuaucugagccuucagcgaguuguauucuuuuugcucauggagggucuuccucuauguaguuggcuacugacugauuagggugguuguugcugaagguuggaguggcuguggcaguuucuuaagacaagacaaugaaguuugccacauugagccuuccuuucacaaaauauuucucuguaacaugcaaugcaguuuugauguguguguguguguguguguguguguguguguuuugagacaaucucuccugcaaccucugccucccagguucaagcgauucuccugccucagccuccugaguagcuggaauuacaggugugcaccaccaugccuggcuaauuuuuguauuuuuuacaggcgugagccaccgugcccagccaugaaauguauuuucuuaaauaauaagacuugaaagucaaaaugauuccuugauccaugggcaacagaauggauauuguguagcaggcaugaaaagauaaaucuuguagaucucccaucagagcucuugggugacuagguguguugucaaugagcagugagugagauuuucugagcagcaguucucaacaauaaacuacucaguaagccaugcugucaaagagacaugcugucauccaggcuuucuuguuccguuguuagagcacaggcaguguagauuuagcauaauucuuaagggcccuaggauuuucagaaugauaaaugaacauuggcuucaacuuaaagacagcuacuacauuagccacuaacaagagaauuagcugguccuuugaaauuggacauugacuucucucuagcuaugaaaguccuagauggcauccucuuccaauauaaagcuguuucauccacguuaaaaaaucuauuguuggccgggcacguuggcucacgccuguaaucccaggacuuugggaggccgaggcaggcggaucacaaagucaggagaucaagaccauccuggcuaacauggugaaaccccgucucuacuaaaaauacaaaaaaaauuagccaggcgugguggcaggcgccuauagucucagcuacuggggaggcugaggcaggagaauggcgagaacccaggaggcggagcuugcagugagcagagaucgcaccacugcccuccagccugggcgacagagugagacucugucucagaaaaaaaaaaaaaaaaaucuauuguuuaguguagccaccuucaucagguaucuuagccagaucuucuggauaacuugcugcagguucuacaugagcacaugcugcuucaccuugcacuuuuuuuuuuuuuuugagacagaguugcccaggcuguggugcaguggaaaagucuuagcucacugcaaccuccgccuucugagcucaagcaauucucaugccucagccuccugaguagcugggauuacaggugcgugacacuacaccuggcuaauuuuuguauuuuuaguaguaauuuaguaacuuuuguauuuucaccauauuggccaggccgaucucgaacugaccucagaagaucugcccacuuuggccucccaaagugcugggauuacaggugugagucaccgugccuggccuuaccuugcacuuuuauguaaugaagaacagcuuccuuccuuuaaacucauguuagcuucaaacuucugcaguuucucaauucucucagccuucauagaauugaagagaguuaagacccucuucugaguuaggcucaggccuaagggaauguuguggcuguaugaucuuguauccagaccacuaaaacuuccuccaugucaggaauaaggcuguuuugcuuucauauuacucauuuuucauuagaauagcacucuugauuuccuuuaagaacuuuccguuuggauuuacaacuuggcuaacuggcacaagaggccuagcuuuuggccuguauuagcuuuugacaugccuuuuucacuaagcuuaauuucuagcuuuugauuuaaagugagggacaguccacucuuccuucacuugaacacuuagaguccauuguaggguuacuaacuggccuacuuucuuuuuuuuuuuuuuuuaagacggagucucgcuccaucgccgaggcuggagugcaguggcacaaucuuggcucacugcaagcucugccuccuggguucacaccauucuccugcuucagccucccgagaagcugggacuacaggcgugugccaccacacccagcuaauuuuuuugaauuuuaauagagaugggguuucaccguguuagccaggaagucuagaucuccugaccucgugauccgcccgccucggccucccagagugcugggauuauaggcgugagccaccaugccuggcaaggccuacuuucaauauuguuguaucugagggaauaaggagguccaaggagagggagagagaggggggaaugguuggucaguggaauagucugaacacacacauuuaucaguuaaguucaccauccuauacgggcacaguuuauggugccccaaaacaauuacaguaauauaucaaagaucauugaucacagaucaccauaacagauauaauaauaauaaugcaaaaguuugaaauacugugagaauuaccaaaaugugacacagacacgaagugagcaucacuugcuguuggaaaaauggugccaauggacuugcucaaugcaggguugccacaaaccuucaauuuauuuaaaaaaugcaauaucugucaagcacaguaaagcaaagcacaauaaaaugagguaugccuauacuguguguguuaaauaauucucagauucaaguugguuuuuguuguuguuuuguguguuuauuuuuaauuugguucaguaccaguaggggaaaauuagaacuaacuuuugagugcuuacuacaucuggcaugugcuaguuacugucacaucccuaaucuuauauauucuuacuauauuccuguaaaguacguaauaucccuauuuuauaaauaaggaaaaggagucgauuagaguaaguaacuuuaauggacauuucaccucaggggcagcagauaccaacagacguguauaggauuuccaaaggcaacuuuuuagugauaaacuaaauuaggugauugugcuuuaugagugucugauauuuccaccguuuauucuugaugcaaagagucuagauauaaagguggcuauaugcacaagaaauaaauuuugauuguuuugaguucugccaccuguagaggugucugcucuauucuugauguuguaaaaguuaagugaaaaauucacuuaaaacagcaaucuguaauauaucuguauagauuucuuuugagcccauaaaugaaaauauuuuuccccugagacggagucuugcucugucgcccaggcuggagugcaguggcacgaucucggcucacugcaaccuccgccuccuagguucaaaagauucuccugccucaaccucccuaguagcugggaguauaggcacacaccaccacgcccaacuacuuuuuguauucuuaguacaggcgggguuucaccauguuggccaggcugaucucaaacucuugaccucgugauccgcccaccucagccucccaaagugcugggauuacaggccugagccaccgcgcucggccuuuguuuuuuguuuuguuuuguuuuguuuuuugagacagaguaucucucuguugcccaggcuggagugcaguggcaccaucucggcucacugcaaccucugccuccuggguucaagcgauucuccugccucagccucccaagaagcugggauuacaggcacaugccaccacgcccagcuaguuuuuguauuuuuaguagagacggaguuuugccauguuggccaggcuggucucaaacuccugaccuuaggcagucagcccaccucggccucccaaagugcugggauuucaggugugagccacugugccuggccuaaaugucugaauuuuuugcaucucguuuuauucuugaaaauuguguaauugauaagaucauacuucuugacgagcgugguggcucacgccuguaaucccagcacuuuggaggccgaggcggguggaucacgagggcaggagaucgagaccauccuggcuaacucggcgaaaccccgucucuauuaaaaauacaaaaaaauagccaggcgugguggcacgugccuguaaucccagcuaaucuggaggcugaggcaggagaaucgcuugaucccagaaggcggagguugcagugaaccgagaucgugccaccgcacuccagucugggugauagagcaagacugucucaaaaaaaaaaaaaaaaaaaaaucacaguucuucagguggcaguuauugaauugaaauacuucuuuuucuccuguuuauuaauucagucaguagagaugcuguaagaaccacucuggaaaauacaacacagauguagauccugagucuacuacuuuuuuaaauuccagggauuaucagcagucaagaagugucuaaggcauaaguggaaggaaagggagacuaggaggcaaaaaagaagccauauggguaguauaggcuuuaaaaaaaaaaaaaaagaggacauggcauauccggagaaaaaguagaauucuucuaacaauuaucuuauuccgaucguucuaaacaagauaguuaaaaggcccugggaucuggugguauuccaguacucaguaguuaaguauaaugaucagauaguucuagauuauauauuccagucacaauuuuccucuucauugauacaaacaauguauuaaaauggacaaacauauguucuaaagcucaccgauaucugucuaaauuacugauuucuccauugucaaacauauucugaaggccauuauauuaguaucugaaaauaggcacccccagagguaagagugauaauaucaaaaaaguaaauggucgauucuaauugguaucagaauaugauuuuccucuuaguucuacauccuuuccacauuacagaaauucacacagacuuuggugcuacugcaaggaacauuaaaaguugugaauagcuuuuccaaauuuaggggaaaaacucgguaucuuggcauguuugcagguaguaugguuuuccuaucauggcccuaaucauuugaacaguauuauuucuguaauacaauugauaauauguuuugcugugaaccuuuuuuuuuuuuuuuuuagauggagucucgcucuugcccaggcuggagugcaguggcgcgaucucggcucacugcaaccuccgccucccagguucaaccaauucuccugccucagccucccgaguagcugggacuacaggugcuucccaccaugcccagguaauuacuguauuuuuaguagagacaggguuucaccauguuggucaggcuggucucgaacuccugaccucaauugauccaccugccucggccucccaaaguaucuucacaggcugggugugguggcucaggccuguaacccuagcacuuuuggaggccaaggcaggaggauugcuugaguccaggaguuugagaccagccugagcaacauagcaagacccuugucucugcuggaaagaaaauaauuaguugggcaugguagugugcuucuaugguccuagcuacuugggagacugaggugggaggaucacuugagcccauguguucaaggaugcagugagcuaugauugugccaucgcacuccagccugggugacagagacccugucacuuaaaagaaacaaauaucuguauacauaugcuuaacuacauauuucugcuauggauauggauuuaaagggaagaaggaucaauuuagaaaauguuugaaaagaaugaagguggaaggcuuaccgugucagauauuaaaacaugucacaauaccauaauaauuaguugacuugaugcaaguagagauaguacaaugaaaugcgaaaggaauuauggaaacagccgggcacaguggcucacgccuguaaucccagcacuuugggaggccaaggcaggcggaucaccugaggucaggaguucaagaccagccuggccaacacggugaaaccucgucucuacugaaaauacaaaaacauuagccaggcgugguggcacaugccuguaaucccagcuacucaggaggccgaggcaggagaauugcuagaacuugggaggcagagguugcaugagccaagauggcgccauugcauuccagccugggcgacagagugagacuccaucucaaaaaaaaaaagaaaaaagaaaaaaacuacaaaaacagccaagcauauaaggaaaaaaaauaagacuauuuuguauuuaaaagguagcauuucaaaucugggaaaaugaucacuuaugcaauaaaugauccuaggauagcuagaggaaaauauucuuggugccuuaggauugaaggcuuaaauacagaaaaauuaagcuauauaauacuggaagagaauauaugacuucuaaaaucuugaggaaaaaacuauaauggaaaaaauuggcagaucagacuucuaaaaaacugauuuuuggccaggcacaguggcuuacgccuguaauccuagcacuuugggaggccaaaguggauggaucaacugacauugggaguucgagacaagccugaccaacauggugaaaccccgucucuacuaaaaauagaaaaauagcuggucgugguggugcaugccuguaaucccagcuacucaggaggcugaggcaggagaauugcuugaacccggaggguggagguuguggugagccgagauugcgccauugcacucuagccugggcaacaagagcgaaacuccguaucaaaaaaacaaaaacaaaaaaauaccaaaaacugauuuuuaaacaccagaaaacgaggaggcaaauggcaaaggagaaaauauuuguaaccagggucgggugugguggcucaugccuauaaucccagcacuuugagaggccuaggcaggcagaucaccugaggucuggaguucaagaccagccugaccaauaugaugaaaccccaucucuacuaaaaauacaaaaauuagccgggcgugguggcucacgccuguaaucccagcacuuugggaggccgaggcgggcagaucaccugaggucaggagugggagaccagccucaccaacauggagaaaccucgucucuacuaaaaauacaaacguaacugggcaugguggcacaugccuguaaucccagcuacucgggaggcugaggcaggauaaucgcuugaaccugggaggcggagguugcagugagccgagaucacaccauugcauuccagccugggcaacaagagcgaaauucugucucaaaaaaaaaaaaaaaaaaagauaacauccccauugaaaaaugagcaauggauaagugcaauuuacaaaauaaauacaaauauacaaacaaaggaaacccagguaaaaauuacaaugagguuuuucuucuccaauuugcaaagaugagaaagaauucuggcaaagaguguggagaaaugaauuacuaguacacugguaauaagaguacaaguuuguguaaccuuuuugaggagaaauuuagcaauguguaucaaaaauguaagauguguuuucucuuuaaccuaauaguucuacuuuauauauucauaaaugaucacauuggucaucuauguuauauggaagacauuuaucauucuuuuuaaaugaccagaauauaaaccaccuuucucuauuugugguauuccccuagugagugaauauugucaggguauuuauucuaguugucuccuacuuauccucauaaaauauaagauauguaacuuguucucuguuguauccucaaugucuagaacugguuacagcucauaguaggugcccaauaaaaauaccugaaagucagguacuaacuuuuccugccuuacuugcagcuagguugcaggcaaguggcuaggacuccauugguuagaugaaucugugcuagauuuggacuucggaauaaagauauaaaaaaccacgaccucuagaagauucuuagccugcaauacaguuuaggaagaucaaguuuccuugcauaaaaggcagcaguguggugugcaccagugaccacagaccugcucucuuggcaugguuucacaccucacucuuccuugcaucgaccagaggcugguucuccagccucccugaugauucugugagcuacuuaauauucguuucuuaaaauuuuauuuacuuaauuuuugaauuugaaauauauauacaauagaauguauaaaauaaguauuauuuaaauauaaacaacuguuuacuuuccagauuaagaaauaaacaauaccuuuauuguuuauuaugcaggauaaaagcuuccuuuuauccugcauugauuacauugcucccacuacccccacucauacagguuaccacuaucuuaaauuucuuuucucuauaauuuuacuucacauacaucucuaaacaauauauuauuugguuuugaaucauagcauauguuuucuuucaugaauuuuuuuuuuuuuuugagacagaguuucgcuccuguugccuaggcuggauugcagugacaugaucuuagcucacugcaaccuccgccuccuggguucaagugauccuccugccucagccucccaaguagcugggauuacaggugcccgccaccacacccagcuaauuuuuguauuuguaguagaaacgggguuucaccaugauggccagguugaucuuggacuccucaccuuaggugauccacccaccucagccucccaaagugcugggauuacaggugugagcucagccucuuccaugaauucuuuuaguuuucagauucauacauugcuuauagucaacuggugugugcuuguauggcuguaccuguuguuguuuggcaucuauucugauuggucaaugccugugcugcccaguuguuaaauaauuugaaaaucaucaucucuagauccauucauuugauguauauccuguauaacauucuacucuaugaguuuacugcaauuuauccauuccauuauuggugaauauuugaauguuucuaauuuuuugcuauuguaagcauucuuauaacaugcuuccuauuguauauucacaagggcauguacauucccuagggaaucuaccaaugaaugaaauguuggaucacuugauaugcacaucuccaaaauuauuuggaaaugucagacuguuaccaaaauauuuguaucaauuuacacucccaccagccauuuccuugccccauauccuuggcaacacauuugguaccaucuggccuuacguuuuugccguuccagugagugugacaugauaguucauugugguuuuuguuuucauuucccuugguuacugauaaaauugagcgucuaacuuuauggacuauuugugucuuuuguaaaaaugcuggcucaugucuuuugcucauuuuucuguuggauuauuugcuuuuuuuaacuaauuuauacaaguuuuaaaauacaaaauugugugaguugaauaugucuucaauuuauagcuugucuuuuuauuuuuuuuccuuuucuguuuuuuuuuuuuuuuuuuuuuuuugagacagagucucgcuuugucgccccggcuggagugcaguggcgcaaucuggggucacugcaaccucugccucccaggcucaagcaauucucgugccucagccuccugaguagcugggauuacaggcacccgccaccaugcccagcuaauuuuuuguauuuuuaguagaggccagaguuucaccauguuggcugggcuggccuugaacuccugaccucaggugaucugcccaccucggccucccaaagugcugggauuacaagcaugagccacugugccuggccuugucaaacauauucuaaccauuccuagaaacaggaagaaaaggagucaagggagaauucuuuuuuuugaaaggugagaugagacauguuuguauauuaauaggaauaauccaguagagaaggaaaacuuggacugggcgcaguggcucacucaaucaauaaauauuuuauuugucuuuuaugugugaggcacuguaguaggcucugggagcguaacaagauagacaagaucccuguacucaugaagcuuacaguuuagcaguauuggugguggugagggugggugugauacaaagaacuucaaagggaaaguacaggacuaugagggccucuaauaggggaccuuaauacuuuaagcuauuuuagagaauagguuagagaaguacauuuaagcugauucccaaaaaaggaggaguuaggcaaacucugaaagaguacuauaagagagaaaagagaauagaugaaugguccuaucauagcaaggaacuaggagauguuuaaguacugaaggcguacugugugugaaaggcaacuugaaguuucgagggauagcagcuaccauauaauacagaaucauaaacauuuuagacuaugcuaaaagcaauagggagccauugaaaggacuuaaacagaguaaugacaauucacuuucauaauauuucuuucuuucuuuuuuuuuuuuuuuuuuuuugagauggagucuugcucugucacccaggcuggaguacaguggcaugaucucagguuacugcaaccuccgccucccagguucaagcaauucuccugucucagccuccugaauagcuaagacuauaggcgcccgccaccacaccuggcuaauuuuuuuguauuuuuaguagagacaggguuucaccauauuggccaggcugcucucgaacuccugaccuugugaucuguucgccucagccucccaaagugcuaggauuacaggugugagccacugugcccagccuauaauauuucuuuuguaaaggaguacacaugaggcuacuggaaccuaaugccauuaaaccuuagacucauacaguagcuccccuucuuauaauuauuuguuuacuuagccauuuaauauggauuccucagucagacaugaguguaaguuuauguuuuuucacugauugaaaaauuuuuuuaauuuuaauuuuuguggguacauaguagguguauauauuuaugggaugcaugagauauuuugauacaggcaugcaaugcauaauagucacaucauauaaaaugggguaucuguucccucaaguauuuauccuuuguguuacagacaauccaauuauauucuuuuauuuugaaauguacaauuauuauugacuauagucacccuauugugcgaucaaauacuaggucuuauucuuucuaacuauuuuuugguacccauuagccaucccuacccacccacucccaccucccacuaaccuuaccagcuucugguaaccauccuucugcuuucucucuccaugaggucaauuguuuugauuuuuagaucucauguaagaacaugugauguuugucuuuuugugucuggcuuacuucauuuagcuaaugaccucuaguuccauccauguuauuguaaauaacaggaucucauucuuuuuuauggcugaauggugcuccauuguguaugaguaccacauuuucuuuauccauucauguguugauggacacaaguugcuucgaaauuuuggguauugugaacagugcugcaacaaacaugggagugcagauaucucugcgauacacugauuuccuuucuuucgcauauauaccuagcagugggggugcuggaucauaugguagcucuauuuuuaguuuuuaaagaaaccuccaaacuguucuccauaguaguuguacuaauuuacauucccaccaacaguguaugagaguucccuuuucuucacuuccuugccagcauuaguuacugccuuucuuuuggauaaaagccguuuuaacugaagugagauaauaucucauuguaguuuugauuugcacuuauuugaugaucagugauguugagcaccuuuuccuaugccuguuugccauacuuaugucuucuuuggagaaauguguauacaaguauuuugcccauuuuuaaauuagauuguuagauuuuuuuccuguagagucguuugagcuccuuauauauucugguuauuaaucccuugucacauggggaguuugcaaauauuuucucccauucuguagguugucauuucauuuuguugauuguucccuucacugugcagaagcauuuaaacuugauaugaucccauuuguccauuuuugcuuugguggccugugccugugggguaucauucaagaaauuuuugcccagaccaauguccuggugaguuuccccauguuuucuuguaguuguuuuauaguuugaagucuuagauuuaagucuuuaauccauuuugaugugauuuuuguauauggugaaagauaggaaucuaguuuuuuucuuuugcaccaucuauugaaaagacucagacaugaguguaaguuuaauuuccuuggaacuaauacaacgcuuuucuauuuuuaugugugugugugugugugugugugugagagagagagagagagagagacaugguagacaagauauucuuuuuuuuuuuuuuuuuuuuuuuuuuggagacagagucuccauuuguugccuaggcuggagugcaguggcacaaucucagcucacugcagccuccaccuccgggguucaagcgauucuccugccucagccuucugaguugcugggauuacagucaugcaccaccacgcccagcuaauuuuuguauuuuuaguagagacgggguuucaccaugugggccaggaugguuuugaucucuugaucuugugauccaccugccucugccucccaaagugcugggauuacaggcgugagccacuacaccuggcccuuuuuuuuuuuuuuuuuuuuaagaagcagggucugccucugucgcccaggcuggagugcagugguacuaucauagcucacuacagccucgaacuccugagcuccagugauccucccaccucagccuccugaguagcuaggacuacaggcaugugccaccaggccuaacuaauuuuuugguguuuuuuuuuuuagagacaagaucuggcuaugaugcccaggcuggucuugaauuccuggauucaagcaauccuccugccuuggccucccaaagugcugggauuacaggaaugagccacuacacccggccuauuuuuaaauuuaaagaacauacaaugagaaacagcuaaaucuucuuagcauguuaauaacuuauguauuauauaguuuuagaaauucuuaaagugcuauuuuaaaacucuagcuuuuuuuuuuuuuuuuuugagacaaauucucacucuuuugcccaggcuggagugcaguggcacgauuucagcucacugcaaccuccgucucccagguucaagcgauucuccugccucagccuccugaguagcugggauuacaggcauacgccaccaugccuggcuaguuuuuuuuguauuuuuaguagagguggaguuucacuauguuggccaggcuggugucaaacuccuaaccucaggucauccaccugccucagccucccaaagugcuggaauuguacugugcugggauuacaaaaugcuggcugagccacugcgcccagcugguuauuuuugaacuauuauauagauucugagaacuauggcagauuuauguaaaaauuuauuuuaacuccuaagcuuguuuaagcucaaaauaaguaagauuguuauacaagucuuauuuaucuuuucaucaagaaugucagaaugugcuauucuauuugugaucagcuucuuuagagauuauccaaguucugaguucucauuuugacuaguuaaauauauugugauccuuauauucuagauuuaaugaacaacuaauacuaugccuugcauauaguaggcacucaaaaaauauguucagugaauuaaaguuccugagauaucuuaauaagauauuuaauuguaucuuuaaaaaauuuccuccauuaauacuuccugucacccaaaauguauuguccuuuuuuuuauuuuuugaugaucuuuuucuuccuggcuuuauaaucuuuaauauucugcucuaaaucuuauuguuuugcuauuuucuuuuacauaaagccccuuuuaaagguuuaauugcccuaauuauuuucuugagacuuauauacucgcuauguuuuauuuugauccuuuauuguuuucccacuuucucuuagaaaaucuucuuuccuuuucuuuugauauauuuuauuuuauauugaaaaagauccuugagccuucuuuuguguuuuauaguauuuuauuagcaauuuuucucauccugagaagcuguguaacuguuugcuguguaacugauaaacauaauuuuauguauucuguauuuuuagucuauugaagacaaugaaguauauuugccuaaugaugaaauuuggaccuaugauauugauaguggguugugguaaguaauuuuaaauugcauacugucugaucuuaauaucuauuauaaauguuucuguagacucuagggaauuugagaccauacuuugaacauacugcaacauuuuugaagucucccuuuccuuuccuuucaaugcuuuuauuuucugacucuuucauuccccuacugucuucccugcuccacuuuuugucuuuuaguauuucucucaagaccagugcugucucugaagauuuuguuuuauucugcaaauuuccaguucuagugacgugugaaauuuuugugauuuuuuuuuuuuuccuagcagauugaaaaaguuuuacccuggaucuucuuagaguuuuuacauuauuggccaccauuacauuguaacuguaauugacagugacaguuuucacugacaaaaguacucauggaguuuaaagagaauuuuaauuugccuuucuggaaaguuaugggauuccauguuauucuugcugcaggagaaugcaccucauggaaggagaacucccagccuccaugucaggaagcuguggugcuugcauuaauggaaagcuguacauuuuuggaggauaugaugacaaaggauacagcaaucgaguaauaauuucuuuaauucaagagugcagcaaaauguaauauuuaaugcaucauuucaucucacaaguuacaaauauuuuaaaaagaagauauauauagaaaaccuuaaacuuguaauuaaauauuuuaaagcuggguugaaaaugcagcaguccugcucuucucuucuucugugucuuucugcuucagaauuaacugcauauuuaauugauauucauaggauaagagcaggaugugacucauuuuaauauguuuuauauaucauuuuuacuccuaaaacagucucauuuuuauucuccaauuuuuaaauuuuaauagguaacaagcuuaccuauuaaaaagaaaauaauaguauuaauucuuggaucacauucccucugauauagauuuaauuuuuaaaugcccugucugcuaauaguguucucaucuuuuaaagcuuuauuuuguuaauuuacgaacaagagaugaaaccuacauuugggagaaaaucaccgacuuugaagggcaaccaccuacaccacgugauaaacuuuccugcuggguauauaaagacagguaaugcagcaguugcacuuaaugcauuaugucuaccuaagcaaagauaauagcuuuggcuaaaauacagaaugcuuaaagguaugaguuuuuuucaggauugcaauugauuuucuaaauaaucaauaucugacaaugcccguuuuauuucuuccuuucuaaucuuuaaacuuuuuguugucuuacuggacuggguaggaccuugaguaaauccagugcuuauauuuauacuuucauauauuacucauucuuuuucucugaacaauaucuaucauuccccuacucugagcaucaauaaaacuagaugguagccucuucaucccucucuccuucccauuccuucaacgcuaguuuuugugaguuauguuuuuaauccuucuguuccauuuuugggaagaaggggaacuuuaguuaugaacauuuuagcuccucacucccugcuuaucauuucuugcuaauucuuuuuaacuauuuuuugugguuuuucacauuuuuauucuuuauguccuuuacuguauuuucugugauaacugucucuuugcuauuuguaacauugucuucauuucugaaaugaguuuuucuccccuuuuauuucuuuccuaauuuuuuuuguuuguuuuuuguuuuuuuggaaauggagucucacuguugcucaggcuggagugcaauggcacgaucucugcucacugcaaccucugccucccggguucaagcgauucucuggccucagccuccugaguagcugggauuacaggugccugccaccaugcccggcuaauuuuuguguuuuuacuuuauuuauuuauuuauuuguuuguuuauuuauuuauuuauuuuugugacagagucucgcucugucgccuaggcuggagcgcaguggcgcaaucucggcucacugcaaccuccaccucccagguucaagcaauucucuugccucagccucccgaguagcugggacuacaggggcaugccaccacgcuggcuaauuuuuuuuuguauuuuuauuagagacaggguuucacuguguuagccaggauaaucucgaucuccugugcuugugauccgcccgccucggccucccaaagugcugggauuacaagcgugagccacugcaccuggcccuaauuuuuguauuuuuaguagagaugggguuucaccauguuggccaggcuggccucgaacuccugaccuugugauuugccugccucagucucccaaagugcugggauuacaugugugagccacugcgccuggccuucuuuccuaauuucuaacaauucuguuucagcuccucauauuuucuggccaucaacucuguuauuugaguucuuauauuuuuguuuuaaggguuuucuucauugcuaauuauuaaauuuuauuuguguuuuaaaauaucauucacuauuuaauuuccaguuuucagauuugcuuguuugucucuuaaauguuuuuaaacaauuuguucaguaggggacuagauaaggucuauacguuauaaucgauuuauaugucuuucuuuuuucuuuuucuuuuuuuuuuuuuuuuuuuuuuuuuuugaggcagaaucucacugucacccaggcuggaaugcaguggugccaucucggcucacuguaaccucugccucccaaguucaagcaauucuccugccucagccucccgaguagcugggacgacaggugcauaccaccaugccugguuaauuuuuuuguauuuuuaguagagacuggguuucaccauguuagccaggauggucucgaucuccugaccucgugauccacccgcuucagccucccaacgugcugggauuacaggcaugagccacugcacccaaccaauaugucuuccauauauauaguugcuuuuauucuagagauuuccuuuuggucuuuuuuguuguuuuguucuugaaauuuauuugauaaagaaaccaugucauuuggcuauagaaucccaauagucugcacuguguugguuguaucucugugauaccauuuaacauauucaucuacaccuucuauuuucuguaaauugguaguuagaucuagaaaguuaagcaaauucauguucuuguguuagcuguugguuugggagcaaauaaaaaguacuucauagauuuucuuuuuuuuuuuuuuuuugagacggagucucccucuauugcccaggaugaagugcagugguggaaucucggcucacugcaaccucagccuucuggguucaagugauucuccugccucagccucccgaguagcugggacuacaggcaugugccaccaugccuggcuaguucuuuuuguaucuuuaguagagacgagguuucacuauauuggccaggcuagucucaaacuuuugaucucgugauccaccugccuccaccucccaaagugcugggauuacaggcaugagccgccacacccggcuuaauuuuuguguuguucaguagagacaggguuucaccauguuggucagccuggccuugaacuccugaccucaggugauccacccaccuuggccuccgaaagugcugggauuacaggcgugagccaccaugcccggcccauagcuaacuuuuuuuuuuuuuuuuuugaaauggaguccugcucugucacccagccuggaaugcaguggcgcgaucucagcucacugcaagcucugccucccagguucacgccauucuccugccucagccucccgaguagcuggaacuacgggcucccgccaccacacccggguaauuuuuuuuuuuguaucuuuaguagagacaggguuucaccguguuagccaggguggucucgaucuccugaccucgugauccgcccgccucagccucccaaagugcugggauuacaggcaugagcuaccgcgcccagcccauagcuaacuauuuuuagacauuaguaggcacauaauguuugguugucucuguauguuagcaagcaccgaugauugcugccuagauccauuuuuguacaagaagaugcaaagugaugauauucuaauucuauuauuuguucuuaauuuauuaguggaauacuucuauaaaaagaaacuuucuuuaacuguuuauuaacccuaagauacuguuuguauaggaaaaucaggauaaaugcuugauucuuucgccuuuagaaucaauugagucauuucucuaguauccuucaaaguggucaguaagguuuuaaauuaccauuuuaaaaucauggauuugaaauauuugaugucggccugcccuaguggcucuugccuauaaucccagcauuuugggaggcugagguaagaggaucgcuuggggccagaaguuugagaccagccuggccaacaugacaaaaccccaucuuuacuaaaaagacaaaucguuaaccaggugugguggcguacgccuguggucacagcuacucagguggcugaggcaggagguauauauauauauauauauauauauauauauauauauauauauauauauauauuuuuuuuuuuuuuuuuccugagacagagucucacucugucacccaggcuggagcacaguggcacgaucuuggcucacuguaaccuccgcuuccuggguucaaacaauucucaugccucccaaguagcugggauuacaggugcacgccaccaaaccuggcuaauuuuuguauuuuuaguagaaacaggguuucaccauguuggccaggcuggucuugaacuccuggcuuuaagugauccacccgccuuggccugccaaagugcugggacuauagauguaagacacugugcucagcuagaauauauaaauauguuuuaaauaaaguuuaaaaaucuaggcugggcugggcgugguggcucacaccuguaaucccagcacuuugggaggccgaggcgcgcagaucacacggucagaaguucgagaccagccuggccagcauagugaaacccugucucuacuaaaaauacaaaaaauuagccaggcgugguggcaggcaccuguaaucccagcuacuuaggaggaugaggcagaacaauggcuugaacccaggagguggagguugcagugagccgagaucgcgccauugcacucgagccuggguaacagagcgagacucugucucaaaaacgaaaaaaaaucuaggcugguugugguggcucaugccuguaaucccaguacuuugggaggucaaggcuggaggaucccuugaggacagggguuugagaucagccugggcaacacagugagaccucaucucuacaaaaaguaagaaaaaaaaauacccaggugugguggcaugcuaugcaccuguggucccagcuacuugggaggcugaggcaggaggauauguauaguauaguauuugaaucauauacucauguauaauauauuauuugacucaaauacucugacucauauacuauacuauacuauaaauguaugguauauguuauauaacauauacuuuagcauauacuuaacacauaguauauauaauauaaaauaugucuuuauauauuauauauacuuuuacauguauacuuaauauauauuuauauauacuuuauuuccauauauauggaaauuacauauauacuuuauuuucauauauauggaaauuauauauauacuuuauuuccauauauauagaaacuuauuuuuaucuauuuuauauuuuauguauacauauauacuuaauauauauuauauauguuuuuuguauuauacauacuuuauuauauuaaguguauauauauucauauauauuuuacuuuauuauuuuuuuuuucugagacagagucucauucugucacccaggcuggagugcaguggcaugaucucggcucacugcaaccucugacucccugguucaagcuauucuccugccucagccucccgaauagcugggauuacaggcacacaccaccacacccagcuaauuuuuguauuuuuaguacagaugggguuucaccauguuggcaaggaugguuuugaucucuugaccucaugaucugaccgccucagccucccaaagugcugggauuacagaugugagccaccgugcccggccuacuuuauuauauuaaguacauauaaaaguauauauaaaauauaggccggaugugguggcucacgccuguaagcccagcacuuugggaggccaaggcgggcagauuacuugaggucaggaguucgagaccagccuggcugacagugaaaccccgucucuacuaaaaauacaaaaauuagcugggugcaguggcagguaccuguaguuccaccuacuuaggaggcugaggcgggagaauugcuugaaccugggaggcggagguugcagugaucugagguugugccauugcacuccagccugggugacaagacucugucucaaaaaaaaaaaaaaaaaaaaaaaaaaauauauauauauauauaauaaaagauaaaacauagccuuaccuuuuaaaccuagauguuuaugagcaaugaauauugauuuuuauuaaauacuuuuucuuuugaagucguuugagguuuguuuucucauuuaaauacugaugucauuaaauauuuucuaauaugauauacucguguuucugauauaaaucuuacaugguuguaacgaguauuucaacauauuguugaauuucauucacagguguauacagaauuuuuuaggaggaguaauugauagcuuuguugauuugccuccugguuacacuuaauuuuuugucauuuugguuugcaaaaagcauuuuaagggcuagaggcaaacauaggacugaacucugucucugaaccuagcauaggcucguauaaagggaguaucuuugaaugcuuauggcaaugacauguguuucuguaaaccacuaugguuuucugccuuuguuuuuccagguuaaucuacccuguaaaguauuuuuggaccuuuaaagguuuuuuguuguuguuaguauguaaaagaaaccaguaacaaugauugcccuaggcaagggaauuaagugacugagaguaggagggagacuuaccucuugcuacgcuuuuuuuuuuuuugagacagagucucacucuuguugcccaggcuggagugcaauggcguggucuccacucacugcaaccuccaccucccugguucaagggauucuccugcuucagccucccaaguagcugggguuacaggugccugcaaccaugcccagauaauuuuuguauuuuuaguagaggcgggguuucaccauguuggccaggcuugucucaaacuccugaccucaggugauccgcgcaccucagccucccaaagugcugggauuacaggcaugagauaccacgcccggcuugcuauaccuuuuugaaagguugugguaaauacauaaaacauaaaauuuuucauuuuaacuauauuaaguguacaauucaguggcauuaauuaccuucauaauguugugcaaccaucaccaguaccuacuuccaaacuuuuuaauuacuccaaacagaaacucugugcccauuaagccauaucuccccauucucccuucuuuccaaccccuggugaccucuaaucuuucugucuauaauaauuuacgaauaagcagauaauagguauuucauaaaaauugaaucauaaaauguuuguucuuuuugucugccuuauuucacuuaacauaacguuuucaaggugcauuauguuguagcauauagcauuccuuuuuauggcugaguaauauuccacuguauguauauaccgcauguugguuagccauuuauauguugguagaugcuuggguugugucuaccuuuucgcuauuugugaauaaugcugcuaucaauguggcauauaacuuugugugauucaguuuucaauucuuuugaguauauacguuaagaauagaacuguugggucauuuggugagucuauguuuaaguuuuugaggaaccaccaacuauuuuccauagugacuauaccauuuuauauucccaccagcaaggaacaaggguuccaguuuugccacauccucaccuaugcuuauuuuggguguguguguguguguuuuuaauaauaguuauacuagcagaugugaaaugguauuucauugugguuuugauuuguauuuuccuaaugacuaaugauguuggcuuauuggacauuuguacaucuucuuuggagaaaugucuauucaaauccuuuacccauuuaaaaaaaaugagucgucugucuuuuugauguuacguuacgguaguacuuuauguauucuggguguugaucccuuaucagauauauuuaauuguauuuuauuugucuugcuuugguaucaggguaaugcuagccucaaacuaauuuaggaaguauucccuccucacuuuuuuuuuuggaagaguuugagugggauugguguuaauucuuuuuuaaauauuugguagaauucgccagugaagccauucuugggcuuuucuuucuugggagcguuuugauuacugauucaaucaucuuacuuguuauagguuuauucagauuuucuauuuuuucuugagauauaauuuauuuuuguuuuuauaagagucagggucuuucuuuguuacccaggcuggagugcaguggugcuuucauggcuuacugcagcuuugaacuccuuggacccucaagcaguccuuccaccucagccuccugaguagcugggacuacaggcacgugccaccaucccugacuaagauuuuuauuauuuguagggauagggucucauuauguugccaggcuggucucagacucuuggcuucaagugauccuuccaccgcagccucccaaauugcuaggauuacaggcaugaaccacugugcccagcauugagggugugggucuuuccaggaaguuuuccauuucaucuaaguuauccaacuuguugauauacccuucuucaugguauucuggugguuuuguuguuguuguuuguuuguuuuugagacagggucucaccuuugcccaggcaggaguguaguggcacugucuugguucacugcagccucuaccuccuaagcucaggugauucucccaccucagccucccaagcagccgggacuacaggugcacaccaccaggcacagcuaauuuuuuuuguacuuuuagagacaagguuucaccauguuggccaggcuggucuugaacuccuggacucaggcaaucugccuaccuccgccucccaaagugcugggauuacaggugugaaccagcaugccuagcauaguauucuuuugucauccuuuuuauucuguaguaucaguaguaauauuucuuccucacuucugcuuuuaguaauuugaaucugcucucuuuuuucuuagugcagcugucuaagcauuugucaauuuuguugaucuuuucaaagaaucaacuuuuguuuuguuguuuuucuuuuucuuuucuuucuuucuuuuuuuuuuuuuuuuuuuuuuuuugagucguagucucacucuguucacuuuguugcccagguuggagugcaguggcgcgauccuagcucacuguuuccuggguucaagugauucuccugccucagccucccaaguaucugggauuacagccgccugccacuacacccaccuaauuuuuuuguauuuuuaguagagacgggguuucaccauguuggccaaacuggucucuaacuccuaaccucaagugaucagccugccuugaccucucaaaagugcugggauuacagccaugagccaccccgcccagccuguuguuuuucuugauuguuuuucuauucacuauuuuauuuugccuccaaccuuuaucauuuucuuccuucugcccucuguaaguuuaguuuguucuugucuaauuccuuaacuuguacaguuauguuauggauuugagauuuuauuuuuaauguaggcauuuacagcuauaaauuucccucugagcccugccuucgcugcaucucguaaguuuuguuauguuuuuauuuucauuuaucucaagguaauuucuaauuuccguuaugauuucuuugaccauuuggguugacaggauuuuuuuucuuucagcacuuuacagguuuuauuuauuuauuuauuuauuuauuuuuauuuauauauauuuuuugagacagagucucgcucuguuguccaggcugaagugcagugaugcgaucugagcucaccacaaccucuuccucccggguucaagugauacuccugccucagccuccugaguagcugggacuacagacaugcacuaccaugcucggcuaauuuauuuuuauuuuuuauuuuuuguagagacaggguuucacuauguuggccaggcuggucucgaacuccugaccucgugauccacuuggccucccaaagugcugggauuacaggcgugagccagcgugcccagccuacagguuuuguuacauugcuuuuuggccuccauuuuucuuucucuuuuuucuucccuuccuuucuuuuuauuucuuuccuuuauuuauuauuauuauuauuuuguuauagagauggucucacuccaucacccacccaggcugaagugcaguaaugcagucauggcucacugcagccucaaacuccugggcucaagcguuccuccuuccuccucucaagcagcuaggacuacaagugcaugccaccacaccaagcucauuuuuuuuuuuuuuuugagacagugucucgcucuguugcccaggcuggagugcaguggcgcgaucuuggcucaccacaaccuccaccucccagguucaagcaauucuccugccucagccuccuguguagcugggauuacaggcaugcgccaccaaacccggcuaauuuuguauuuuuaguacagaugggguuucuccauguuggucgggcucaucucaaacuccugaccucaggugauccgccugccuuggcaucccaaagugcugggauuacaggcgugagccacagcgcucagccuuuuaaaauuuuuuguagggauggggaucucacuauguugcccaggcagaccugaaacuccuggguucaagcacuccuccugccucaaccuaccacauugcugguauugcaggugugacccacugugcccagucuggccuccaucuuuuuugugacaaauuuacucucauuuguguuuuuguuucucuguaugugucuuuuuuuuuucuuuaucuguucuauauuuuugcccuuaaauaauuugauuaaauaugcauugguguguaguuccuuuguauuuaucuuacuuggagugugcugagcuucuuggguuuguagguugauagcuuccaucaguuucucaguaauuauauuaucaaauauuucuucuccaucuuucuuugucuccccuucugugacucccauuacaugcauguuaggccauuuugauacuguuccacaaagcuuuggcuaccuauuucuuuucuucccauucuuuccuuuucuuuauguuuuaauuuggauauuuuuugugaaucuauugacuugucuucaaguuuacugauguuuuccauugcugugucaaguuugcuguuaauuaccaaguuccaggaaggaaauuuuuuuuuaaaguuugcuguuuaaccuauauaaugaauucuuuaguucugacauauuauuuucuauuuuuagcauuuccauuuaguucuuuuuuaugguucuaucucuuugcugaaauuacccauuuauuccugcauguuguccacaucuuucugcuauuaguauccucaucauaguuuuuuuaaaggcccugucugauaauuccauugucuagaccaccucugagucuguuuauauuaagucuuuucucucaucaucaugggccacuuuuuugugccuuuuguguauuuuguaauuuuuauuuuuuuaagacaaggucucacucucacucaggcuggagugcaguggugugaucauaacucaguacaaccuugaacucugaguucaagcaaucuucccaccucagccaccugaguagcugagacuacagguaugcaccgccacaccuuucuuuccuuuuuuuuuaaauuuuauuucuuguggagacaggucuccuuauguugcccaggcugaucucaaacuccugcccucaagcaauccgccugccucagccucccuguaguuuuuaaauuauaugccagaucuucugucugaaagaacaguaaagauuggaauaaauuauauuuaucuucagaaagugacaugcccuuucuucuuuuuuagguugcuagaguaagaguugagucagucuaauucguaggugauuuguauuugggcuuuguuguagcuuuaguuugauugaguuuuaccucuggcuucaaauguuuugggacaguacuuuuccuuuacuagggcccccuauuuggacacugagauuuucuagagauuugcagcugugcuucacagcugcguuccuaccucucagaacugugggagaucucuccauguuuuauaguccaguugguaggucauuggccacgagggaguucucuuugcucucugaucccacuuuaugcuuucugcacccuggaagaccucuuucagccuugcaucuccuccccuggccuuuggagggcagguacucuauaggguguaaauauuuggcaugccccugagguguuucuuucagaucuccuguuugcaucacaaacuuuaguaguccaaagcucagauugccuaaaggggauuuucucagcucuccucugccuccagcuguuggugacugacccugaucccucccugaagauuaugcgaaagaguuaaggaguagguuaaauuccgucuauggcuggguuuccuuuuuuuuguuguuauuauuauacuuuaaguucuaggguacgugugcacaacgugcagguuuguuacauauguauacaugugccauguugguaugcugcacccauuaacacaucauuuacauuagguauaucuccuaaggcuauccccgaccccaugacaggccccggugugugauauuccccuuccuguguccaaguguucucauuguucaguucccaccuaugagugagaacaugcgguguuugguuuuuugucccugugauaguuugcugagaaggaugguuuccagcuucauccaugucccuacaaaggacaugaacucauccuuuuuuauggcugcauaguauuccaugguguguaugugccacauuuucuuaauucagucuaucauugauggacauuuggguugauuccaagucuuugaggcuggguuucuaaagaugcuaauuuggggccaggcgccauggcucaagccuuguauuacgccuuuuucacacugcugauaaugacauaccaaagacugggcaauuuacaagagaaagagguuuauuggacuuacaguuccauguggcuggggaggccucacaauuauggcagaaagugaaaagcaagucucacauggcaacagauaagagaagagagcuuguggagggaagcuccccuuuugaaaaccaucauaucagcgggugcaguggcucacgccuguaaucccagcacuuugggaggccgaggugggcagaucacuugaggucaggaguucaagaccagccuggccaacauggugaaacccugucucuacuaagaauacaaaaauuagccaggcgugguggcaggcgccuguaaucccagcuacgcaggaggcugaggcaggagauucacucgaacccgggaggcggagguugccuugagcagagaucacgccacugcacuccagccugggcaacaagagugagacucugucucaaaaaaaaaaaaaaaaaaaaaaaaaaagaagagaaaaccaugagaucucaugacacuuaaucacuaucaugaggucagggaaagaccuguccucaugauucaauuaccucccauugggucccucccacagcacaugggaauucaagaugaaauuuggguagggacacagccaaaccauaucgcgccuguaaucccagcacuuugggaggccaggauaggaggauaacuugaccccaagaguucaagaccagcuugggcaauauggugaaaccccaucucuacaaaaauacaaaaauuagccaggcaugguggcacgcaccuguagucacagcuacucagaggucugaggcaggaggacugcuugagcccgggagguggagguugcagugagcugagaucauguucaugccacugcacuccagccugggugacagagggaaaccaugucucaaaaaauaaauuaaaaaaaaucuaauuugccaugccaauauaaauguagcuguuaaaaauuuggguaguuucuucuuacaagcccuguaugugcuggauucuuccucuugcuguuacacaagggaugaaagcagcuaugggucucuucuuucccauugagagcucaucacuuucuggaauugguuuauuuaggucucuuuguucccucagcucuuuauucuuuuuaaacugugauuuuguguuuggguuguuaaggugagaggaucuuuuucagcuuucuaugaacaaacuggaaacagaauuccuaaagugugucauuucguauuuguuuuucagacuaauauauuuuggugguuauggguguaggagacacagugaacuccaagacuguuuugauguucaugaugcaucuuggguaagauaguaaucacuguuuacauuuuccuccaagucaguauagccuuaacaucuuagaaauaaugagucuagucuuucucauuuuuggagcuaccaauuugucguaauugacgcuaugaaaaaaauguguuuucucucuuuaacauuuggauccauuuggcaaaagguaucucucuagugguauuagccuucauggcuauuggcagaguaauuucuuuucuuauaucguuaaucacagauaccugcuucuguuagacagguagaggcuuuagcacaacuuggaaaaauuauguucauauuuaaccgcaaaagcuauuguugacauacaccucuuuuuagauauguccacuagaauuauucauaggucagacuggccucuagauaagagucaguugguagugauacuaauuuuucuacuuauucuuacugauuagacaauaaaucauuauuaaugaaagaagucaugaauuacaaaaaugaaauuuuuaaacagauaauuuaaaaaaccauugauccuaccaccaagaugcagucuuauuaguuuuaccuucuacuagcguauauuauucuacauuaguguaaauacauauauauguguauauauauauauacacacacacacauuucauguauauugcuuuguauauggguauuauugaaaauuccccauguuucuauguuguuuuugaguuuuaaaaaugacauaucauuaaagcuuugcuacuuaaaguauugcugagaauuuucaggaauauaacuucuauuuauaucuaguuauuuuuauucaucagugaaauaacucaauuuuuuucuccuacaauacaguuacuaagcuaauuaucauguccugaaguuucuggaacacaaaugguauuuuuuuuuuuuuuucauuuagacucuaaaugagcugggugugguggcacauuucuauaaucccagcuacuagggaggcugaggcagaaggaucacuuguaccaaggaguuugagaccagccuggguaacauggcgagacccuguuucaauuuaaauaaaauuuaaaaauagauucuaaacuaaguaaauuguuuagcuuauuuuacuugcuugacaaggccugacaaaaauaaaugaugucuuucugacacacaauauaaaacuggcacagagaucaucuagaguagugauagaggauuucagcacccugggagaugcuaaauaugguauagcugcuaagucuuuucuuugcugacaaagaauuuuauaucuuaggagauaaagaagagaguggucauaaguuuaaucuguaagaacaaauugcuuggugaaguagaagugauuggaaguuuuugggaacaggaaccaugacccacccccuaaaguuuauuacagcaaaaaugaggaguucugagcauguacuuuagggaaacagauuuuaaaauguaaacaucauuccacccucugcaauuuuaaaaaagauaauccuuagagaaaauugaaagauugucaacaaguaaaauuaugauucacugcaaacaauacuaugagaagaaaaguugccagguggugcugcuacuggucuggggaccacgcuuugggagguacccguguauccguuggcuuugugacuaugguaacacuuaacucuauuuuuguaaggugucuguuauuuuaccaguaaauaugugauaaaacuguaauaauaauguaaaaauuauuaaagcuuugagauauuuaaaacauuucucuuuuaggaagagcagauauucuggggauggcauaaugauguccacauauuugacacaaagacacagacuugguuucaaccagaaauuaaaguaagugugguaaaaagucaucuuuauauauuuguauuuaaaaauaaauuuuuuacuguggauuuuggguuuuuuuuuguuuuguuuuguguuuuugagacaaagucuugcucuguugcccaggcuggaguacaguggcacaaucucagcucacugcaaccuccgccucccggguucaggugguucuccugccucagccuccugacuagcugggacuacaggcguggaccaccaugccuggcuaauuuuuguauuuuuaguagagacggaauuuugccauguuggccacgcuggucuggaacuccugaccucaaguuaucuacccaccuuagccuugcaaagugcccggauuacaggcauuauaggucaccacaccuggccuguuauuuggauuuuuguaauuagguuuguaaucacauaccaaguaguucucuugaguacuuucauuaauagcauuaagaaaaacaucagaaccguagauggcacuuguagucccaacuacucaggaggcugaggcaggaggaucacuugaguccaggaguuugaggcuguagugugcuacaaucacaucugugaauagccacugcacuccacugcauucuagccugggcaacauagugaaacccugucucucaaaauaaacaaauaaaacaaaaaaaugcauauucuucuccaugucagcuaagguuuucuagaaaaaagucuuuuaaugaggugccaucgucauucuuuacccacaagugucaugcccugauuuaauaaaggucuauuuuuaaaaauccuuuuauaacaaagcccauguuuuauauacccuugaauucagagguacaugcaauuauggcaugacaaaaaauacauuaucaguauucuuucauuuguuagugaccaaacacaaauucaaauuaguuuaagcaauaaugaauucucacauagcuggaaaucauauuggaauggcacacaaaguagaaggaagagccacagggaccauagccucaggaaccggagcagguuacucagcauccucacaauacuuucugucuuucugucugcuuuucucugcuucucuuugugugcuuguuucauuccgucuauggcagacacacuggcucauuuaggagggaauaugguccugguuacacacacaguuauuuguauuguacucucucaacgucuauauauuagucuuagaaaagggcugggcuugcuggcucaugccuguaauccuagcacuuugggaggccgaggcaggcagauugccugagcucagaaguucgagaccaaccugggcaacauggugaaacccugucucuacuaaaaauacaaaggaaauuagcugggcguggcggcaugcgccuguagucccagcuacucgggaggcugaggcaggagaauugcuugaaccugggaggcggagguugcagugagcggagauugcuccacugcaccacuccagccugggcaacagaaugagacuccgucuguaccaaaaaaaaaaaagaaagaaagaaaaggacucugccucuacuugggcauguuccuacccuuuacagcaauuccugaugccaaagggaugauuggccagucuugagucacauguucauugcuaggaacaggaggcuauugugacugauaagcuuaccagaauugaacagaguggaaugcuaagcaggucguauaugcacaguuacauacaugucuacuaauacacauauaugaccagaauuccuuacaguccaacuucuguucauggaaaugaugggaaggucuauacaaaaucguaaguauuagaguuuggccauucucuggauucucuuuuuccaggcaauaaauuucagauuuccaguacucuucuauucucuucuauauaguagaagaauucuuccaaaauuucagaucaagccugggguaauaauaaaaauuuuguuuugcuggaagggcugggaaccaaaauucuuaagugguucucauuuaaguguuauauagguaauaucugaauuaugucuuaccaaguugaccucagcacaguuauucaaauaagccugaaaaguuuaggaaguuaugauauuggaugcagagcuuuaauuuccuauacccacuuugaguagccagugagcugaaaaugucagguucuuucagaacuuggaauuaaaauacauacauaaaggcacccaccaugaaaauauggaaauuaugcagaagauuuuucccucaaaccuuauucauucaucuacccaugauacucacuuuuuccaccaauuaaaaaccucccuaggguggcguaauggcucacgccuguaaucucagcacuuugggagguugaggcaggcagaucgcucgaggccaggagguuugagaccagccuggacagcagagcgaaaccucaucucuacuaaaaauacaaaaauuagccgggccugguguugcacaccuguaaucccagcuacuggggagguugaggcaggagaaucgcauaaacccgggagguggagguggcagugagccgagauugugccauugcacucaagccuuggcaacagagcaagacucugccuugaaacaaaaaacaaaacuucucuaaagaaaaggucugcuauauuuauucaaaauaaaguguagagaaguguuaucaauuaauguuaagaguuuuaguaagagagagagcacugucuggcuuaagccaagagugaacuucuuauuguaaauuugaggcaccaagaguuuuggggccauuuuuaauuuuacagaguuucugagauaaucgcaauaugcacugcucacuucuaaugggaacucugugugugugaaagagaaacagaggagagagggagagagagaacauuuuaaaauuugauuuuaaaaucuuuauacaguauuucaaacaaaaauuuacaugaaaccuuauuuugcuaaauagugucagacauauaagaaaaacauuuucaaaaguaaagaucagggagaauaaaauguauucugacaaauaguauuugucuacaauuaguacuauuuagaauaaacuuuugcauuagcguuuuuaauugaauuacauagguaaugauaacuuagugauuaagacuuucacauacugagcauaggaauguaacuuuauuacagauauuucaagucuuugcagucuguucugauuucuacuugcaggguggaguuccaccacagccacgagccgcgcauacaugugcaguucuuggaaauaaggguuauaucuuuggcggacguguucugguuaguguuuuuaauggaaaugguauuuuuaugugcaaugcuccuuauaaaaauuuauccucugauuucguggaauaauugaacauucauguaaucuagagauuaaaauggcauucaauacuaauuuuauuuaucuucuaauucauaaacagaccauacaugaacaaucauagaugauuauaaaucauauuuuaaugaggagaaucuuucagugcaguaucagaaaaaauuaauuucuugucaucuaaagccugugaauuuaaaccuauuucuuccuauuuuuuccuuuccccuuugacacauugauuugggagcucugugucagucuuauuaaugcuuagcauuguuuuccaauaguuaaacaucuuaugugaaguaaaauagagauagucuauuuuuaaucugaacuuacuuuaaaagaaaaauuuuagcugauaaaagaugugaaauacugaccaauguaacacacuuuucuuuuagcaaacuaggaugaaugauuugcacuaucuaaaccuagacaccuggacuuggucuggaagguaaguuugaagucuaaguacguuuuaaucuauaggcauguguaugugucuguaugucaccauaauccaaaugugagucuuuaaaacuggacugguauuuuuuuccuucagaucguaugucuaagcaaggacuauauagauuuaaauagaguuuguuccuuaaccagacaagauaaaacaugaaaauacuaacaguugaaauuagauuauauaaaaguacugguuuuauacuaaguaguuuuugaggauugaucaguagaagaaaugaagaagugguugaauggggucaucucaggugaacagguaauggaguaaagucggauuuuauuuguagcucauaauauguauuuaacaauagaacaaauauauuuagcuaucaacuuagcaauuuguauaaugagauggaaucagagcuauauauuauuccaaaguauaaguaccauuaaauaccauaaaaccaugaaagucucagaagaaaauauagcagauuaucuuuaaaauguuggcauggagaaagcuuuguaaagaugauaugaacucaaaauucauaaaugaaaagacugaucgauaagacuacuuaaaaauuaaauauuucucuguagaaaaauguaccacaaaaaauuaaauggcaaauuguaaaaugcaaacaaaaaacuggaaacaauauuugcagguuuuuuuuuuuuuuuuuuugagacagagucuugcucugucaccaggcuggagugcaguagcauggucucagcucacugcaaccucgccucccagguucaagcaauucuccugccucagccuccggaguagcugggacuacaggcgcgcaccaccacgcccagcuaauuuuuguauuuuuaguagagacgagauuucaccauguuggccaggauggucucgaucucuugaccuugugauccgcccaccuuggccucccaaagugcugggauuacaggcaugagccaccgugcccagcugacauuugcaauauuuuuaaaagagagaugucagggcaaagauccacaagaacucaguaaaucaguuuuaaaaaggcaaauaauccaauagaaaaguggacaaagaacaugcauaaacaacucacagaagaaauaauagguaaaaauuauuuuuaaaagauguucaaccuaggcugggugcaguggcucacaccuguaaucccagcacuuugggaaaccgaggcagguggaucaccugaggucaggaguuugagaccagccuggccaacauggugaaaccccagcucuacuaaaaauacaaaaaaagcaaggaguggugguggacgccuauaaucccagcuacucgggagccugaggcaggagaaucgcuugaacccgggagguggagguugcauugagccaagaucgugccacugcacuccagccugggcaauaagagugaaacucugucucaaaaacuaauaauaaaaauaaaaccaggcaggugcagugguacacgccuguaaucccaguacuuugggaggcugaggcugguggaucaccugaggucaggaguucuuaaccagccugacuaacauggugaaaccccgucucuacuaaauacaaaacaauuagccggguguauuggcgcaugcuuguaaacagagcuacuugggaggcugagacaggagaauugcuuguaccugggaggcggagguugcagugagcugagaucacgccauugcacuccagcuugggaaacgagcaaaacgccgccucaaaaaauaaaaaaaaguuucuuauaaacaacacaaacaguaaaaauauuuccguuuuguaaaaaacaaauuguaucuuccaaaaauguccuguguuauucuggaacauuccagacuguggaagaaugguaucuucucaccuccuaaauuaaauucuuuugcuucuaacuuaugcuuuuuuauuuuauuuuauuuauuuauuuuuuuuggagacggaguuucgcucuuguugcccaggcuggaaugcaauggcgcgaccucggcucacuacaaccuccaccucccagguucaagugauucuccugccucaaccucccuaguagcugggauuacaggcacaugcuaccaggcccagcuauaacuuauguuuuuauuuuucaugccccgucucuuuuaagugucccuuuuauuauuaugauuauucuuguuguucuguuuucuuuuguuuuaagagacaaugucucuauuuugcccaggaugguccguccaacuccugggcuugagcaauccuccugccuuggcgucccaaagugcugggauuacagaagugagccacugugccuggcauuguuuuuauuuuuauuuuuuugagaaauccuuagagguuuacccuguaucuggaauggcuuucaugcuuuuauuuugaaguuagaauagcuagcauuuucagaggaagauaauguuuugggaaauucuagaaguagaucaaaguaaaaaacaacaauauaaaaacccauaauauccuuggggaaaucagcuaaaaacacaaaauuaaccaugaaacaacaguaaaaaguuacagacaugaaaaaaauuguguugaaaaacuaaggaagcagcugauuagccaauaagaaugaugcugaguaugcauugugcauuaacggagaauugacuuuuuuuuuuuuucuuggagaagcagucucucucugucacccaggcuggagugcaguggugcaaucuuggcucacugcaaccuccaccucccagguucaagcaauucuccugccucagccucccgaguagcugggacuacaggcgcaugccaccaggcccagcuaauuuuuuguauuuuaguagagaugggguuucaccaugcugcccagucuggucucgaacuccugaguucaggcaauccacccgccuugaccucccaaaguguuggaauuacaggcaugagccaccgcgucggcugagaauugacuuuuauuuucacuguguagccagguggaauggucauuaaauggaaagauuuuuuaaauucaucuaagaauuuaauaauguuuuucaaauauucauguaggugggacuaguaaaaguuuuuuggagcagugagggcagauuuuuuuuuuaagaucuaagaugauuaaaaaccuuuuauuuugauuaauauaguaccuagacuuucuuuuucuccuugccacaggauuacuauuaauggagaaagcccaaaacaucggucauggcauacuuuaacaccuauagcugaugauaaacuuuuccuaugugguggacuaagugcagauaauaucccauuaaguaaguugauuaagguuuagccuauaauuauuaucucauucuuuuuucuuaauuguauuucauacuuacagugaaguaaaucuuccuuuuuuccuguuuuucugguuugccuuuauccucaauuauuuucuugcaugaauuaugaucuccuugcuuuuguacccuuggcucuccacguuccccuguuuucuagggaaagagaagaggaagggugauugaagcuagaugaaacaaagccccuuuauacuacuauauucugugauucuguguccgcugauuuuugauccagaugcuuguacuguaggguaggaugcuugcacuguucgcuuuugcuguacuccaggcuaggggauuggaagagcagccuuucuuagaaggcccuggaaauacaaagugggaagcccaguugcuucucuuuuuguuccagagcuguagaggaaaguguuuagcuagguuuuuuaaacuccagucauugcugaucccaguggcuauggguuuuggaaugcaguuuuucuuucagcaguagaacuguggcaucaagauagacagaugaccacgaauauugacuucuuaauuuggcauguuagauguuuuauguuuucuauuuucuuuucuuuuuuuuuuuuuuugagauggagucuugcucuguggccugggcuggagugggauggugcaaucucggcucacugcaaccuccaccucccggguucaagcgauucuccuuccucaggcaccugaguagcugggauuacaggugcccaccaccacgcucagcuaauuuuuguauguagaggugggguuucaccauguuggccaggcuggucucgaauuccugaccucgugauccacccgccucagccucccaaagugcugggacuacaggcgucagccaccgcaccuggccauuuucuguuuucuuaacccagaaguuuucucuggcuagagauguuuucauuaagaaacauuauacacuauuacaacauuuauauaauuauauauuagggucuggaaacaacuguuuuucaacaaaaguuuauugagcaucagcugugugucuggcagucagacaaauuccagagguuaguuggagaaacaacaguuccuaguaggagauguuaguuauucuugcacauuauuauacuucuccaauuugugagauuuuuauuuaaaagagauuuggaaucuaaccaaaaacuaacaucuguacauuucacuaggggcuguuuaauaucauaucuucaugaucucuaguguuuuuaguuccuguuuucuguuuuuggucauugaccuaugggaaauuaaauguccuaacucauaagcuagucaauuuccucccuuaaagauucuguuucagucuaagauuuggucauauggauauuagaugaucccaagacuuuuuuuuuaguuugguugacugugauaauggcauugugguuauguaaaaaauguccuuuuauuuucaguaaugcauacugaaguauguauggagaaaaugaugugagaucuaggauuucauuuagaaaaauuaagcaauaauaacaaaaagauaaguggagcacauguagcaaagucuugauaguuguugaaucugcgauauauggaaguucauugucauggucacucuauuuuuguaaauguuugaaaauuuguaugauaaaauaggugcacucagaaaagauagucauuuaaauguagcaugauaaauuggggggaaaauuaaaauuguaucccagagaccuaaucuuaauuucugaacugucaugauauugcaggugaugguuggauucauaaugucacaacaaauuguuggaaacaacuuacacauuuaccuaaaacaagaccuagguaagucaagaaauugacaaauaguaaaauaguuaagaauuuuuaaaguauuaaaauauaguacugaauuuauaguguuugccauugaaaccauaagccauugagaaggauaucuuucaaaugagcuugauguuaccuaaauaauuuaauuauuauuuuaauuauaucugauuguuagaaaugaucuauccaguuuucacccauacuugcauauuugaaaauguuauucuuuuagguaaaugcauaaucuugccugauaacugugaagauuaagauaauuaaaagcaucauaugagauuaauguuuuuaauguuaauaauuuuaauaagcagacaaaaaugggguuggcuuuaauaguaguuauuuguuuuuggaagagguuuaaagcaaguuaaucaggaaauuugcuuccauguugauccaauggauggcagguuauuauuaaucucuguuaacugcaugauguauucauugaugggaauuuuuugaaaaagaaaauacguuauuuaugguauauuauagaauuaaaaauuuuagaaauuauauacuauuauuaaacuacaaagaaaaccacauuuguacuauaauucuuguuuuuuucuaauuuuauugaauaguguaauaauaucuucauaggaaauucagauucagcacauuaugaucauuauaauugguaauucuuuuuuacgcuauguauuuuagaauuuuaaaaauacagauuauuuaugcuaguguguaaucaauuuaaugauauauauuuuguuauuuaauaaaugacagcuuacuugagaaaaaggccugaaaauauuuauauuuauuuugguauauguaucuauauuaauauucacaguacguuuagaauucauaauugcauuugugauucuuuugucuucauguauaaaaauucauuggaauguauuacuuuaacauuucuggcucuuuugaaauuuuuuuuuuuuaauguaaagaguuuuguacugagacaugggagccaagaguucuaguccuugcucagcuacuaccuacuuuuuuggcuuugaaaagucacuuaaggaaacugagcauuggccaggugugguggcucacgccuauuaaucccagcaauuugggaggccaaggcaggaggaucacuugaguccaggaguuugagagcagccugggcaacauagugagaccccauugcuacaguuuugguuuuuuuuuaauggccgggugugguggugcacaccuguagucccagcuacucaggaggcugaggugggaggaucacuugaucccaggagguugaggcugcagugagcugagauugugccacugcacuccagccugggcagcagagccagacccugucucaaaaaaagaaagaaagaaacugagcaucgauuuuuucaucggugaaauaagagaguuggacuagauaaucucuuaguuuauuccaguuguuugauuguaugaaugcauuauagaccaaaguauuaguaaaaauguuuaauuuuaaaauugcuccuauuuuauauuucaacccuuaaugaguagagcaacacaacuauuaucuauaauauacuguuaguuagaacuagagcuauguaaagagauuucuuuuaauucagcugaugugucauguaaauaauaugcuuuauuagaauguuuaggugauaaguuuagagcagcugugaaaggacauaaacuaucagucuguagaaaaaacaucagguugcaagcuagaugucaccaaaaucaaggcaggaaaggcuuuccaguguucuucgaugaugaaauggccagaguuucccuaaggcagauaagacagaggcagaucuacagguaugaggugaggagaagaacaggugggauacaguugaguguaaggagaacauauauaugugucuauauauauacuaauuuuuauaaaagugacaauuuagcuaagaucuauaagcauuuuguacaaauuuuucaaguuguaauuugaaauguaagcugcccaauucuccucuuagaacucuacagcuagguuucucaaccuuggcauuacugacauuuuggaccacauaauucuuugucaugaggguguccugugcauuguaguauguuuagcagcaucccuguccuuuacccaguagaugccaguuguacuaccuuuucucuccccaacuuaugacaacuaaaaauaucuccauauacugugaaaugccucuuuaggggacaaauugccccugguugagaacgacuguucuacaguguagcacuccuauucucugagucucaccuuagauaaaccuauggcugaaaagccauauauguagccagaucugauagccuauauaguuggcuaucagcaaggacccuuuuuuaugugucugaaaaagauguuagagaaaauauuaguguauagagccccaaguacuguuggaucucgugaguaucgccaagguuacacauagccuucucuccaggaaauuaaucuguuccuucccauguaugagggcauuuuuuguauucucucuccuuuaccuaacccucuuccaguucccauccuugaccccaccacguaaucuggguucuuguugaagauuuauaucaauguaucuucuauaagaguuggagaacugggcagaguauuucccaaacaacaucucuaaugacuuaguuccauuuugggccacaagugcauuugucauugaauguguacacgauuguuugaggaaaguauuugguuuaacgaauugugcauaauuccacuguuugcacuugugaaauuuaaguaaaagggauuaauguacuaaaaauuaguuaugugucccaguuccugggaaguagaaaaaauaaaauaaguugugugguaauaaaauaaguuaugauuuauaauuguuuuagguaucuguugcuucaacaguugguauauuaagaaaaguaaucaaggccaggugugguggcucacaccuguaaucccagcacuuugggaggccaaggugagaggauugcuuaagcccaggaguucaagaccagccuggauaauacagugaaaccccaucucugaaaaaaaaaaaaaaauuagcugggugugguggcgugugccuguaguucuagcuacucaggaggcugaggugggaggaucacuugagccugggagacagaggauggaggaaccagagauugugccacugcacuccagccugggugacagagccagauccugucucaaaaaaaaaaaaaaaaaaaaaacaaggaaucaaaguacucuaaaagucaaagcaaugacuauguaaaaaucccuaauuuacccucuaaaauugggaaauuuuuuugagaguucucuuacucuggaaauauucaacuuuguuaaaccauaaaauuaguauuuggguuuuuuuguuuguuuuuugagauggagucucgcucugucaucaggcuggagugcaguggcaugaucucggcucacugcaaccuccgccuccuggguucaagcgauccuccugccucagccuccugaguagcugggacuacaggcgaaaauuauuauuuguuaauaaugugauauuggaaauagacaugaacuaucagaccacuuccaaaagaauauuagaugcucuacuccuuuaugaaauaauuuguauaucuaaugacugaauauauuauguuguuuuuuucauguucucuuuuguuugguugguuuuuuuguuuuuuuuuuuuuugagucagaguguagcucugucacccaggcuggggugcaguggugugaugucggcucacugcaucacugcaaccuccaccuccuggguuuaagcaguucuccugccucagccuucuaaguagcugggauuacaggcaugcgccaacaagcucggcuaauuuuuuuuuuauuuuuaguagagaugggguuucaccauguuggccaagcuagucuugaacuccugaccuugugaucugcccaccucagccucccaaagugaugggauuacaggcuugagccaccgugcccagccucauguuugcuuuuguuaaucacaaguuuuugagcagcuacuggguacagaacaccacaugaggcauuuuuaagaagccauaaaauuagauuccccagguucccauggugugcuguuaauggccaacaagcacucuccagagugggaggaugcccuaauuuguagcauuugccgauuuccaagguguaaauacuccuaccauggccaauuucaagcuuccaacgugaugucacugcacguggaguuggaugcagauauguacaaucagcuucugcuagccaguaagccaguuugagcacaccacugugacaauuucuuaacuuaaggaccucauaaucuuaguuagcuagucaaacagcuaaaguagcaugcagagcaguucuucuucaaauguaagugaggcaaguauaaaaugagcacauaaacauuaaagggugcugaauagagaugguaacagaaccaguuuuggguggguauuuggaauacuuccuggguguuuggagccuguuuuuaaggcccaguaagaauggcuuauuacucuaagcauaagaaacagagugaacaaaagccuagagauagaugauaagcuuuucucauaggggaagcaagggaaugaauuuagcuaaguagagggcucauuugggaaaagccaagaauuaagauuugugggaaaaagaaacugguugaucacaaauauuaggcuaggaaaacagccauugguagugcagaugcuucaucaucaggaaauuuccaugguuagaggcaauauuugaaaaauauuuguuauuagccauauguagcugagggagaugagagacugaaaaacuaggaacauauuaugguguucuguacucagagugaugaguagugugacaauggaaaugugaaggagugccaaauuggauuuguugggugauggggaacauagaguaggaaaaaaggcaaaaauuauaagaacaguaacaucgcagauaguaauaagaaaacuggggaaagugcuuguuucagcaauaaggugaucaguuccuuuuuaauuuauuucacugcagggauaauauguaugagagaaaaagguuauaaaaauauugaaggauauaguagaguuauuaagagucgucucuggcugcgugugguggcucaugccuauaaucccagcacuuuaggagaccgaggcaggaggauuaucugaucccaggaguucaaaacuagccucaucucuuuaaaaaacaaaaacaaaaaacagagagagagucaucucuuuaauggugugauuuaaugaacucuagaggaaucuuuauaacccuuuuuaggauauuccaaagguucaaguucaaucgugucucuuuuaaauagauuacauuuuagaguaugaaauuuagaauugauuuauauauaauguacaguuucucccaugacaguguuucacucuguuuauaauuuucaaucauagguuauggcacacagccuguuugggaaaagaaaaugaaauaaugguauuuggugggagcaaagaugacuuacuugccuuggauacaguaagaaaaucuuauaucuaaauauuuccucugaguaguuguguuauucacacuaaauggcuauucagcaagaauguugauauucuaacauugcaaaauaugaagggccugaaauguuacucugugguuuaauuaaucuucaggaugacuggcuuuuuuguuuguuuguuuuugagauggagucuugcucugucccccaggcuggagugcaguggugcgaucucggcucacugcaagcucugccucccagguucacaccauucuccugccucagccucccgaguagcugggacuacaggcaccugccaacauacccggcuaauuuuuuguauuuuuaguagagagacgggguuucaccguguuagccaagauggucuugaucuccugaccucgugauccgcccgccucagccucccaaagugcugggauuacaggcgugagccaccgcacccagcaaggaugacuggcuuuuaugaagccuuucuggauauuuuggauuuacaaaucaaaauaggucuauuaguuugauuagcaaaauuauuaagaagaccuuuuaaaggaugacuccucuuucucuuuucucuuacauggguuucucuaauauuauugaauuaaaauauuuguauguaggcuggguguaguugcccacgccucuaaaucccagcacuuugggaggccaaggcaggcaaaucacuugaggccaggaguucgagaccagccuggccaacacagcaaaaaccaucucuacuaaaaauacaaaaaugacccagguguggaggugcaugccuguagucccagcuacuuaggaggcugaggcacgagaaucacuugaacccaggagguggagguugcagcaaaccaagaucaugccauuguacuccagucugggugacagagcgagacccugucucaaagaaauauauauuuuuaucuaauauuugauacauaaaaagaauauuaauaauguagaugcuaaguauaauaaauacccaugaauuuuguuagcuaauuuuagaguuagaacaucaucaguacuguugaagccaccugauuauuccuucugaaucuuaccuacuagcuugccccuucaagaggaaacuacuuuguugaaauauuccaaguauauuauuauuuuuuuuuuuugagacaggauuucgcuguuacccaggcuggagugcaguggcaugaucucgguucgcugcagccuccaccuccuggguucaagcgauucuccggccucagccucccaaguagcugggauuacaggcgugugccacaacgcccggcuaauuuuuuguauuuuuaguagagaugagguuucaccguguuggucaggcuggucuugaacuccugaccucaagugauccacucaccucagccucccgaagugcagggauuacaggcaucagcaccgugccuggccuauucucuuuuuuacuauauaucuuuuaccacugcuuuacucagcuguuuuacauuuaaguuuaaagcauuucaauuuuaaaauuugauaaaacuaaggucagaggcauaaaugaguagcauuuggagaguaugguucuuucacuccuagcacccugggaaauucagagcagggcggccauauuuauacacuauacacaaugggacaggaguucaggaaugauugaugugguuuuguguaggacacucagaaauagaggauucugagccaucagggaugggguauggugagccagagccuaacccagagggcacuagcucccuuucaucucuugaggcacaguuaucuccagagcugcuccuauggaguggcaaacuccaaagcaggauggcuucucuccauggaauuugcuuuauuuuguaguuaugaagccccuaacuuaaauguuuuguauauugaaaguuuuagagcuuucuuuggcugagaauucagugcuucacuaaaagauuaaaacuacaacuucgcauuuauuaaaaaagcaaauuuugugguuugucuucucuuucuuggcacuagaaaucuucauuuaggauacaaaguuuaucaugaaaguaggaauucugauuaaaagcaugaucauaaauuaugaaauucuaaagaccuauuugaaaggauuagauacauuuucugugacuuuucuaccacauuaacuuuuagaugagagacucauuauucaaauaaucuuccagaucuugacuuucaaauuaagaauucccggggagggcugggcgugguggcucacgccuguaaucccagcacuuugggaagcugaggugggcagaucacccugagaucaagaguuccagacuagccuggccaacauggcaaaaccccaucucuacuaaaaauuacaaaaauuagccaggaugugguggugugcaccuguaaucccagcuacucaggaggcugaggcaagagaaucacuugaacccgggaggcagagguugcggugagccgagaucgcaccaccgcacucuagccugggcaacagagcgagacuccguccuaaaaaaaaaaaaaaaaaaagagaauucccggggaaucuugagaccaccuggaaaaggaggacaagguaaagaggaaauuuuuacauaugaguuauuugaaagaaaaaguucagcuuaaaaacaaaaaaagugccaggcgugguggcucauaccuguaaucccagcacuuuggaaggcugaggccggcagacugcuugagcucaggaguuugagaccagccagggcaacauggugaaacccugucucuacaccagcuggacgugguagccuguuccuguggucccagcuacuugcggggcugagguuggaggauggcuuaagccaggaaggcagagguugcagugagcucugauugcaccacugcacuccagccugggcaagagagccagacccugucuccaaaaaaaaaaaaaaaaaaaaaaagguuugaaaaccacuacugggcugggugcgguggcucacgccuguaaucacaacacuuugggaggcugaggcagguggaucaccugaggucaggaguucgaaaccagccuggccaacauggcgaaaccuugucuauacuaaaaauacaaaaaaaauuagcagagcaugguagugggcgccuguaauuccagcuacucaggaggcugaggcaagagaaucgcuugaaccugggaguuggagguugcagugaguggagauugcaccacugcacuccagucugggcgacagagcaggacuccaucucaaaaaaaaaaaaaaaaagaaaagaaaaccacuaccguuauuuuuuaacucacuucucggugaagaauguauuucuuauuuucaaauuugcaauuauguaggcuauugguuagguuaaaauuuggucacugaaaauuggaaaccacaaacucaaaguuuguagguagcagguauauguauguacauguauguuuaugugugugcaugaauuuaugugugugugucaacagcuagaaagauuuauuugcugccuuauacaauaucuuuuacauuuauaaaauuaagaaacauucaauuauuaacucauuguuauuuuuaucaaaaacuuaauaaugccuuuuuuguguugauuagggucacuguaaugauuuauugaucuuucaaacacagccuuauucacuacucagguaagcaaauuuaauauuuucuauauauuugcuaugaguauaugauaauuucuuucucauuuuugggaagcauugaaauauuuuucagguugcuuaugacaugaauucaagaauauguucacaucuuccuaagaguauaaucaaauuuauaauggugaacuauacaccaaugugaguuuuaaaaauuaaaauauacaugcguggcgugaugacuuacaccuguaauugagugcucugagaggacaaagcaggaggaucacuugaggucaggaguucaagaccaguguggguaacauugugaaacccacgacucuacaaaaaaaaaaaaguagcuggcaugguagcucacguguguagucuuggcuacuguggcuacuagggaggcugaagugggaggauggcuugagugcaggaguuugaggcugcguugagcuaugaucauguuuccuguacuccagccuggaaauagacugaaagccuguauauauguguguguguguguguguguguguguguguguauguacacauacaauacagucacuguuuuguuuguaaaauugccuuuaguuuauaugguaauauuaaacauacuauauuuccuuaauucuaagccugacauuuuucacauuuuaacuuuuuggaaauuagagugugccuaauaauauauaucauauauauguuauauagucauuccuugguauuuguggggaucgguuccaggaaaacccccacuuggauaccaaaauucauggaugcucaagucucuuauauagggugauguaguauuugcauauaaaccuaugccuauccuacuauauacuuuaaauaaucucuauauuacucauaauuccuaauacaauuuaaauacuaugaaaauaauuguuacacuguauuguuuagggaauaauuacaagaaaaaaaaagucuguacauguucaguacagaugcaacugucauaagccuaacuauauuuucaaucugcaguugauugaauccacagaggaggaacuuacagauacagggggcugacuguauauacacacauacacagauauuuaauauagaagaauuucuuuuuuaaccccaaagcuaguauuaaguugguguuaugacuuguagugucuuaguucauacauucuuacucuaaaaggagucuguacaaaguuuagugggaggauuauggaagaagccccuauuucuaccugugagaguugggaggaaggaggcaggauuugagagauguagaaguugcccagugaacaagugugggaauuuuaugcagagggaauaacauaagugaagacauaugagaaagagagagauaaagagaggggacaaguuauauuucaaggaguauacugugacauuuagauguucuauaacaugaaccaccugaaaaccauuagacuagcucaaacuggaccuuucugacgucuuucuuaacuaccccuucucuuagcacaguaguucucaaacuaaacucucaugaggggcuucaaaaaaauuaaugccuguguucugccccuacagaugaugauuuaauuaguccaggguguggccugcacuuuggauugcaaguuccucauaugcagggaucaagaaacacuugagugccuacuugggaaggcacugugccaugaaauaagaaggcauggccuuucccuaacauugcuaauaauauagaagguagacuuucaagcuuccagacuuuuucuacaauagaaaaaggaaauugccuuaagagaaacauauacaaaguuuaugagaauacuggagaagaaggccuuuugucugucuaugauuaagauggcaaagguuagggaagucuuugcagaagaaggauuugagcuaagaauuugccaugaacaaacagugcaaggguguuaguguaaagauauauacaaaagcauaguauguucuggauacugaauucuugagcauuccuggaauguaguaugaggcagagaguugcaagaaaugauguuggacaagaaaucagaaaucauaugucaucuagaacuuuaucucucuuuuacaguaucugguguaaagagaucaagagccauugaaaaauuuggagcaagagaauaagaugaucauauuacaaguuagacaauuccucuggcaacagaguggacgaaaaauugaagggauaugugacuggguaaagaaaauugguaaagagacuauuacaguggucagguacagagugaaugucugaucuggaaaguaucaauggggcuggagaaggaagggagauggagauauuuaggagggagaauggacuugguaguuaaauagaugccaaggaaaaggaguggggagaauuaaugauaggaggaauauggagaaaggcagcagucugaagauggcauaaggguagaaaugaugaguuugguuuuggacgugcuaaguguuuaugggaacuguaguggagcuauccauuaaaugcuuaaauauauggaaagaggucugggccagacauaaaauuucauaaucauuggagaauuaguaaguguggauuagcucuggccaggaggaguuuuagaaguaaggagaaagccagcaacucagcauuaggaccuuacuacauuugagggggagggagaagaaaaggaggcagcaagagagugaccagagaaguugaaggcuagccaggagauaaugguagcacaaaaaccaagagaagggagaucugaacaaggaaagacuaaagagauccuagaacauuuggauugaaaagcacuguggauaguacauauuuucccucaucuccauuuucacagucaaggauccagugucuguagucucacuucucaccacugcuuccagguuacaucauuucacaugcagguguugccaucuacuaaccuccagcucauuuucccccagucacugaggacuuuggcccuggcucaccacagucccuuuucuugacugauuuuagcaucuguguggagaacucuuuucauucuuuaugaccuugcucagcacaguuccaccugugaaaucuuaaacucccauccuccucuuggaccagaaaccucuuauccuguuaauucuuacacucccuuacuccuuggacucuucucgguucuccaaauaauaagacccuuccacccuuccaguuuuagcuuucucucuuuuuuuuuuuuuuuuugagacggagucucauucucacccaggcuggagugcaguacgcgaucucagcucacugcaagcuccaccucccggguucacgccauucuccugccucagccucccgaguagcugggaccacaggugcccgccaccacacccggcuaauuuuuuguauuuuuaguagagacagggguuucaccauguuagccaggauggucucgaucuccugaccucgugauucacccgccucggccucccaaagugcugggauuacaggcgugagccaccacacccagccuuaacuuucuuucauauccagccuaguucaccuguacuucuuucucuugccagcaauuuuaauccccuucuccaccauuucucuguuagugaagggugacuucuggggaagagcaccaagaccgagggaggaugaguauguuuguuuauaugccgguugggcaggagaagccaauggagaguagguuguuagaaacacaagaaaaugcaggaaaagcggguagagcagugucuugagaaggugauuuuagcaaacagauuuuuaaauuaguccuugacuggagaaaggauucuuuucuuuaaaauaguggagaaagaaggaaguauggauauauagauagaaaacuuuuuugguuggggugggacauugagaaguucuaguugauagugaggucaucugauaagagaaaagagaggugaggauaagaacuuaagaugaauggugaagauuugaaguagcugccuaggugacugcaggaagaugcugacgucugucugcgggauauauaacaaaguagcacgcagcugagguagaauaucaucaauauguaguggcaccauagcugagaaacauggcuuuccccaguagcacuaaacagcugggucgcaggugcagaaaggagaugacuggcugaauuuauccaucauugcaguuuggcugggauggguaacaaacggugaaggggauuaaaauugcuggcaagagaaugaagugcaggugagcuaggcuggauacaaaagaaaguuaaaacuggaagggucuuauuauuuggagaaccgagaagaguccaaagaguaagggaauguaagaauuaaaaggauaagagguuucugguccaagaggaggaugggaguuuaagauuucacagguggaacuguccugagcaaggucauaaagaaugaaaagguuucuccacacagaugcuaaaaucagucaaggaaagggacuguggugagccagggccaaagaccucagugacugggggaaaaugagcuggagguuaguagauggcaacaccugcaugugaaaugauauaaccuggaagcaguggugagaagugagacuacagacacuggauccuugacugugaaaauggagaugagggaaaauguguacuauuuucucaagaaagcugcacacacaacaauuuucuuagauuucagaaagucagaggaagcagggguguuuauagaacauacagcugguguuccaaaaagcaaaaaacccagguuugggaggggagauaagcaaugaugcagaagaugaaaaaguguagaaaugauaggaaguggcuuauaucgucuaguagauuugugggaucauguucaucuuaccuuuggauauaaaagaauauuauaagaaauuaaaagaaauagcuauauuguucugauuguaaaaagauguauuuaccaagaaaauucauacgauaugaaaaguauauaguaaaaaaaucaccuaugagccaucguaggggguauauauauacauguauuaguaaaauuauaaaaauuguacauguauauauauguauauauauacugagagaaauuuuuuuucuuuuuuuuuucuuuugagacagagucucacucugucaccaaggcuggagugcaguggcgcaaucuuggcucacugcaaccuccgccuccuggguucaagcaauucuucugccucagccucccgaguagcugagauuacaggcacgcaccaucacacccggcuaauuuuuguauuuuuaguagagaugagauuucaccauauuggccagccuggucucgaacuccugaccucaugauccucccgccucggccucccaaagugcugggauuacaggcgugagccaccccgcccagcagagagagauuuuauauauaaaucauuuauauaaugaucaauauauaacccuauauacaugauuuuaaugauuuuauuaaaugauuagagugaacuuaaucaugcuaagaggucauuggaaaccucagcaagagcaguacacauauauguauaugugaauguauaaaggaucaaauuaugcagucuguuuuguaauaucuuucauguaaauaaucauucaguauaauaaaucuauacuuaaguuaguaauggcuauauagguucuaucucguggaaauacaguuuauuggcuaggugcaauggcucaaaccuguaaucccagcacuuugggaggucaaggcagguggaucacccaaggggcaggaguucggaguucaagacuagccuggccaagguggugaaaccaugucucgacuaaaaauacaaaaaaauuagcugggcaugguggcaugcgccuguagucccagcuacucgggaggaugaggagggagaauugcuugaaccugggaggcagaggcugcaguaagccgagaucacauuacuacacuccagccugcgcaacagagugagacuccgucucaaaaaaaaaaaaaaaaaaaagaaauacaauuuauuaacuagucuauuauauuuaggauaucugcaauuugggaauuuggggcuacuauaaaaauuaggcaucaggcugggcgcagugaggccuguaaucccaacacuuugugaggccaaggugggcggaucaccugagguaagaguucaagaccagccuggccaacauggcaaaaccccaucucuauuaaaaauacagaaauuagccaggcgugguguggcacacaccuguaauaacagcuacucaggaggcugaggcaggagaaucgcuugaacccaggagugggagguugcaguaagcugagaucaggccaccacacuccagccugguuaacagagaaagacuccaucucaggaaaaaaaaauuagucaugaaauauucuuauauauuacuauggaaaacugauguaucacauguuguauugugaugauuccugcuuggcucgcacugccagagacaaacagcagauuccuucgcaugguccucagggccuccauuuaucugucucaccucuggccaugccccacucgcgcucugcccuccagcuguauuuagacaauagaagugcaguuucuguaaucuuauuucucgucucuagggcuuugcaaaugugguucuucuagcuggaauaccuuuguuucuuuaauuuguugaggaccucaaggucucagcuuggaccuccaucuggagaguuuccccuggcuugcuaagguugucuuaguuauucuucuccucugauucccacagaacccuguaccucuacuucaaccucucaggacauuuuaacucacuucuuguuuagaguuguuccagaguggagggaaaaagcuucaaagaguagagaagaacaucuaaaucucuagaguauaagugcuuguaaaaaugacagcuaaaguuacccacagcagaaucaaaugagucuguuaaaaaaauuuuuaacacuuauuuuuuugaauuaaaguuuauuaauugaaacagaugcuuuuuugauaguucuuaaguuucuugugguuuuaaaguacaaaaugcucuucaaaauagcauaagauuaaaaagggcauuguacuuggaaggauacugcccucuagucuaauggaaucaaaggggaaaagaaaugaacacccacgcccccagaagaguagaaacccaaguggucucuuggcacuuccuguaucgcuccauuccugucuuucacccugcucucucugggucaaauaagucaaguguguaacccccgugcaguuguuuauggaagaaacauggagcagauauaaaaauagauguuucaucuugaggugacagaagcaaaggacaguucugugagaaggguauaugguuauugggcugacugaaaggaugacauaaacaggagcugccauagacucaucugguuugaaauuaagucugaaucauuuuuacuuaaagaacauuaugcaugguaagccauauauucuguuuccauuggauuuuggucagauuuagucucuaugcuauaaaaauauaugauuauuauggugcucugggaaaaaaaaauccuaucauguuccaaacaaaacaaaugaaugcauugccauguaaaauuuuuaugaugauuuuaaauuuuaggaauacuuaacuauaacaaaggauaaauguuugaggggauggauaccccauuuucuaugacaugauuauuaugcauugccugucuguaucaaaacaucucauguaccacauaaauauauguaccuacuauguacugacaaaaauuaaaaauuaaaaaaagaucugugaaaguccaauacuacaauguuaaaaaagaaagaauucuuaacuauaaauauuuuauauuauaaccucagguucaagacuaauaauucuguuauguuuuauuuacaggucaugccuugacugcauugguaaaaauucuaucauguuagaaagucagauaucuuuauuaccuccuaaacuucugcaacaaguacucaaaaaaauaacauuuugggcugcagcuaaucaccgagaagaacaaagaguccaaaaagaagaaacagaaaauaaauaucaguggaucaguagcaauuaaauuguuauauacuuuacauauuuaguauguuuuaacuuuuuaaucagacuauacauuuacacucccaaauugcaggcuuuauuuaaaggauaaaauuuaaaggauaaaaaaacagucacucuguuaagugacuauaugccaugggauauauggaaaaaagauauuaaugcagauuaauuuauauuuguaaacaaauuuccuuacaaacugcagaacaaauauucuuucugaaaguaaguacaguuauaacagauuuuaaaucaauguguauucuuuacuggaaagauuacauacauuugagaauaagaaauuacucucaagaacuucagaaaucugcaacauaauuuuauaaauauauaaauacauguauguaugucaaaacacuacauauacacuuucagaaagaauaaacuuucucaagucauuuuaaaguuaccuaacguucuucuugaauaacuaauacagugggucaaauauuauaaaauaggcaaacaccaaaaugguauuaaauauugaacuccugaccuuuucgacacuuaccuaguaaaguauucuuaggcaucaucauaacuuuuccucaccuuuauucgaauagaggaauaaaugucuucaguugucucuccauuaccccuaaguuauuaguuugucuaguuuauauauaaagaccauguuuuaaaguacauaaaguggagguuuauuuaucauacaggcuuugaaacauuaagaagcaguauuuuuauuaacuuuuugagacauauuaaaauacauuuugccuuagaagacugcuucuaaaguaauuuuuguaaguaaugagaugggaugguaaucuaguaauuugacuuuauagaaaucccucaguuuggcccccaccauucuacagaguuguacucaagacagauacugaaaaaaucuaauaccuucccuuguauuuucagcauuaccaucuauacagaaauggaacacuguaucuuuauauuccuaaaaaugguacuuuuggcauaauuaagaaauuuuucuucauauuaucacaaucaugcccuuccauugaauuauuaauuacaauuaauuacuaaaaagcuugguauguaaaauuauucuccacaauauuaccaugcaaguuaucucugaaauuuaaaauguuaaagaaaaacauuucuauauugaaauauauauaauuuauaaugaaaauuauaguaguuuguaguauuucauugaauuuuagagagauauuucauauauauguacuguauuuuggauguguaaagcuucuauguauugaaauauuuuuuuacguuuuauuuauuguacaaaguguauauaauuacuguuuucuuuuuugucaguguaaagcagucauuagaauugauuauacaaaaaaua

SEQ ID NO: 192358 - RNA, 69796 nt, Homo sapiens
gcuaaagagcgcggguccucggccguggagggucaaguggcuucuucugagcgcugagggaggggagcgugcguaggggauggugccagcgcugcguuauuugguuggugccugcggacgggcccgcgggcuuuucgccgguggcuccccuggggcgugcggguucgcgucugggaggccaagaccgcuguguggagguagccgcagcgccagcaccaggugaguggccgcugguccuccccgccgccugcgcugcugccccucgcggaggcaccuggugguggaccugugccccuguucguauuucccugucccggggugagagcagguugggguccuguggcacuccaaccucggaucccaggagcuaccaaccugcagguucauucguuguauuuacgggccggaggaaaggcaguguauagaguagaggucgggaguagcucuggcuuugaacaacccguccacuuucuguugaacucugggcuaguuacuuaaccuccuuaaaggcucaguugugaauuggaccuuagucucuccuguagguggucauuugaaggauaaaaggaccuagcacacaguauaagcaaucaaauaugcucuuuauaagcuggagucuuuggcguugcuuggaagaucugaauacagucuuaaaucaguuccuggcacaccccgcauaguguugcccccgucggaggcagcucuuaugcuaaugaaagcccgcagaauucaguguccugugauuuauaguuuggacgucacauucgaaaccauugucuuucucuguccucuguagaagaaacaguuugugugaaggcuguaaggcuuggagagguuuuggcuauuuugacgacuagaaggugggccauaugagugugacugaaguuuaguggaagacauaugguguggaaugacccagaaggacuacaucacagcaagguuuuuaguuuauuuuaaccacacguugacuuuuauucuaagagccacgggaagcuauuuaaaaggguuuuaagaagaggcuacgcuuuaggaggccgaggcgggcggaucgccugaggucagaaguuggagaccagccuaaccaacauggugaaaccccgucucuacuaaaaauacaaaaaaauuagccuggcgugguggugggcgccuguaaucccaacuacuccggagccuuaggagaaucgcuugaaccugggaggcggagauugcaguaagcugagaucgcaccauugcacuccagccugggcgacagagcaagacucugucucgcaaaaaaaaaaaaaaaaaaaaaaagaaaagaaaagaaaaaaagaagaggcuaauaauuaaauguugauguucuaaaaguugacucuggcugcugcguguugguggauagggggaguagagugggauaccaguaauagcgauugugauuuguuauggggcauguggacaguucuuuugggaagcuuuucuuaaggaaagaaaaguagggcuagugaaaguuuuguuuauacuuaaaauguuuuuuuaaaaaauuuuuggagucagggucucacuguguugccaaggcuggagugcaguggcacaaucauagcucacugcagccuccacccuccugggcucaagcgauccucccuccucagccccccuccccaaugcuuccuguccuccaggagcugggaccacaggcagcuaauuauuuuccuauuuuuuuguagagacguugcccaggguggucucgaaccccuggccucaagugaaccucccucuucagccacccaaagugcugagauuacaggugugagccaccgugccuggccuauacuuuuauuuugaaguaauuauagauccauuggaaauugcaaaaauaguacaggccaagcguggugacucaggccuguaaucccagugcuuugggaggcugaggcaggaggaucacuugagcccagaaguuugagaccagccugggcaaaauauaagaucccuucucuacaaaauaaaaaauaaaaauaaauaaacaguacaaagagaucccauguacccuucaccccauuuaccccaaugaaaacaucuuauauaacuauaguacaauaucaaaacuaggaaauugauauuggcaaaauccacggacauuguucagcuuucaucaguuuuacauauauucguguguguguguguguuuaguucuaugcaguuuaaucauauguauuaauuuguguaacuaccaccucaauuaagauaugaaaauguggccaggcaugcuggcucaugccuauaaucucagcacuuugggaggccgaggugggaggauagguugagccucagaguuggagaccagccugggcaacaaagggagacggcaaaaccccugcucuacaaaaaaauuaaaaaauaauuagccaggugugguggcuugcuccuguagucccagccacuuguggggcugaggcaggaggaucgcuugagcccaggagguugaagguguggugaccugugauuacaccgccgcgcugaagccuggacaacagagcaagacucucuuaaaaaaaaaaaaaagggugguauaaaaauauucuauugccacaagguuaucuguuguguuaccuaucucuuuauauucacaccuuccucuccauucuuccuaacucuuggcaacugugaaucuaaauuuuuuuuuuuuuuuaacacgaagucucgcuuugucacccaggcuggaguacaguggcaugaucuuggcucacugcaaccucugucuccuagguugaagggauucuccugccucagccuccugaguagcugggauuacaggcaugugccaccacgcccagcugauuuuguauuuugaguagagauaggguuucaccguguuggccaggcuggucucaaacuccugaccucaggugauccacccgccucagccucccaaaguauugggauuacaggcaugagccacugcacccggccugaaauuuuuuauaucaccaaauauucaguauaaaacuuuuagaaaaaggacaagaucuuuggacauagagaugacaucaaaagcaugaucucuaaaagaaaaaaauugacaaaauggacuucaucaaaaugaaaaacuuuugcucugcaaaagacuguuaagagaaugaaaaaacuaccaagacgugggaaaaaaauaccagcaacugcauaucucccaaaggacuaauacacaaaauacauaaagaacucucaaaacaagccuuuggagauuggcuuuuuuucacacagcauacuauccuuaagauccaugcaaggcgucgccuguauugauagcagguuuuucaaaauuguugaauagaauuccaugguauggauacaucacaauuuguuuaaccguuuaccauggguugaagaacauccaagcugcuuccaguuuuuggcuauuacgaauaaagcuacuaugaacauucauguucagguuuuuguaugaacauaaguuucauuucucuggaauaaaugcccaagacugcaguuacugagucauguaguaaguccauguuuaguuucuuuuuaagaaacugccauacucuuuuccagaguggcuguacuauuuuacauucccaccagcuaugugugaguaauccaguuucccuucauucucaccagcauuuggggugaucacuuuuuaaauuuuagccauucugauagagacguagugauaucucauugugguuuuuauuuacauuucucugaugcaaugauguuugaacaaugcauugacuaaugguguugaacaucuuuucaugugcuucuuugccaucuguguaucuguccucuuugaugaaauauuuguucauaucuuuugcccacuuuuuuuuuuuuuuuuuuucugagauggaguuucgccuuguugcccaggcuggagcgcaguggcgcggucucggcucaccgcagaggccuccuggguucaagcaauucuccugccucagccucccgaguagcugggauuacaggcaugcgccaccaugcccagccaauuuugucuuuuuaguagagaugggguuucuccauguuggcauggcuggucucaaacuccugacgucaggugauccgcccgccuuggccucccaaagugcugggauuaaaggcgugagccaucgcacccggccugccuacguucuaaauggcuuguuuugagaguucuuuuauguaugaguccuuugggagauaugcaguuacuaguauuuuuuuccaauuucuuaguuuuuuuauccucuuaacagagucuuuuugcagagcaaaaguuuuauguuuugaugaaguccauuuuaucaguuuuuuuucuuuuauggaucauguuuuugaugucaacucuaagucccaagauuuuguccuauuuuuuccuaaaaguuuuaaagugaauauuaggugauguaaaaaauuuuguguuaguuuuuuuaacuauaaugguaguguguguuuuuagagaugccuuuuagaaauaacauugaaauauuuacagaugaaauaaugugguguuuaagauuugcaucaaaauaauauaauacaggaggggaugaaauagaguauagaagaagcaagauuugcugugaguugauaauuagugaagcugggugauguauauguggggcuucauugaacuauuuugucuaacuuuguguagguaugaacuuuuccauaaaaagcuuaagaaaauuaucuguuaaaccauucauugguguuaacuugagauuaagugaguuguagagaaagaugucucuuucagccuccgugguuagcuuggccugcaacuguccuccagcauucaucuaugacuauuguucuguucaccugucuccauaguggaugcuuggagauuugugcuuuuguuugugaaacauauuucaaugauuuugugucacuggauaaaacagugauucuucagauuugagaagagggagugaaggguggcacauguaguuggaaaaagcauauucaguaugauaguuuuauguuugaaaauaagaaggguuuauugauaguuguaguauaaucugcaaagacaauaucuuggcugggaaucuguaccaagguaauaauucuaaguggaaggucuaccuccccaaaagcuuuuguguuauaauuaucaaaaggcagcaaggggccaggcgcaguggcucacgccuguauucccagcauuuugggaggccgaggcggguggaucaccugaggucaggaguuugagaccagccugaccaacguggugaaaccucgucucuaguaaaaauacaaaaacuagcccagcauggcaguguucgccuauaauaucagcuacuagggaggcugaggcaggagaaucacuugaaccugggagugggaagcugcagugagccgagaucaugcugcuacacuccaaccuaggcaauagagugagacccugacuccaaaauuuuuuaaaaaaaaauuuucaguauaaacaaaacuuucaccagcccugcuuuucuuuccuuaagaaaagcuucccaaaagaacugucuacaugccccacaacaaaucacaaucacuguuaacugguauccgacucuacucccgcuauccaccaacacgcagcagccagagucagcuuuuagaacaucaacauuuaaucacuagucuccaucuaaaaaaaaaaaaaaaaccccaaaacaaaaaaaccccccaaaaaaaacaaaaggcagcaaggaugagaagcauuauuauggaagucaagaccaccccuguaagggccaagguuaugcuaccuuuuacagaaaaugagccuugaaggcaaaacauagcaucauaguugaacuugaaaguaagaaagaaaaacaguaugaaagauaucucucuuauacacacacugccauguaauugauauagauaucaacuugauaaauuaaaaaaauacagcugggcacggugguucacaccuguaaucccagcacuuugggaggcugaggugggcggaucacgaggucaagagauugagaccauccuggccaacauggugaaaccccgucucuacuaaaaauacaaaaauuagcugggcaugguggcgcgcaccuguagucccagcuacuugggaggcugagguggaagaaucgcuugaauccgggagcuggagguugcagugagccgagauuaugccacugcacuccagccuggcgacagagccagacuccaucucaccgaaaaaaaaaaaaaaaagucagucaaaacagucaguccucguuuuuguggguucugcaucugcagauucaaccaacuauggaucaaaauauuuggaaaaaacaguaaaaaauaacacaauuuaaaauacaguauaacaacuauucacauagcauuuacaugguacuauguaguauaagugauccagagaugacuuaagguauauuggaggauguguguagauuauaugcaaauacugugccauuucguauacaagacuugaacauacguggauuucgguauccaugggaguccugaaaccaauccccuguggauauugagggaugacuguauauaaaauaugauuaaguaauacacauacaaauaucuuaaguauuuguaaguguuuugaacaccuaccuuaguggaagauuauagagguuuugaaaaauaaaaagccuaucuuaacaauaguuauucuggaauucuuaaaagccaggcuauuuuagaauccauaaaacaucuguuuauugugaaaguuguguaaagggucaaucuguaaaucaguguaaguaccuaguggaaugugaaugcuuuaccuuuuauccacugaacuuauguuuuuuuaaaaccugcuuaaaggcuuggacuuccaaauacauucugaucacauuaguaauuuuuuaguugaccacuguaggcauuugccaauaacuaguauuaauguaguggacccagaaucccauuuuacuugugcugcucuuuuuaugcccucucuuuuuaaaagugggcaucauucaccauccuugacaaccauuuuauccaaucuaaagcugcugcaggagaaccaccugcugagcaucaccuggagguucucccuguucaaguauaaggcuuaugcucugacagagggaacuuuauccacuuaugacccccaaguuaauuuaagaugcaggauuugauuuaucaagcuuacguguuaguuccuaguugucuaggaucuguuucugguuccagauacagccaaagaugugguagcaauucuaaucaaauugaugugcuuugcuaaggauuuugaaauugaaacuuagaucacuuuucgaagaaagggccuaaucucugaaauuucccucugucuacaguuccuauaagauccauauuuguuggcuaucaggucaguguuaaagguaaucuuuuaagcuucgaauugcagauuuauauaaauuauacaugguuguucuaaauuuuuuuuuugagacagagucucgcucugucgcccaggcuggagugcaguggugcaaucuuggcucacugcaagcuccgccuccuggguucacgccauucuccugccucagccucccgaguagcugggacuacaggugcccgccaccacgccuggcuaauuuuuuguauuuuuaguagagaugggguuucaccguguuagucaggauggucucaaccuccuggccucgugaucugcccgccuuggccucccaaaguucugggauuacaggcgugagccaccacgcccggcccuaauuuuguaaaugguuguauaaucaggauuugccauggcaaagauugugguuccuaagcccauuucuggaccaauuauugccccaagguuuauuuucucggaguuguuuacuucucaaagaaaaacuuguaaaaauucuugcacacuaaaguguuaaagcuuuaauguguuaacacauugucaagaguacuacauuggaauuuugaaaggcuggguaguagaaucaugacuaugcuuaacacaaaguauagucaugcaccgcauaacaacauuuuggucaaccacagacugcauguacaguggugauaccaaagauuauaauaccauauuuuuucuguaccuuuuuuauauguacacauuuuuagaugcacagauacuuaccauuguguuacaguugccugcaguauucaauauaguaaccugcuguacaggcuuguagccuaggagcaauaagcuaucccauauagccuagguguacaguaagcuauaucaucuagguuuguguaaguacauucuaugcuguuugcacaaggaaaucgccuaccaaugcauuucuuagaaccuaacccuaugguuaagcaacgcaugacugcagucacuuauguaaccagccuggcugccgugcuauggagauaaagagcagauugggcaaccagcuauccugccugccaguaagcuguaguugauuauacuacugaccagugaugcguauaacuuuugagguuuuuuuuuuuuuuuuuuaaugcgucuaacuuuuuuuuuuuuuuuuugagacagggucuggcgcugucucccaggcuggacuggagugcaguggcaugaccucggcucauugcaaccuccgccucccagguucaagcgauucuccagccuuagccucccgaguaguugggauuacaggugccugccaccacacccagcuaauuuuuguauuuuuaguaaagaugggguuuuaccauguuggccgggcuggucuugaacuccuaaccucaagugauccacccaccuuggccucccaaagugcugggauuacaggcaugagccaucacacccaggcuugauuaguauaacuuuuaaggguuuuuuuuuuuuaauacaugugaaaccaaacagcacagggcccaauacauugcucugucgccuugcucugucaccaggcuggagugcaguggcgugaucuccacucacugcaaccucugcuucccagguucaagugauucuucugccucagccucccaaauagcugggacuacaggcacgcgccaccacgcccagcuaauuuuuguauuuuuaguagagacgggguuucaccauguuggccaggauggucucgaucucuugaccucgugauccgccccccucggccacucaaagugcugggauuacaggugugagccacugcgaccggccgccgaauacguuuucaugauuacaaauuaaugguuuaauuguccauugaugaaaauuaugcaugugaaguuuggcgaggucuacuguaaauaugaauuacuuuaaagaugacuuucuuuugaagcucauuugauauagucaucguugguggcggaauuguggggcuugccucugccagagcacucauccugcgacauccaucacuuucuauugguguucuggaaaaggagaaagauuuagguauguauauaaucaauguuguucuuugggcuuacuugggcaucugcucauuuugucuguugugaaucuuucaugcugaaugucaguguuaguuucuuaguuuguguucuaaaagcagagugugggacaaggacauggcuauagguuauuugagagguuaaagccgagugugggacaaggaggacgugucuauagguuauuuauuugagagguuaucucaggaaacaggagugagggggugaggaaaguaagacagggaaggaggaaaagacaugagaacacaucaagauuguggcugugagcuugauuccaccggagccucugaggagcaauguaguauuucccaggauugugcucacuuuauccaucggcucuucucucuauugguugaggauugccgcuagugauguugagcaccccgugcccuucucuaaaaaaguuaccagaggccccaaggcagagugcaaagagcccuagggggccccugaagugguuugcugguaaugagaggugaguuugugcaccaaaguuguaguugaaaucagagaugggcuggagggaugugacauggauaccagggauguuagaagaaguuaccagugaucugaacaaauucaggcagaauuuuacaugauguggucucuaauagcuucaacuauaaguuuguucucuuaccucuuauguuuuguaugaaucauguacuuacucuuacccuguuucucuuguucuguagcuguucaccagacuggacauaacaguggugucauacauaguggaauuuauuauaaaccugagucucugaaagccaaauuauguguacaaggugcagcccuccucuaugaguacugucagcaaaagggaauuuccuacaagcaguguggcaagguauggcauuuuauuagagccuugacuaauuuccaacuagcauuugcuuagugauguuuaauauuacauuuuuuaaaaauguauuuuuuucuuuguaucuauguaauuuuucaaaucuaaucuuagggaauaacuaaaaaaagauggugugacguuauguaauuuucuaaauaaaaguuuuauugacauauaauuuaugcaccauacaauucgcccuuuuaaagugcacagaucaauuuuuaguauauuuauagagcugagcaaucaucaccacuaucuaauuucaggcuuuuucaucaccccaaaaagacaccccauacccauuagcagucacuucccauuucuaccucccccgaugcccuagcaaccacuaguauacuuucugucuuuguggauuugccuguucugcacuuuucauauaaauagauucauauacuauguagucuuuugugacuggcuucucucacuuagcauaauguugucaaaguucaucccuguuguagcaugaaucaguacuucaugucuuuuauggcugaacaauauuccauuguauggauauaccacauuuuauuuguucaucaguugauagacauauggauuguuuccaccuuuuggcuauuauggauaaugcugcuaugaacauucauguauaaguuuauuugugaacauauguuuucauuuauauugguuauauaccugggaggggaauugcuggauugucaggguaacuccauguuuaacauuuugaggaacugccaaauuguuuuccaaagcucugugcuauuuuacauucccaccaguaauuaauaaggauuccaauuuuccauguccuugccaacaucuauuuugguuugucuuuucuauuuuagccauccuaguggaaguuuugauuugcaguucccuagugauaaugauguugagugucuuuuauuuuuuccuuuuuagaaaauaguucuugagcccaaggguuugagaccagcucgggcaacauagugagacccuaucucuacaaaaaauuuaaaaaguuagccgggugcgguggugcacaacuauagucccagcuacuugggaggcugaggugggaggacugcuugagccugggagaucaaggcugcagugauccaugauuaugccacugcacuucagccugggcaacagagugagaccuugccucaaaaaaguuaaaauuauuauuuuuuaacuuuauuucuuauuuaaaaguugagacaggaucuugcuuuguugcccaggcuggucucaaacuccuggcuucaagcacuccuccugccuuggccuccugaagugcugggauuacagaugugagccacugugccuggccuaaaauuauuuuuuaauugacaaaaauuguaaauauuuaucauguacaacauguuguuuugaaguauguauacguuaugggccgggcaggguggcucacgccugccuguaaucucagcacuuugggaggcugaggcaggcagaucacuugaggucaggaguucgagaccagccuggccaacauggugaaaccccaucucuacuaaaaauauaaaaauuagccgggugugguggcacacgccuguaaugccagcuacucgggaggcugaggcacgagaauugccugacccugggaggcagagguugcagugaggcgagaccacaccacugaauuccagccugggcaacagagugagacucugucucaagaaguauguguacauuguggaauggcuaaaucaagcucaccaacauaugcauuaccuuucauacuuauuuuuuuuuuaugaugcaaacacuuaaaucuacugucugagcagucuucaagaauauaauacauuauuaacuauaaucaacauuuuguguaauagauauccugaacuuauuccucuuacuuaacugaaauuuuguguccuuuaacaaauaucuuuccacaccaccccugccucccugccacccucagccccugguaaccaccauuccacucucuaccucugugaguucaacuuuuugagauucuacauguaaaugagaucacgcaguauuuaucuuucugugcuugguuuauuucaccuaagauaauguccuccagguucaucucuguugucauuuguggcauggaccauuugugacaauagagaugaacauggaggauauuaucuuaaguauuucucauuaucuuaaagauuuucuccuuuuuuaaggcugacuggucuuuuguuauguauccaccugaacuggccucccacaguguugggauuacaggugugagccaccacgccuggccugauuguaugguuuuugucauucaucuuguugauaugaugugucaccuugauugauuuacauauguugaaccauccuuugcaucccuggguuaaaucccacuuggucaugaugaaugaucuuuuuaauguguuguugaauuugguuugcuaguauuuuguuaaggauuuuuguauaguguucaucaggaauauuggccuauaguuuucauuuuuuugaugugucuuugucuggguuugguaucaggguaauaccagccucauggaauguguuuggaaauauuuccuccucuacuuuauggaauaguuugaguaggguuuaguauuaguucuucuuuaaauguuugguaaaauuuagcagugaagccaucagguucugggcuuuucuuuacugggagacuuuuuauuauggcuucgaucuuauugccuuuuauugguuuguucagguuuuggauuucuucaugguucaaucuugguagguuguauguguccaggaauuuauucauuuauucuaaguuuucuaacuuauuggcauauauaguuggucauaguagccuuuaacaauuuuuugaauuacugugguauugguuguaaugucucuuuuuucaucucugauuuuauuuauccgggucuucucuuuuucuuagucuggcuaaagguuugucaauucuauuuauccuuucaaaaaaccaaccuuucauuaaucuuuuguauuguuuucuuuguuucaauuucauuuauuucugcucugaucuuuauuauuuauuuucuucuacuaauucugaauuuggugugcucuugcuuuucuaguuuuuuaagaugcauuguuagauuauaugaaguucuucuacuuuuuugauguaggugcuuauagcuauaaacuuuccucuuaguacggcuuucgcuguuucccauagguuuugguauguugucuuucuauuuucauuuguuucaacagauuuuuaaauuuccuucuuaauuucuuuauuggcccacuggucauuuaggagcguauugguuuuguuugcuuguuuguuuauuuuuuugagauagagucucugucucacccaggcuggaauauaguggcacuaucucacagaucacugcagccuugaccucccggccgggcaugguggcucgcaccccuaaucccagcacuuugggaggcugaggcgggggaucaccugaggucaggaguucgagaccagacugaccaacguggagaaaccccaucucuacuaaaaauacaaaauuagcugggugugguggcucaugccuguaaucccagcuacuugggaggcugaggcagguuaguugcuagaaccugggaggcagagguuguagugagcugagaucgcgccauugcacuccagccugggcaacaagagcgaaacucugucucaaaaaaaaaaaguccucccaccucaaccucuggaguaauggggaucacaggugcaccaccaugccuggcuaauuuuucuuuuuuuuuuuuugagacagagucuugcuguuacccagccuggagugcaauggugccaucucagcucacugcaaccuccaccuccuggguucaagcaauucuccagccucagccucccaagucgcugggacuacaggcucacgccaccaugccuggcuaauuuuuguauuuuuaguagagaugugguuucacuauguuaacuaggcuggucuuaaacuccugacuucaagugaucuacccacccaaauugcugggauuacaggcaugagccaccaugcccagucauuuuguuguuguuguucguuuugguuuuuuuuuuugaguuaggaucucccuccguugcucaaguuggucucaaacuccugggcucaagugcucaagugauccucucaccuuggccacccaaaguguugaaauuacaggugugaaccacuaugccuggccagaggcauauuguuuaauuucuguguguuuguauaguuuccaaaauuccucuuguuauugauuucuaguuucauuccauuguggucagagaauauacuugauauaauuucauuuaaaaaaaauuuuaaagaccuguuuuguggcccaacauauuggucuauccuugagaaugauccaugugcuggggagaagaauauauauucuguagcuguuggaugaaacucucuguaaauaucuguuagguccauuuggucuguagugcucaguaguuuauucuuugugaugcuuuugugaggagaauuguuuuccuacuuucauuuuuuauaauucauugcuaaugcauagaauaugauugauuucuguauguugauuuuuuuuaauccagugaccuuucugaacucauuuuguucuaauuguguguguaugugugugugugugucuaugaauuccuuaggcuuuacuauaugcaggaucaugucaucugcaaauaaguuaguuuuacuucuuuuccaauuuagaugucuuuuaacuacuuauucugcuugccugauuuccauggguggaagcuccaauacuguguugaacagaaguaguaaaaguggaccuucuugaauuguucuugaucuaauagagaaagcauucaaucuuuuacccuuaaguaugauguuagcuguggauucccuuuaucagauuaaggaaguuccuuucuauuccuaguuuguugaauguuuucuaucaugaaaagguguugaauuuucucaaaugccuuuucugcuucuaucaaggugaucaugugguuuuuauccuuuauucuauuaauguaguguauuaauacauuuuuggauguuaaauugauuuuacauuccugugauaaaucccucuuggucaugguguaaaauccucucuauauguugcugcauucaguuuauuaguauuuuguucaggguuuugcauuaauauuuuuaagggauauugguuugcaauuucuuacgauaucugguuuugguaaaaggcaaaauauuuuuucuuucugaagagaaaccagagcacugguuuuaguaucaaacuaauauuggccucacagaauuaguugggaagugauucuuacucuucuguuuuuuggaacaguuuaugaagaauuaguauuacuuuuuuuuuuaacaucugguagcauucaugaauaaagccucugggccugggcuuuuuuuuuuuuuuuuaaugugggaaguuuucaaucacuucauguguuauagguuuauuaaguuuuucuucucaaauccguuucagaaguuugugucuuucuaauaauuuguucaucuagauuuucuaauucguugccauacaguuguucauaguauucuuuuauaaguccuuuuauuucugcaguguugguagucauguccuucauauaaguuuuuuuuuuuuuuuuuuuuuuuuugagacagggucucacuuugucacccaggauggagugcaguggugcaaucucggcucucuguagccuugaccuccugagcucaagugauccucccaccucagcccacuaguagcugggacuacaggugcacaccaccacacucagcuaauuuuuuuguauuuuuuuguagggacagguuuugcuauguugcccaggcuguucucgaacuccugagcucaagcaauccaccagccucagcuucccagagugcuaggauuacaggcaugagccaccgugccuggcccuuauaauuuuuaagaauaaaagcucauugucaccauuaaaguugcuaugaggcugggugugguggcucacgccuguaaucccagcacuuugggaggccgaaguggauggaccaccugaggucaggaguucgagaccagccuguccaacauggugaaaccccauuucuacugaaaacacaaaaauuagcugggcaugguggcaggcgucuguaaucucagcuacuugggaggcugaggcaggagaaucguuugaaccugggacgcagagguugcagugagacgagauccugccauugcacuccagccugggugacaagagcgaaauuaaaaaaaaaaaaaaaaagaugcuaugaaaaaaaaauuguagggcuggacucaguggcuuaugccuguaauccuagcacuuugggaggccgagguggguagauugcuugagcccaggaguuugagaccagucugggcaaugugguaaaacgcugucucuacuaaaaaaaaaaaaaaaaaaaaaaaaaaaaauuagccgaguguggugcacaugccuguagucccagcuucuagggaggccgaggugggagaaucaccugagcucgggaagucgaggcugcagggagucaugacugggccacugcacuauagccugggcaaugggagugagaccuugucucaaauaaauaaauaaauagaaauuuuaaaaauagauacaaauuuuuuuaagagacagggucuuguccuguugccuaggcuggagugcaguggcacaaucacagcucacugcagccuugaacuccugggcucaaguggucuucuugccucagccuuugaaguagcuuggauuauagacaugagccccugugcauggccacauuuuaaaaaacaauucaguaaaaugggccugacauaagugaaaaaggcaagauauaaaagucuaguuacaguuuuuauuaugaguuguaagaauucuuuacauauucuaaauacuagaccuuuaucagcuacgugacuugcaaauauuuuuucucauuguguggguugucuuuucacuuacuugauagaguccuuugauuccacuucuguuuuuaagguuaauuauuuauugauuuaaauagccuuuauaccuugauuaaaagugucaccucaugaaauucuguugccucuuugguaugaaauaaugacuugugaauucuaauauaccuucgaauaugcaccuguguuuuccuuugccccuuucuuuaaguaaagaagaaacuguaccucagauauuuuucccauaaauaaauagaaaagaaauaaauaaguugaugaauugacuguuuucccccugcaacagaauguuuuguaaauacuuuauaauauauuccaaaaauaaaagggauuguuuugucaguuauguuccaucacauucaguaccaguugucuuucugaugugcugauauuuuacauuuuccugaagaaauaagaaggccauucuguuuugggggggaaaaaaaguaaaguccaagcaacuuaugcuucucuccuuucuggguuugagaaugugguagugaugaguugcuuauggccaagaugcacauagagacuaugauaacagaaguggaaauugaagcuacauuucauuuuuagggaaaauuuguuuuaauaacauuuucuuaagacaacuuuucuugguggaggaagaaaauagucaugaagaaaggaagaauuagauaugugaagaaaaaauaauuuuaaaaaauuaaccuccuuugggucauacaauaguugaugauuuuccauugacuuuaucuuucaucgcugaugauacauucaccucuauccaugcuccuuaccuuuuuuuuuuugaagcuuauaguagcuguugaacaagaagaaauucccagacuucaggcccuauaugagaaaggccuccagaauggugucccgggccugaggcugauccagcaggaggauauaaaaaagaaggagccauauuguaggguaagugauuaacaaagggauguuuuuauuuagggcuuaguccugagacauggaggcugagggugaguguauaggaggcaggaauaauauaaaaucaguuagauaauccugucacagaaguagugaagugacagacacaagagggcauugucacaaacucuggacaccugauuucuuucucugugagaaaauaccaggucugaccaacaugaagacaagaggaggccugagaccacauggcauguuuggaaaacacugagcagugaggugugguugggagcauuggguauguagggaaauauaagagaugagacugaaaaggcaggguuaggcccacauaaaggguuuggcauucauguuaauaacauugaaguuuauccaguaggcacggggagccauugaacauuuuuggaggagggcagcuguagugucugaucuauacgauaggcggauaaggcuggcaugaguuugauccuccugccucgaccucccaaagugcugggauugcagcauuucacuuucuuaauauugucuucagauuaacagaaauucuuaauguuaucaauuuaugcauauguuuguuuuuuuaugguuaguguuuuuugugcucuaguuaaauuuucuggaugcauucaaagacuugguaagaaaaauaaaauaaaauagaaaaaaaaagaaaucuuugccuagcccagggucuagaagauauucuauguguuuuucuaaaaguuuuauuguuuuacauuucacauuuagaucuacaguccauuuggaauugauuuuuauauaugguauaaguuaggggucaagguguauuuuuuccccaaacagauauccaguugugucagcaucacuuaucaaaaaaccauuauuuucccacugugcugcaguauugccuuuaugauaucagguauguggcgggucuaugucuggacuccauucuguuccauugccucuucugugcuacuaccauaauguuuaauuauaauagccauuuuuuuuuaaauggguucuuacucugucacccaggcuagagugcagugacgugaucacagcuccccaugaccagcuaauuuuaaaauguuugaagagacagagucucaccauauugccuaggcuggucucgaacuccugggcucaagugauccaccuguuuuggccucccaaagugcaaggaauacaagcaugagcuauaguagcuuggacuauaguaguuuuguuuuuuuuuuugagaugcagucucucuuugucacccaggcugaagugcagugccaccaucucggcuuacugcaaccuccaucuccuggguucaagcaauucuccugccucggccucucuaguagcugggauuacaggcacccgccaccacaccuggcuaacuuuuguauuuuuauuuauuuauuuauuuugagauggaguuucacucuuguugccaggauggagugcaauggcgcaaucucagcucaccgcaaccucugccucccggguucaagugauucuccugccucagccucccgaguagcugggauuacagacaugcgccaccaugcucggcuaauuuuguauuuuucguauagacaggguuucuccacguuggucaggcuggucuugaacucccgaccucaggugauccuccagccucggccucccaaaguucugggauuacaggcgugagcgccuggcccuauaguagcuuuuuaauaggccugaauaucugguagaguaaggccuuccguuuuuuucuucaacauuaucuuggcuacucuuggaucuuuacauuucuacauaaauuuuggaguuaauuugcuaaacuccacaagauaaccuguuaugauuuugacugagauugcaaugaaucuguaugucuguguggagacaauuuacaucuuuguaguguggagucuuccaauccuugaacuucauauaucccucccuuugucuggaucuguuuuaauuuauuacauaauguauuuuaauuuucaguauggaagucuugcauggcaugucucuuauauuuauuaucuacaaagaauuuguauuugauguuuucugauacucucauuaauaguauuguuauuuaaaauucacuuuuuauuuguuuguugcagguauguggaaauauaauugauuucugaccuuguauccaacuuucuaguuaaauucguguauugguucuaaauaauuugucuagaaauucuuuuggacuuuuuauacccagacauuuuaucugcaaauaauaacuauuuauuucuucuuuucuaauucauauacuugguugauccaauguuuaauccuaguuuguauaguuuuauauguguuuuuuguuuauuuuuacaagcugcuucauccuuucugcaaaaagacaagauagaaauguauuuuuucaaguccaggaaaaauaaaagcuugaaggaaaaaaaauguauuuuuucccuuuaucucuaguuguaaaguuaaaguugggucaaaauaugcaagauuuucugaauucauguaaagcuccuaagacgcugcugguauccaggagucuaaauaguguugaaugaguucuuccugcagagguuauagcaucuucgucuccagcaagccaccuauuccuuuccuggcacccagucaggauaaucaaacuauuuugcuugugggauacacuaggucuuguuacuucccauuucucuccucaaauauuucuuaucucucugagauagugaauuagugacugauuuuuuuaaguagaauauuuucauugaccaucuuauuuuggccaccugcuuauuucauacucugagcaaauucuaaauggucaaagucuuggcaaauucuguccugugggccaaauucauccugccaccuguuuuuguauggccugaaaacuaaaaauguuuuuuguuuguuuuuuuuuuuuuuuuuuuuuuuuuuugagacggagucucagucugucccccaagcuggagugcaguggcacaauuucggcucacugcaaccuccgucucccuggguucagcgauucuccugccucaggcucccaaguggcugggauuacaggcacaugucaccaugccuggcuaauuuuuguauuuuuaguagaaacaggguuucaccauauuggccaggcuggucucaaacuccugaccuugugauccgcccaccucggccucccaaagugcugggauuauaggcgugagccaccgugcccggccaugcuaaaaauguuuuuuacauuuuaaguguguuaaaaaaauuaaaagaagaacauuauuuugugaugaauuaaaauuauaugaaauucagccaggcgugguggcgugugccuguagucccagccacuugggaggcugaggcaggagaauugcuugaacccgggaggcggagguugcagugaguggagauugugccacugcacucaagccugggcaacagagagagacuccaucucaaaaaaaaauauaugaaauucaaauuucaguguccguaaaguuuuauugaaauacaaccgcaaauauucaguuauguauugucuguagcuguuuuaacgccaaacagccucauugaguaguugcaacagagaucauaagccuagauagucaaaaauauuugccaucugucucuuauaaaaaagguugccuacccuugaucuaaauagcagauagcuaccgaaggacuugagcagaaugcugacaggcaaaagguacuaauuuaggaaauuuaaucaaauuugaauauguaagauggaacuggacguggggagaggagaaccaaagccacuuauuguuauuuuugaauuaucugauuccaauaauucucagucuuaagggaguuuuuuuuguuuguuuguuuuuguuuuuuuuuaugagacggagucucacucugucacccaggcuggagugcaguggcgugaucucgacucacugcaagcuccaacucuuggguucacgccauucuccugccucagccuccagaguaacugggacuacaggcgcccaccaccacaccuggcuaauuuuuuuuguauuuuuaguagagacaggguuucaccuuguuagccaggauggucuugaucuccugaccucgugauccgcccgccucagccucccaaagugcuaggauuacaggcgugagccacugcgccuggccgacuuaagggaguuuugacauauuauccuuuacuuuaucuugcuguauccuucaacuuuuugaaauuaacuugcaucuagcauaaggugagcaguauaauguagcuguugauaagucagacagacauaagcuccauucucacaucugccucuuuaauggcuauuaacauugaguggguuauaaucuuucuaauccucagacucauuuguaaaauggagauuguuuugagaauuaaaugaaauacuauguauaaggcauucggcuaaacguuaaucccuuaagaaaugguauauauuauuauaugcuuuuuugaacaauccuaguaaauucaaauugguuuuguuugaaauauuuggggacuuuucauuucugcuuucuuuagcuuuuuucugccuauaaagccagccuccucuggucagcucauuagagugcucuuucuaaaucuaugaaugaggugcucccugaaucaugaauuucuaauaaagcuaauuagaucuuuaaacuaaauuuguuauaauuuugucuuuuaacacacucaaugguuuuguaacgcacuguguagauaagaaacaggauaauagauuacccuguuaagauaauuaagaauauuuaguuauguguauucuucccccuguuuguauuuccccuuuuccugauguguuacauuuaauuuauuauuuuauucuguuuauuuucuuuaaggcauaucagucuuuuuuagagugagauagccuauuuuaaaacaauagagauccuagcauauuauaaaacuaggguugugaauaacugauauaagggcugguuguuuagacugauguuaugcuucaaggaaaaaaaaugcuaguauuaaaauuaagaaauuaggaggcuguuauauaugugggagcagagaauauaugggaaaucucugaacuuuuugcucaauuuuucuaugaauuuaaaacugcucuuaaaaaggagucuacuuaaaaaauuuagauuaaacccacuuucuguuucuuaucuauacagugcauuacaaaacuauugaguguguuaaaagacaaaauuacaacagauuuaaagaccaaauuagcucuuuuagugauucaugaauuaaggagcaucucauucaaagauuuagaaaaggcacucugaugagcugaccagaggagguuggcuuuauagacagaaaaggguugaagaaagcagaaacagagaacaaaaagcagauugguuguuucaaaguuacuuuccuauaagguuaaaacagaggccaggcacaguggcucacgccuguaaucccagcacuuugggaggccgagguaggcggaucaucugaggucaggaguucgagaucggccugaccaauauggugaaaccccaucucuacuaaaaauacaagaauuagccgggcaugguggcgcaugccuguaaucccagcuacucaggaagcugaggcaggagaaucgcuugaaccagggaggcagagguuuuggugagcugagaucgcgccauuggacuccaaaaaaaccagagaagacuuccuuaucaagcuggcuaaaaccagccuguuugugaacuuggcuguuaguuaucucuugugauuucuuagaaggucauauaaacaauuugguuuccaucuggugaggaggauuuuagcaugagagacuccauuuugguuuggucuguagaggucuaauacagaagcucaaugcaaaacaacagcuuccuauacacguuauuaaacauguccuucccgaaaauagacuaaaucuauugcuguuucauagcuuuauaugauuuugauggaauucaauugugaaacuaauauaucagaaucucacauauuuucaaaaacccagaaaaaaggauuuugaauuuuuacaacacaaagaaauuauaaauguuugaggugauugauauacuaauuacccugauuugaucauuacacauuguagacacauacugaaauaucacuguguuccauaaauauauacaacuauuggcugggcaugguggcucaugccuauaaucccaguacuuugggaggcugagguggguggaucauuugaggucaggaauucgagaucagccuggcaaacacgguuaaaccccgucucuacuaaaaauacaaaaaauagccaggcguguuuuugggugccuguagucccagcuacuugggaggcugaggcaggagaaucgcuugaaccugggaggcagagguugcagugagccaagaucgcaccacugcacuccagcaugggcaacagagugagacucugucucaaaaaaaaaaaaaaaaaaaaaaaaggaaaaaaauaaaaauauaauuaugugucaacuaaaaauaaaaguuucaaaaauuuaaaaaaaaacuuucauugaugugcuccuaucaaguauuaccuugaagaaugaaagaauugauaaccuccuucaaaaggacaugccaauuuuuaaaaccuuuuaauuuuuauuugcucaugaaaagucuuucaaauguaagaugcauaucaaaaaaaaaaaguacaucugagcugcuggccccauuauagauuuggucaugaaaauaauuuaauuguagaguuugaaaaacaggauuacugguauccuaaugguacugaaauuuggagaauuggucuaucugauuguugccuguuguguauccuuguuaaggcuuuaaagagaaaaaaucggaacaggaacccaugauuuuuuauauuaugcauuacugaaaaaaacaaaacuuuucagauguuguaaaaguuauggaugagucuggauauuguucucuguaccugaugaggugaccaucacagguccuuggaaugaggucagugagauaugugugcauagguaaugaaauuauauguauuacacauauuuuugugucuuauaaaugaagaaacuuuacuuucccagggucacacagcucccaaagaguugcccaccucaagaucugacucagaacugguauuuuuucuguuugguucaaccaaagguuuuuugauuacuaugugccacacacuauguuaggcacuguagauagauaagaagaugaauaaggcauggcugucaaccugaaggagguuauaguguaaaagaagauauagugauaaguauucugauagagcugguacucucucuuauaccaauguuaagggaaugcuuuuagcuuaguacaauuguuuaagaaagccucagagacaaacccccacuugaaagaugaaugaguaaaauaacuuacaaaagaggcauauucugcuucucucugaggccuccacagaagugauauauacuuuauaugauuccaaguuguaaucauuaguguuucauauauuuagggauggcaauauauaguagaacauguaguuugguuauuuucuaaagauguuuugaauaaaguccuuccuucccugccaaccuuaccacugcuauaggaauauuggguaaaaugcccauuguacggggucacuuguuuuuuuuccaggccacccagaaagaaguuuaccaaggcagcucuaaagagcuucuuagaccaagucccuuuaagaaaaccaaguaucaucggggagaggcccuuggaaaauuuuaaacugccucuguaaacuuugacuugggaggauaacucuuuuuauuuuuuuuuaaaguacuucuugcagagcagggcuaccccauaagcgguaugcccagaguagccgaagguaacucuugacugcucccucucugggcaaauccucacugcuacucugcccucuggucugcuuuugccauuuuguuagcacuauuggucaaucacauguucaucuguuccucuguauccugacuugagaucuacucucaauuuucccuguccugcuugucugguucuugccugguucugaucugccaaggccucagauuucagucucugaccugcugaccuggacaguucaugcccaaccuccugggugacagacacagccagccugucuaccaacaccaccccaacuuggcagccucuaccuuugcagcuagucccaggccagagcauuggauugcauggugaugaugacucuuuucaccuuucuacaacacacauguauagguggggcacaccagcaucuuaggaggagaggaaaggccaagacuagaaagagaaagaaaagaagagacaccuucuagggaaggucuggaauggaguaaaggggauccucuauguuuaaacacagcccucaaauucaauccuucaguaaauguuugagugucuucagugugucagacguugugcuggguaauaggagcauaagaugaauaaggaagcuauuuggaauugcaaaaaacuauugauugagaauuaagcacuuuuacagaauguuuuuaucccucuguuauacuugucacauaauuuuaugguagguaaggaaguuuucauggacuaaucucuugguauuauccuaagugagcuucuaagauuauuguacccaaaauauuguuuauagauugaaguugaguuacuggcaugugaauuuagucaaugacuaggucuuauguuuacugacuguaucaaaacagaaggaaugauuuccuaugcuuggcaaauacucuuauauucuagaaaugagacugucaggaaaaugaugaaguuugccaaacauugcuuucaauuuguuaaaaaagagacuguugauguuuugggagucuuuacccucagugugaccuggucauuagaaaacauuggucccagugggauagcaaagagaaaaucuuuuuuuaaagacgaagucucacucuguugcccaggcuggagcgcaguggcaucaucucggcucacugcaaccuccgccucugggguucaagcaauucuccugccucagccuucugaguagcugggucuacaggugcccgccaccacguucggcuaauuuuuguauuuuuaguagagaugagguuucaccauaauuggccaggcuggucucgaacuccugaccuugugauccgccugccucagccucccaaagugcugggauuauaggcgugagccacugcgcccggccgcaaaaugaaaaucuucuaagggccaagcaggggaauauguuggggugauggucagguggugaauacaagagugagaucuuuacaauaguauuauaucagauauuauuuuaaaaccaccacaacaauaaugcugugcuggccaaaugagaggauggcagaauuuauuaauagcacucaccgucuggauguuauccuggauaccaggcuacccucuuggggaaauugauugggagaacugauauauacaaaaaaaggcaacagaaaauggugcuauuaacaaugaucaccaaaauguagucaguacuuagugugugaaauucuccucuuauccuuuucuuuagaauuagaaacggccaaugacacguucaacauuuauucuaaaaaaauaaaauaagcauguguuauauaggucauucaucuacagauugaugaacauugauuuggacaugucuuuagggacaaaaacagaaacaaacaaaaaaauccaggcuauuaauuucuuguauuaccugaagaaaaaguuugaguuaaccacauaaaaucuccauuccauauuuguagucucaaagauagggucugggcagcaagucaaagcaaugcucuggaaacauugugaguagcuagaacaacucuugaguucuuacuaaguauggacaacauaguauauacuacugggaaaaaucucacuagagcuuauuuaaaacauaauuguuugaugauacguaauucaacucagaaucagauaugaaucaaaucagaaucagguauggugagggauaauaaauggaaaagaaaaacucauuguagcagcaagaaaagcuuggcaaaaucaacuccucuaaaggacaaaauuguuucuugauuauagagauuuuguuauuuagcaaguauuauuucucuuaucuguuaucuuuucauaauucuguuucagggucuaauggcuauugauuguccacauacuggcauuguggacuaucggcagguggcuuugucauuugcccaggauuuccaagaagcagguggcucugucuugaccaauuuugaaguaaaagguauugaaauggcuaaagaaaguccuucaagaaguauagaugguaagccauccuugucuuuucuauugaauauagucagcccuccauauccauggguuuugcaucugugguuuuaaccaacugaggaugaaaaauauuugggaaaaaaaacaauaaaaaauaauaguagaauaauacauaauacaaauaaaaaagauaguauaacaaaaaaauagcauuuacauugcauucgguguuauaaguaaucuagaaauuaucuaaaauauccagcguaugugcauagguuaugugcaaauguuauaugcauuuuauaugagggacuuaaguauccuugaauuuugguauuugugggguuccuggaaccaauccuccuuggauacuaaggaacagcuguacuuauauugauuuuuuuuuuaauugggauauuuuaggggguagugcuggugggagggccacauggagcuaggcuagaguauggugcagaaccagagguagguacagaaggugcagacugaaugugagagaacugggacuccuggagggucuugugcugguagaaccaggcggugguccgacacuucugacuggugcuaaaaucugaacugccaaggcuguuuauggaaaauuugucuccaaacacuucccuacccuguagauuacagucagaaucucuugacaaugcuuguuaaaaaugcauuuuuuuuuuccccuuggggcagggucuugcucuguugccuaggcuggagugcaguggcacaaucccggcucacuguaaccuucaccucccaggcucaagugauccucccaccugagccgcccaaguagcugaaacuauaggugcuugccaccacacccagcuaauuuuuguauuuuucuuuuuuuuuuuaauuuuaauuuuuauagagacaaggucucacuguguugcccaggcugguaucgaacucccgagcucaagugauuuucccuccuuggccucccaaagugcuaggauuacaggugugagccaccgugcccgucccaauuuuuguauuuuuuguagagaugggguuccaccauguuccuuaugcugcucucgaacuccuggacucaagugaucugcccacuugaccucccaaagugcuagaauuacgggcgugagccacugugccuggccaauagcuaacauuuauuaagcacuugguccuuuccaaguauuaacucauuugacuuuuacaauucuccguggcaggguaccauuauuacucacauuuuuuuagggugagaaaacaggcacagagagaguaagaaacuuggccaugguuguacaaguagugaguggugggguuuggauuucaacucauagacuguaccuaaagcccacauaguuaauuacugaacuauacuggacccacacuauguuccccacaagcugaauaacgagcaagaauuucagauuaacaaagaugucagguggaaagcuucauugguuuaaugaagacagaagaguuccagaaauuggugguuagaaugaaggaaaaagacuggcuaugaagcacaacaggaagguggaagcuaagaggcuggacuaggaaaguaggacaccaagguaauugcagaggggaggucuaggaaaggguuucuuaauccugacacuauugauauuggggccagaucguucuuugucguagggggcuauccggugcacuguaggauguuuuguaguaucccuggcuucuguccacuagaugccgguaccaucacgcccccaagugaugacaauuaaaaaugucucuaggcuaggugcaguggcucacaccuguaaucccagcacuuugggaggccgaggcgggcggaucaugaggucaagagauagagaccauccuagccaacauggugaaaccccaucucuacuaaaaauacaaaaacuuagcugggcaugguggcucacgccuguagucccagcuacucaggaggcugaggcaggagaauagcuugaacccgggagguggagguuacggugagcugagaucaugccacugcacuccagccugggugacagagcgagacuccgucacacacacacacaaaaaaaauaaaaaguaucucuaaauguuggcaaauguucucuuagaguugggggugaaggaaucacuccugguuaagaaccauugcuccagacuuacaauuagacuaguuugaacaaccaggaauagagauaaaccaguagacugaaaaaaggacaaagaaccaugaacugaagaauuuugaaaguuccuauaaaaccagaauuuuauaacuaugaaugauaauuuauuuuuauuuuauuuauuuuauuuuuuuugagauggaguuucacucuuguugccccggcuggggugcaguggcauaaucuuggcucacugcaaacucugccuccuggguuuaggugauucuccugccucagccucccaaguaacugggauuacaaacaugugccaccccaucuggcuaauuuuguauuuuuaguagagacgugguuucaccguguuggccaggcuggucuuaaacgcuuaaccucaggugaucuuccugccucagccucccaaagugcugggauuacaggagcgagcuacugcacccagcuugaaugacaauuuauuauacugcuggaaaggagagaaaaaaauuuucaugacaugacaucuccuuuuuggcuugucuauauauaucaacauguaaauuagucuuccagugugcuagacuuuaccacuccuaaggaacacauaccauucuggagaauuuuuuuuuuccuuuuucucucccuuagaagucuggacagcaaaucuaauugugaaguuaaaauuugcacaaguacuuugagaggccaaggaaggaggaucacuugaggccaggaguuuaagaccagccugggcaacauagcgagacccugccucuacaaaaaauuuuuaaacguucacugggcaugguagcacacaccuguacuuccagcuacuuaggaggcugaggcaggaggauugcuugagcacaggaguuugaggcugcagugagcuauaauugcaucacugcacugcagccaggccgacacagugagaccuugucucaaaaaaauuuuuuuuuuagggcugggcgcaguggcucgcgccuguaauccgagcacuuugggaggccaagguggguggagcgcuugagcucaggaguucaagaccagccugggcaacaucgcgagaccccaucuuuacuaaacauaaaaauuuuuuuuuaauuaaauaaaauaauuuuuucuuaauuugcaaaauccuaugggacucagauguacagcuuaccgguauaacuauucagguucuguaucucuaaauggcaaacguagucaguaggaaaauuggcaaaccuggugucuaugugaagaguacaggacugaacugauccuuuuuauugauagcuguaaauaugucuauauaaagcagugaccugggaggcgcguuggcucacgccuguaaucccacacuuugggaagccaaggcaggcggaucaccugaggucaggaguuccagaccagcuuggccaacaugguaaaacccaucuccacuaaaaauacaaaaauuagccggguguggugauacgugccuguaaucccagcuacucaggaggcugaggcaggagaauugcuggaauccggugggcagaggcuguagugagcugauauugcaccagcgcacugcacuccagccugggcaacagagugagacucugucucaaaaaaaaaaaaaagcagugacccauguggcucagucuuagagaggugucagggucacgaaggaguaauuucaaaagaacucuuuugcuuguauauuucuuuuuuuuuuuuuuuucuuuugagacggagucucacccuauugcccaggcuggagugcaauggcacgaucuuggcucacuccaaucucugccucucagguucaagcaauuccccugccucagccuccugaguagcugggauuacaggcaugcaccaccaugcccagcuaauuuuguauuuuugguagagaugggauuucaucauguuggucaggcuggucucaaacuccugaccucaggugauccacccacuucggccucccaaaguucugggguuacaggcguaagccaccaugcucagccugcuuguauguuucaagaaccaugaaagggaucgaagcaaucuuuuuaaauaugcuuuuuccucuuuacuuucuuccuucuuuuuuuuuuuuuaaauaauaaaaagaguugaggucucacuauguuguccaugcuugucuugaaccccuaagcucaaacaaccugcccaccuuggccucccaaaaugcugggauuacaggcaugagccacugugcuuggcccaaaaugcaaauguuagcaucacccauacuuacugaaucagacugucuggaaauagcaccuaguaauaagccuuuagugauucuuagacacauccaaguuuuagaaugucagaaugacagccuaaggucauaaaaugaccuggccauuuggaacuccccccaccucaugcccagcccccacaguuuaagaguucacuuagaguuuguuuuguuuugcuuugagggcauuaauuuuuuuuguccaaaugauagauuugugagccuucuauuugcuguugagaaauuugaaggagaaaaaaaguaguguucuguucuuucuuccuugacagguuuuuaaggagaucuaagccaucugaaucauucugucuuucugaauucuaagaugaugagcaaaauuguuaaauaauuaagguuguuuuagguagguagcauaauaaaccaaauuugugauacaaguagauuguauuuaucugcucuacauacgcuuuauaaaacuuugagaucccauguaucugagugggaacuaauuuuaaaaauggucaauuuuuuauuagaaguuuuuguguugugagaacucuugcuuuucuaaacaacauagaaccugcaaggaauccaguaaccaacacuuggaugacaagguuucucauaucauagcuuuagucugugggaaaauacauacugauuuaugauuauccauuuuacauugcgguuuccaggauuauaguucagagaauagcuaugucuauauuggaggucagguggcauaugguuuauaagcauagauuaggugaauuaaaaucaagcuaaaaacaugcuggaguuuuauauguuguuaaguaugaacuaguuuaauuguuauuugguaaaaaguuucagaaugaacuguaaggugcaaucauaguaaugacagaaaaagguuauuuaaguuuguuucuaguaugauauuucaaauaauguuggccuuuugcuaaaaauaaauuuuucacuuauucuuuuuuuucaggaaugcaauauccaauuguuauaaagaauacaaagguaaagauucuuaagcaaaacugcuggcuacuuucuuucccuccccuuuauuaaaaauuaaauuaacccacagggcuguauuuuaaguuauugaaugacauuugucuaauguaauucugagagaauuucuuuuagggaaguuuaacagcuuuuauucuaaggaggguuucaacuugggaauguccuaauuaaguggcucugcuggcaaagaacaggauuauaagcauauggaguguuuaauuuuaaggcaaaacuaauauuuuaucacucuaucuacugaucuccacuaacuuauuaacucucuauaaaucagaagacuucggaagagggaguaugcagguuguccagagggagauggacugcuuuuauucaucuucacauggaccuaaagcaagaaccacugaauggcauagaagcaguggauucccuguagguucgcugcaucaaguuguacucaagggagcagagucauuaaugagugcuauaggauuuauuauaggaauaagaccuuacacaauuguggaaguuucugggaaagcauagauucagaagagaguugauggaucaguaauugggaaacagagcugaaugcggagcuggaauucacuggacaguggguaucugucugucaccucauuggacuaggaugaccuucagagaauaauaccugcugauuuacuucugccaccagauuauuauuauuauuauuauuauuauuauuauuauuauuauuauuauuauuauuuugagacggagucucacugugucgcccaggcuggaguccauuggugcagucuuggcucacugcaagcuccgccucucgggugcacaccauucuccugccucagccucccgaguagcugggacaggcgcccgccaccacaccuggcuaauuuuuuuguauuuuuaguagagacgggguuucaccauguuaaccaggauggucucgaucuccugaccucaugauccacccgccucggccucccaaagugcugggauuacaggugugagcuaccacgccuggcccucugccaccagauuauaugcaucuccuguuuugaccaaguuuaaguuggaaccaugaagagaaggggauucugucaagcauaguuccuagcuuaaccaaauggacucaguacaaaccccuacaguccacccuuugucaaccugacaucuguccacgccccuuauaaccuuauaacgauauuuagcuuccaaauaaagacagaaguaaaaguaugcuuccaccuaacaagguguaacuguccuucauaggacugaagacaugcuaacuaacucucaaaaaaaaaaacaaaaaaaaaacagucuacuuuauccauccuggauuauguuuaauuucuacuagcugaguuacacucccccuuugagauccugucacuuaaauaccaagauauaagguuaaccacuauuuaagcauuuuauauuagauuaguaguucucaacuagaggcaauuuuacuccucggggaacauuuggcaauguuuagagacauuuuugauugucacaacugggaugggggagggacacagcuacugggauuugguggguagauaccaggaauguugcuaaacauccuucaguguggggaauaggccuccaaaacaaagaaaugucuagcccccaaagucaguaguacugagguugagaaacccuguguuagauaaugugggaaugguagagaugaguguauuagucuucucagacuuccauaacaaaauagcacaaacuggguggccuaaaaagcccacaguucuggaggcuaaaaguccaagauuaaggugcugguaggguugacuuuuggcuuguuaauggcugccuucuuacuauguccucacaugaccucuugucugugugugccggaaaagagagcgcaugaucuugggugucucuuccuuuuauaaggacaccaguccuauuggauuagccccuacccuuaugaccucauuuaaccuuaguuaccucccuaaaggcccuguuuccauauacaguucacauuaaggguugggacuucaacauaugaauugggguggggggggcacaauucaaucuauagcaaugggaauaaaaaaagaauuagguaauguauggagaaauguauuauuuuaaaguaaagaagauauacucagaugauaacaucccucauuucugugacuagucauguggccauagccaauauuuauaauuuccuuccccuacuaugcauuucauauucucuuugccuuuggcaagcaucucagcuggucaugguuucuaguuuggugguguagcucaaacuuucauuccugaagucugugccguuagcagcccuggcuguuuugggucgagguaguuuccaguaacuuuuauaacaguacaugggaauacuaagagaagcuucaggagauguguauuccaggcauauuccucuuuaucauccccaagccuaguugugguagcaacucauuuucuugagagucaggauuaguuauccaauucaguauagcaguccccucuuugauuuacuggcaggggaacccaaaguggccagguguugcaguaucaaccuccaguuuaauggaaccacugucauucucuaauggaaguacuucucccuugggaacuaagaccucuagaucauaauagcgaaguuguggggauagaaugcaaaaauuucauguaguagaugauugagguaauaguaaggaaccacucucauuucuaccucaauuuccagacuugugaauucuggcugugggagaaacaauaccauauauuagucacugauuuagagcacauggagcauccuggaggacauugccccagcccugcaaggaguugccagccagcuagugcuauuacuucuaaagcccauuccaguuucugucacccaguggcuucagggugauggggaaaaugguaaaaucagugaauuccaugagccugagccuauagcugcauuucauuugcugcagaauaaguucacugaucagaaguaaugcuucucuguaaaauaccaugauggugaauaagacaucucauaaguucacacaugguggcuuuggcagaagcauuauaggcagggaagacaaauuuauauucagagcaagugccuaugccagugagaaguaagugcuaccuuuucuaugauggaagugguccagggaccacaucaguggcucuguugcuaucuacuauuggcagauugagcacucagcauuagcuguagacagaucagccuuggugaguaaguccaugucgcugaucaccuccauccuugcuaccauaacuauguuuuccaguucuauguuuacauugugaaaugauuaucacaaucaaguuauuugauaucauaucugccaccucacauaguuaccauuuauguguaugugaugagaacacuuagauuuguuaucuuagcaaauuucaaguauaccauacaguauuauuaccuguagucaccaugcuguauauuagauuucuagaacuuauucauccuauaauugaaaguuuguacccuuugacugcuaucaucccauuccugcccaccccccucccagucuguagcaaccaucauuguacucucuuuuucuaugaguucaacuuuuuuagaucucacauguaagugagaucauacaguauuugucuuucacugucuggcuuauuucacuuagcacaguaucuuccaugcccacccauguugucacaaauggcagaauuuuguccuuuuuauggcugaauaauauugcauuguguauauauaucacauuuucuuuauccauucaucugucaauggacacuuaacguuguucucaugucuuggcuguugugaauaaugcugcaaugaacaugaaaaugcagauaucuccuugagguacugauuuuguuuucuuuggguauauacccagaggaaaucauaugguaguucuauuuuuaauuuggaucauaugguaguucuauuuuuaauuuuuugagaaacguccuuacuguuuccugugauggcuguccaauuuacauucccaucaauagggcauucuacauccucaccaaugcuuguuuucuuuugucuuuuugauaauagccauccuaauagaugugagaugauaucuuauugugguuuugauuuuccugaugauuagugauuugaacaccuuuacauauaucaguuggcuauguguauaucuuugaaaaaauacauaaaaauacauauucagguccuuggcccccccacuccccuuuuuuuuuuuugagacagggucucugucacccaggcugaaguccaguggcaugaucauggcucacugcagccucaaacuccugggcucaagcuguccucuuaccucagccucccagguagcugguauuacaggcacgugcugccaugcccggcuucuuugcccauuuuuauuuauuuauuuuaucuuauuuuauuuauuuauuuuuugagaugggguuucacucuuguugcccaggcuggagugcaauagcgcgaucucggcucaccucaaccucugccuccuggguucaagcgauucuccuggcucacccuccugaguagcugggauuacaggcaugugccaccaugcccagcuaauuuuguauuuuuaguagagaugggguuucuacauguuggucgggcugguuuugaacuccgaccucaggugaucuacccgccuuggcucccaaagugcggggauuacaggcgugagccccugugcccggccuuucuuugcucauuuuuuaaucggcucauuuguucuuuugcuauugaauuauaugaguuucuuacauuuuuuggauauuaaccuguuaucagauauaugguuugcaaauauuuucuccaauucuguagguugucucuuuauugucauuucuuuugcugugcagaagcuuuuuaguuugauauagucccacuuguuuauuuuugcuuuuguugccugugcuuuuggugccuuauauauuaaaaaaaaaauugcugagaccaaugucuucccuguguuuucuuccaggagucuuaguuuucaaucuaaaaucuuuaaucuuuuaaucuaaauauuuaauccaguucaaguuaauuuuugugaaugguguaaaaaaggaguccaauuucauucuuuugcauggggcuauccaguuuucccagcaccauuuauggagacuaucuuuacaccuaaucauguaguucaugaugccgucagguaaagacaggggugccuggagaaagaggcuaacuaacauccacagggcaggucaucuuuuucuaaugauuauuaaaauuguccuuggccaagauuucucuucagugagcauucauauggagcuugaauaucuuuacucucugaaacuguuuuggagugguccauucauauaccuuucuccagagguccuuucccuguccaucuagccaaaccauuaguuguugcacaugaaacaguguagauccauaucuuuggccaucaguccuucuaaaguaagaugaacagcuaggugugauguucagaggucugcccacugagaauauuuucugcaccacaguccuucagggccacucaugaguggggcucuggugcuguggcuguucaguugugugugguaccagaauauugugcagaaccauuucuaaaccuggccuauauuuuuucuucuuuggucaacuggucauagagaacuccccaugggucuauagaggcagguugauaggaaggaggcaauuuagcaggaguaggggccaugggaauuugaaccacuugccucuucaacuuacgugugccagcaggaccuguacaacccuuaucuuacaauuuuucuuaaugauggaaugcugcuauauacacccaauuuuguggcuugaugagucagacaacaccacccaguuaauaauggguagcucauaugguaaacuuagugaccuguggucaaguguucagucaaagccagaagcacuuucucaaaaggagguuaguuaucugcagaggaugauauaacuuuccuccaaaaacccuaaaguucugugcugugauuugccuacaggugccuuccaaaggcuccauaaagcaugacuaucugcuguagacccuucgauuaccaucagauuugccgggucaugugacccagguggcaggcuuuccauucaaagaagaauugaaaaucuguuucugugccugcccucaucuaagggacauuuucacuagaguauagcaucauaugauagaauauauacaggggccuauggcauaccaguggauauauacuuuguacccagaguugccauucuuuauuuuggcauuuucaguaaguauaauuuuggguucacauucaaauugggggguccacuuaccagguugaaauaguuuuaugaaaaguuuaaagaaauuuuuucuuuuugagacagucucacucuguuacccaggcugaagugcagaggcacgaucuuggcucacuguaaccucugccucccagauucaagugauuguugugccucagccacaugaguagcugggauuacaggugugucucaccacgccugguuaauuuuuguauuuuuaguagagacaggguuucaccauguuguccaggcuagucuugaacuccuggccucaagugauucacccacuucagccucccagagugcugggauuacaggugugagccacugcgccuggccagggauuuuuaaaauaaauuuuugcagguaggauuugcuaauuaaagguuuauacauuggauauggggaggggggaaucugcuucacuuaugaaagagcaacagacaugcaugguuuauuucuuugucuucuuuuuauuuauuuauuuuuuuaauuggggacuuuaucucuaauaaaacauagggagacaaggucucccuguguugcccaggcuggucuugaacuccugggcucaagugauccucccacuuuggccucccaaaguguugggacuacaggcgugagccaccgugccaagccuaaaagaaauuuuuguugaacuaauguaucauuugaugguuaccuaaauuuuaauuuggagguaaaauuaauauguuacugaauuuaauuauuguuucacauauagcauaaaaugauuucagagaccugugauaguuuuugauaauuucuuucuugggaacuguugcuugaguuuugaaagagaacuauuagguuauugcaugcugguaccauuuuauaaauucuauuauuaucuuuacaucuaucauaggacuuaucugcauuuuuuuuguuccaagaacgaaagaacugccaaucuuuuguguaggagcugaugauuuauaucacaaaaauacuucucauauuucuagaauauaacucuagaugaacaggaaagauauuaaccuauuuagaagaaguuauuuuuggcugggugcgguggcucacgccuauagucccagcuguucguuuaggcaggagaauuacuugaacccaggagguugaggcuguagugagccaggacugcgccaucgcacuccagccuggguaauggagcaagaucuugacagcccuuuugacuucaaaggucuuaaaacagucauggcuuagucuagcuaauuugaauucauuauggagaaguugcaucuaauuuuuguaaaaacuaugacauguauaacuccugaaaagaggcuuaacuuucuagcaagggcaaaaauaggauacauauagaggugaaaauuuagcucaauagaguaaggcuaaacaguaaggccuggccgggcgcgguggcucacgccuguaaucccagcacuuugggaggccgaggcggguggaucacgaggucaggagaucgagaccauccuggcuaacacggugaaaccccgucucuacuaaaaauacaaaaaauuagccgggcgugguggcgggcgccuguaguuccggcuacucggaaggcugaggcaggagaauggcgugaacccaagagguggagcuugcagugagccgagaucgcugccacugcacuccagccugggcaacagagugaggcuccgucucaaaacaacaacaacaacaacaacaacaacaaaacaguaaggccuggaaagaaagaaaauguugagacaggugagaacucugaggcuucaaaaauaggucaucugggaagaagaucuaagaauaagaacagaauugcuagguguuuacucuguaagaaguaaagagaugggaauucaagugugguggugaaugcgggauaaaugaagucauuuaggaaauagggugacaaauuggcuaaacuuagugaguaaaguuaaaaauaagcagaugauaaucacaaaauaaaauuuauaggaaaucauaacagccuaacauuagcagucuaaagcuggucacuaaagcaaacguugaacguagugugugcucucauuaaaugugcauugaaugaaugagauuucuaaaguguccucaguuugcaaaguagauauugauuaggaaggagaaauugcuugguggguagguuacaguugcaacugggcaggauuauugagugugaagcaaccgaagaguaacacgguaauugcucagauacaggagaagcugguugcaauacagaguuugccuuuaaaugagaggguuacaggcccuucgacuucagugccagagauguuauggauauaauuaucaauagguaauaacuuuaauuuuaaaaugauuuuaugugcuuauauuuuuaauguaggaaguuuugucuuucuugauauucugcugauuggguaaauccucauauuugugauugguauauugaauuuuuaauuaauccaaauuaaaagcuguggggugggugggggagcaaaaaaaauugguggaggcugucuaaaugacauuugcuuccucaugcagcaaauaguuaagaagcucccugcuagguccuaauaaacagauuuguauguauuuguauguauguauuugugugcaugcauguauaccuuacuaaguauccuugcuagguugaccauuauuaucuuuacaguacaaaauuuaaggugacauccucuuacaugccacuauccuaaguuucuagcugccaccuaaaugcuaaagaacauauuuugcugauaccuguauugaauauccucuuuuagaaaaaauucuauuucuguaccuuuuuuucuuuucuaucaccuguuuuuccccucuugaccuauucuacuccacuuuauacaaauaacuguucuuuuauuuugcacuagggagaggaaauucgaugucaguauguugugacaugugcaggacuuuacucagaccguauuucagaguugaguggcugcacuccugauccucgaauuguaccauuccggggagauuaccugcuuuugaagccagaaaaauguuaucuuguaaaaggaaauauuuauccgguagguaaugaugcuuccuacuucucauuuuuuucaagcaggugguggucauaaaggagaugaaaacaacuuucacuugggucagaaauaagagaaauuuugaaggaccguuuuuguaagcauuucaucgguuucucuugugguuaaaucccuaaaucuuuaucccuguaucaugguuauuaaauuguaauuaauugccugcagguacaugucuccagaaagcaugagugcacucugggaagugcuaucaagaaggaacugaauucuaccuucucucugguggagggaaagggaaaacuuucccuuauggaagucccugauacccaacccuuuuccucaguucacuaucuguagguacagaaaagggauguggccacucuguaguuucagggaguagaagacagagguauuuaaaugaggaguucauucuucugucuggaacuacccuggaaaugaaugaaucucuuaaaauauauuaggucgaaccagaugaaauagucaguauucggcuauuugauauuuuugagcuugccgaaacaugaauuucaucugcuucaaccucauguauuuguacuuugcagaagccugugcuaugaauguguauuuuuuucuggcagcucugauuuuacuugccagucauagacaucccuugugaaagaccgagaauagccugaaguaagacaguucaucuuuuuuuuuuccuuuacccagaaagaugcauagauggaacaaucuauuagugucaguagcaucagaguuucuuuuuuuuuuuuuuuuuuuuccugagacagauucucacucuguugcccaggcuggagugcaguggcaugaucuuggcuuauugcaaccuccaucuccuggguuuaagugauucucaugccucagccucccaaguagcugggaucacaggugcacaccaccacgccaggcuaauuuuuguauuuuuaguagagaugggguuucaccauguuggccaggcugguuuugaacuccagaucucaaaugauccucacgccucagccucccaaaguguugagauuacaggcgugagccaccacacccagccagcaucaggguuucuugugugcauuucuaagcagaagcauguuaauggaaaaguauaucugaguacagcucacaauacaaauuaaaugcaugagaagaaaguguuuuauguuaccaauugaauguuugcaucucugauaacauggaaugugaaaugaggcuguuauuuacuauguuaaauuuauaggucccagauagccgguuuccuuuccuaggaguucacuucacaccaaggauggauggcaguauuuggcuagggccuaaugcaguucuugccuuuaaacgagaggguuacagacccuuugacuucagugccacagauguuauggauauaauuaucaauagguaacauuauuuauuuuuaaaaaugauuuuaugugcuuauauuuucaaugugggaaguuuugucuuucuugauacucuacuuauuggguaaauccccauauuugugauugguauauugaauguuguauuaauccaaauuaaaagcuuuggaguggaugggguagcaaacaaacaaacaaacaaacaaaaaaaaaaaugccuuuuggaauaaguauaacauuuuaacuacuucaagaaaauucuguugagcugggguuaaaaagaaaaggcuggcugggcgcaguggcucaugccuguaaucccagcacucugggaggccgaggcagguggaucaugaggucaggagaucaagaccauccuggcuaacacgaugaagccccaucucuacuaaaaauacaaaaaauuagcuaggcgugguggcuggcaccuguagucccagcuacuugggaggcugaggcaggagaauggcaugaacccgggaggcagagcuugcagugagcugagaucgcugccacugcacuccagccugggcgacagagcaagacuccaucucaaaaaaugaauaaauaaauaaauaaauaaauaaauaaauaaauaaauaaauaaaaauaaaaagaagauaaggccaagaguuauucauauaucuggcaauccaaaucuuguauugcuaaguuuccaguuuuauuuggugggggaggaaauagauucucucaaaaucaguagauggcuauuuuaauaaaaucauuuugagccagucuccaucauuuuguaagccacuggagaaauuacugaugaccaaaguaauuuccuuguguaggaaacuaacaauacgauuguguugaccuaagaugcagauucuuuacuauuguaagaaauacugaauuagguauuuuguuugguccuuuuaccaauguuucucucuaaaggguuucacaugaaaaucacuagauuuuccuguuuaaaucacuagauuuaaagcuauacuugaguuucacccucuauggauucugaaacagaaaguuuaggauggagcuuccuggcacauguaguuguaaaaauauauacauaugugcaucuaggcuuugcagagucucacuugaaaaucacaacuaaaguuuuuuugguuuuuuguuuuguaauuuugagacaaggucucacuuuguccucacugcagccucaaccuccugggaucaaucaguucucccacuucagccuccaaguagcuggaacuacaggcagaugcuaccaugcccagauaauuuuuguguuuucuguagagacaggguuucgccauguuacacagccuggucucgaacuccugggcucaagcaauccaccugccuuggccucccaaagugcugggauuacaggcaugagccacuacacccugccuaaacaacuaaaguauuuuaccucuggcugacuaaagaaaucuaggguagaugucccauuucuuucauacccugccuuuuagguguguugaaggcaucuaauauuuccauuagaaagccuugauguuggcaggcuuuauagaguuccaguuugaaaccagcacuccuugggaauuugaguuuagaggguguuuaccucuguauuuuuuuuuuuuuuugagucaaaguuucacuguugcccaggcugaaaugcaguggcacaaucauugguuacugcagccucaaacuccugggcuuaagcgagccucccacuucagccucccuaguagcuggaacuacaggcacacaccaccaugcccagcucuguuuaccuccugagcugaugagguuuucuucugauauuggccaaaaguugauuuucauugauucauugauugauugguugauugagagagggucucucucugucgcccaggcuggagugcaguggcacgaucucagcucacugcaaccucugccuccuggguucaagcaauucuccugccucagccucuugauuagcugggauuacaggugugcaccaccacaccugucuaauuuuuguauuuuugguagagacaguguuuugccauguuggccaggcugguuucaaacucgugaccucaaguauuccgcccgccuugaccucccaaaguguugggauuacaggcgugagccaccacuccuggccuugauuuucuuuuaaucuguaguuuuucugacuuugccuagauuuuugugaugacauaaaaaaagaaucuaauaauuauaaagguauuuuacguaauaaagaauuccuuucucucauaaagauuuuuuuucucuguuuucaguggcuugauuaaacuggcaucccagaauuuuuccuauggaguuacugaaauguauaaagcauguuuucuuggugcaacagugaaguaucuucaaaaauucaucccugaaauuacuaucagugauauacuuagguaaggaaaagggauaaggaguguaaauacaguccugaccuaugugaacuugagaggugggucugacuuggugauuaguaaguaccauuucagagucagucugcauaugcacugaauuuuuguuugcuuucuuucccaacauguuguugaauucccuuugcagugcauuuauugggcauugcuacaucauggcccuuagugcugguccauuuauaauuaucuagacugccuuacagcucuaaucugaaaucucuaugacagcuuuauugugaugcuaccuuagccuuuuugucuaacuaucacuccugauaaaaacaacuugccugaauuuuuaaaaaucucucuggccaguuagucuugugauuccaaagccuuuuggccuuaauuuuguauaagauuauugaucacuauguuaacuaauuagguaauaagcacauuaaaacauuauauuuugauugauucuuaaaacuuaaaaaaaaccuuuuagguuugggguacaugugaagguuucuacauagguaaacacaugucaugggguuuauuguacauauuauuuuaucacccacauauuaagcccaguacccaauaguuaucuuuucugcuucucuccuuccucccucccuccccacuuaaguagacugcagugucuguuguuuccuucuuuguguucauguguucucaucauuuagcucccacuuauaagugagaacaugugguauuugguuuucuguucuuguguuaguuugcuaaggaugauagccuccagcuccauuaaaaccuguuagaaacacacuccuagaccuggcaucucaccuugcuucuucucuacuucuuuuguucuuucuuggaccuuacugcacucagggacucuacuuucaggauagaaguggaaagcagugugguaacaaucagaguccuugcuacagggguguggggcaaaguaaggacaacuugcaucuuuuauuuuuauauuuuuucugaaauggaguuucgcucuucuuguccaggcuggagugcaauggcaccaucucagcucgcugcaaccucugccuccuggguucaagcaauuccccugccucagccuccugaguagcugggauuacaggcaugugccaccacgcccggcuaauuuuguauuuuuaguagagacaggguuucuccuguuagccaggcgggucucaaacucccgaccucaggcgauccacacgccucagccucccaaagugcugggauuacaggcgugagccacugcacccagccacaucuuuuauucuuaaagauaaaagacuggcacggcggcucacaccugcaaucccagcacuugggaggcugaggcggguggaucaccugaggucaggaguucgagaccagccugaccaaaauggagaaaccuugucucuauuaaaaauacaaaauuagccaggcaugguggcacaugccuguaaucccagcuauuugggaggcagaagcaggagaauggcuugaaccugggaggcagagguugcagugaggcaagaucacaccauugcacuccagccugggcaacaagagcaaaacuccgucucacaaaaaaaaaaaaaaaagauaaaaggcuuucuagacuugaucuguagauuauucuuaauaccacccaaaccuauuuuuuuccccucuuugguaauguuuuuaguguucaccuuuuuuccugagcaagccauucguuaggccuaaucagcaguguacuuugagguacucucacccuccauuuacaauccaucccuccaugaauuuucuuagcacuagauaucugcuuucucugcaacagcugcugaacuagccugguaaaaaaugucagcaggcuugacuguguaucuguguagagagcaauaaucaugucagcugucucucuuaggggagcguccucguuuaaaucugacuguaauguaucauucugagaccagcauguuugaauccuuagaagauuaaaacucagcuaacguuuuuccucuuaucucuuucacuccucuacucaccuucugaaauagaagggauaaaaauaucuagccauuauuuucuuucacucacuuauaaguaagggcuuuuauguuuucagugaucugcuuuagcaaacuugugauguuuuauaucugaaaauagacuggucaaaucugguuucuauuacugcuauugauauuccuuggaaaacaaacgaggugagcauagugaauucuguauaaaaauaguugcagugaauucacugccuguauucaguuaccacccuuuauagaagccugaggaaaacuuuuuagaccacuggauuucauaugguagaacuggacuucgggcuugugguuauuagugaacucuccugucucuggguguaagggugugaauuucuguuaccaauuucauuggcauguaguagaaaagggcacagcacugcaggcaggugcauuuggggacaaauucaacccaaucacagaugaguuccucuuuaaagagagaaaagcuaacuaauucagcaauuccauuugcuucgucucuugauuccuauaguuauuaagugcaggaaauuauuaauaacaaaaaggaagcuguagaagauauguuuuuggguuucucgggggaagauacguuugauaccauuuguauaaguuuuaaaacaaguauagcaaaaccauauauugcuuacggauuauacauguaguaugaaaauaaaaaugagcaggggagugauaaacaccuaauucaggagagugguuaccucuggugagggaagagaaugggaucuugagaguucuacagaggcuucuaucauaucgguaaugcuuuguuucuuaagcuguuagauaaaaaaauggguauucauuguguuagucucucuuccuugugauagccugaaauauuaaauaauaaaaauaagaucaauagacuuuuuuuuuuuuuuuuugagacagagucucggucuguugcuaggcuggagugcagugguacaaugucggcuuacuacaaccuccgacucccugguucaggcgauucuccugccucagccucccgaguagcugggauuacaggcacgugccaccaugcccagcuaauuuuuguauuuuuaauagagacaggguuucauagagagccaggauggucucaaucuccugaccucaugauccuccugccuuggccucccaaagugcugggauuacaggggugagccaaugcgccuggccaagaucaauagacuuuuccacagcuugaagccuaaguccugccuugucuccuuugucuugcaaccaguauacuaaaccauaaaugcccuuaguauugcagugaaagcacaucaggcauuaguaaauaguaaaauauaguugaagcaacacuuucagugggguguguuucccaggaugguguccuuaaauuucauuaaccacugaagggcacccagguugacuucucauugcuuagccagagcauuuugggcaauaauuuacuggugaacaugagauuggaauauaaaguuacaaucuguuaaauauuugcauuagauaaacuucucauuguuaaaugauggucucuaagacucuuaauguuagcucuaggccaggcacaguggcucaugccuguaauccuagugcuuugggaggcugaggugggaggaucgcuugagcccaggaguuugagaccagccugggcaauauagugagaugccaucucuacaauuuuuuuuuuuuaauuagcugggcagguggugcacgccuauaguuguagcuacuagagaggcuuaaguggcaagaucccuugagcccaggaugcugaagcuacaguuagccauuauugcacuacuguccuccagccugguggagagaacaagacccugucucaaauauauauauagcucuaaacuuuaaaaauuuguucugugauuaauuuugacauguuaaucuaacagcaguuuguaucuguuagcacuguaaagauguaaaagacgaagacauauaugucacaauuuccccauuuucaauuuggaaaaugucuucuguggggaauucuagaguaaacuuucaggcaagauguuuucauagcaagugauaacuagagugugugaaacacaaaggugcaaaacucaaacauuucuacaauaaaguuguaauggcuuauggugaucuagauuaggguuucucagucuugaugcuauugacauauugagccaaauaauuauuuauuguggaggaguguccaguucauuguauaauuuuuuuuuuuuuuagacggagucucacaguguuaccugggcuguagugcaguggugccaucucggcucacugcaaccucugccucccggguucaagcgauucuccugacuuagccuucugagcagcugggauuacaggcgccugccaccacacccggcuaauuuuuuguauuuuuaguagagaugggguuucaccauguuggccuggcuggucucaaaguccugaccucagguaauccacccgccuuggccucccaaagugcuaggauuacaggugugagcuaccgugcccagccauuguagaauguuuaacagcauccccagccucuacucauucuccuaauuguggcaaccaaaaauaugucgacauugccagauguccuguagggggcaaaaucuccuuugguugagaaccacuaguguagagaauuugguaaccuucacacuacaaaauaguaauaagagucuggaggaaauaugauaaacauccuugaaauacauauagcugagaguaagggaaaguaaggggcaucccagagcaaaaaacagaaagaaaauuaaaauucauacuaaaaggaguuggugcugaugcugacuuggagagguggggaugguuugcuaauuuuaauaacugaggggcuugaguuauauuuguaauuuaugugugacucaacguauaaaauauguagaucuuaaaugcuuaguaaauuucgauaauuguacaaaccauauccaccagucagaacaagauauaggacauuagggacuuguauuuuaauugccacucaagugcugaaaaagaaaucuugggucuauacaagguagaaaguuggaacucagacucuaauguaaggcccccuaggggcucuugaaaggcuauacccucagaagaaaggaagucuggaaaaaaaauauuccccuuggcacugggaaguauuaaggaacuuugucuaucuuggucuuggggauggggagugggaggaaucuuccccaaaaucuagaaucccucaaagugcuuagauuuugaacguauaccaccagcuugguuuaggaacuguaagcuaacaaauuaacugaaaaaguagagccagacauuuuuggauccugcuucaaucaaucucucucucucucucucucucucucugucuucuucucucuccuucuuucucccucccuccccuccccacccccucuaauucaaguaaauuagagagacuaaaaaucagauaauuugaccacaaaaugacuacugacacuaagcaauuauugguuuauaauuauuuuuaagaauuuuuuuuuuaagagucucgcucugucucccaggcuggagugcaguggcgcagucucagcucacugcaaccucugcuucccggguucaggugacucuccugccucagccuccugaguagcugggauuacaggcaugugccaccauggcuggcugauuuuuuuuucccuauuuuuaguagagaugggauuuuacuauguuggccaugcuggucuggacuccugaccucaagugaucuacccgccuuggccucccaaagugcugagauuacaggugugagccacugcaccuggauaauuuuuaagaaucuuuuuaaaagaaauacacauugaggccgggcgggguggcucaugccuguaaucucagcacuuugagaggccgagguggguggauugcuugggcagccuuggcaacauagugagaucagcccaggugacauagugagaccccauuucugaaaaaaaaaaaaaaaaaaccgaaaaagaaaaaaaacagaaagaaaagaaaacaaauacacauugaagugaagugguaugccaucugggauuugcuuuaaaauaauucaguggggguguuguggcucaugcauauaguccuagcuacuugggaggcugagguaggaggauugccugagcccaggaguuuuaauccagcuuagcaagacaacaugucuaaaaaauaauaaaauaugguugggcucaguggcuccugccuuuaauccuagcacuuuggguggcugaggcaggauuguuugaccugaggaguucaagaccauucugggcaauaugagaccuugucucuaguaaaaauuaaaaaaaaaaaaaaaaaaaagagccuggcgugguggugcgcauaugccuguagucccaacuacucaggaggcuggggcaagagaauugcuugagccuaguggucgaggcagcagugagccaugauaacaccacugcacuccagucuggacaacagugagacccugucucaaaaauaaauaaaauuaaauaaaaaauuauaaaauacuaaaauaaauaggucaggcaccaugggcucacgccugcaauccuagcacuuugggaggcugaaucaggaggauucuugaggcuaggaguuccaaaccagccuggacaauauagcaagaccccaucuauaccaaaaauuuaaaaacuagcugggugugguggcauguuccuguagucccaccuacucuggaagcugaggcaggaggauugcuugagcccaggaguuaaaggcuauagugagcuaugaucaugccagugcacuccagccugggugacagagcaagacccugucucaaaaaauaagacugggcgugguggcugacaccuauaaucccagcacuuugggagacugagaugggagaauugcuugggcccaagaguuugaggccagccugggcaauauagugagaccuugucucuaaaaaaauauuuuuaaaaaacaauuagcuggguguagugguguccaccuguggucccagcuauucaggaggcugagaagggaggauugcuugaaucugggaggucagggcugcaguaaguugugauugugccacugcacuccagccugggugacagagugaggccugucucuaaaaaaaauaaaauaacccaguggagagacauugguguuggauugguacauagaugaaacaagauuggcuguguguguauaauuguugcaacuggauaauacauacaugggaguucauuauacuguugguuuucuuucuuuuucuuuuuuuuuuuuuuuuaacuuuuugacguguuuaaaauuuuccauuuaaaaaaaagugcucucaggauaguaauagaagcaaauguaaaaccacugcagagggacacacccugaauccaaccccucccagaugauucccacagauaaagucguacugaacagaaacucacaaucagaaguuacaaaccaccauaagugagagucagcagauaaaauaaguggcagaauuagacuuccaacaacuauggguaauaguaauaauagaaacuguaaaguaaauaugcuucaauuaaucaaaaacaagguaaugaaaacaugaaaaaaaaaaaccaaagaaaaaagaacuaggcaaauuaguuggaaaccaccuaaugagaauuucuggaaauaaaaauauaguuuuuaaauuuuaaaacucaggcuaggcuugguggcccacuucuguaaucccagaacuuugggaggccaacgugggaggauuguuuggguccaggaguucaagaccagccuaggcaacauaguaagauccugucucuacaaaaaguuuuaaaaauuaaccagguauggugguacacaccuguagucccagcuacucuggaggccgaggagggaggauggcuugagccuaagaggucaaggcugcagugagcugugauuacaccacugcccuccagccugggcaacagagcaagacccugucucaaaaaaaaaaaaaauuaaaggaaaaaccucagaugacuagguuagacagcugguuagaccuaccuuaagaggaaauuaucaaauuggaagguaacucagaagaauuuagaaagcaauacugcaagauaaagauguauccauagaaauuaaaagacaugggguugggcacaguggcucaugccuguaaucccagcacuuugccaggccauggaggguggauuaccugagguuaggaguuuaagaucagccuagccaacauggcaaaaccccgucuuuacuaaaaauacaaaaacuagcuguggugggcaccuguaaucccagcuacuugggaggcugaggcaggagaaucacuugaaccugcgaggcagagguugcagugagcugagaugacaccauuguaccccagccugagugacagagugagacuccgucucaaaaauaaaauaaaauaagacauggaaaagaaaacugagaagauuccagccuaucucucauagguguuacagagaaauugagaagaggcaauccuuugaggagagaauacuuaaaaauuuucuagaauugacagaccucaaauucaagauguacagugcaucccaucugaguaaauaaaacuaaauacaagauggaaauagauuuccaauuuaguagagaaggaaaaaaagaauauagaaaacucaauaagugaagaaagaggagauagaaaccuuagaaaaucagguuagauagcauaaaauaauaugguagaaaucaagcauaucaguaauuacaguaaauguaaauguauuuaauaguuaagacagauuaucagguuggauuuaaaaaaaucuaugugcuagaaaaaugcuuuuaauuuuuuuuuuuuuuuuguaagacaggcucucgcccugucacccaggcuagaauggagugcagugaugugaucauagcucacugcagccuugaacuccuggguucaagccauccuccugccucaaccucccaaauagcuaggacaacaggugugugccaccacaccugccuaguuauuauuauuuuagagacagagucucccuauauuguccaagcugguuuggaacuccugggcucaagugauucuccugccucauccuccaaaagcauugggauuauaggcaugagccacuaugccugguauggacuuauauauuuagauuagcaguggaguuuuauaaaauacuagauugucucauuguauuuggaacuggcugaagaugccuguuacagcuuuucguagcuguuuuuccaaccuguaguguaaugcuugacauaugacaauaauguaauacaagacuucucaugaauguauguauuuaguuacacauucagcuguucuuguuucuggacauauuuuuuuuucuuuuuuugagacggagucucacucugucacccagccuggagugcaguggugcgaucuggguucaagugauucuccugccucagccucccaaguagcugggauuacaagcaugugccaugauggcuggcuaauuuuauguuuuuaguuagagaugaggcuucaccauguuggccaggcuggucuggaacuccugaccucaagcgauccaccccucgagccucccaaagugggauugggccugagccacccugcccaggauauauuuaaaaauaaaaauuaaaaaaauagaaauuuuaaauuuuaacuuaaagcuuaaaguuucuagccuuauugaaugccuacuaugugcaagacacagaucugcacauuugggugauguagggguguugacaccauacuugcccucaagacauuuaugguuuauguuaccugagauuuucuuuucuuuuucuuuucuuuuuuuuuuuuuuuuggagauggaguuucgcucuuguugcccaggcuggagugcaauggcucaaucuuggcucaccgcaaccuccaccuccuggauucaagcgauuuuccugccucagccucccgaguagcugggauuacaggugccugccaccacgccccagcuaauuuuuguauuuuuaguagagacggggguuugccauauuugccaggcugaucuugaacuccugaccucaggugauccacccacuuuggccucucgaaguucugggauuacaggcgggagccaccuuuccuggcugagauuucaaauaauaauacuuauuucaguuugaaguguucugaggggaaagcauauguaauccuacaaagaaaaacccugaaguugccuuaagugcuugaaaagggaaugaaaaauuugguacuuuaaacauuucauguuaaaaacuuguuugaacuaaaaugaaaucguaggaaaaacaucauuauuauuuauuuauuuauuugagacagggucucacucugucacccaggcuggagugcaguggugugaucacagcucaacugcagccucuaccgccauuagcucaagggauccucccaccucugccuuccaaguagcugggacuacagacacucagacacucaacaccacgccugauugauuuuuuuuuucucguauauaugggauuucaccauguugcccaggcuggucucaaacuccuguguucaagugauccaccugcuuuggccucccaaaguucuaggauuacaagcaugagccucugugccuggccagaaaaacauuauuauuauuuuaaaauuuggauuguaggguuuucaauauguggacaagaguauaggggacauugagaacauaauuuuuguuuguaagaaaaauaaguguagacauuuuuaacugugguuaaucaauuuuaaccuuuaugugccuagaaggagcaaagggaauguacugacugauucucuauacagcagaguuuuacauuggacacucaacaucaguggcugguccugauguugaggggagaaaugcuacuucgaugaguucagauaaacuauaaauaguauacaaaauaggccacauaccagcugauaaacauaugcgucucuaccccaagaaguuucagcuuucaguuccgucccuucuuuuuguguucuaugugguauaucugauucuuuaagauuuuuuuuuuaauuuuuaugggugccuaguagguguauauauuuuugggguacauaagauauuuugcugcaggcauguaaugcauaauaaucacauuauggaaaauugguuauucguacccucaagcauuuauccuuugucuuauaaacaguucaauuacacucuuaguuauuuuuaaauauacaaucaaauuauuauuuacuauggucucccugucgugcuaucaaauacuaggucuuauucauuucauucuuucuauuuuuggggggagguauccauuaaccauccccaccuccccuguaaauccccacuccacacuaccuuucgcagccucugguuacagucuugcucucuuaccucuaugcguucaauuguuuugauuuuuagaucccacuaauaaguaugaacggaugauauuugucuuuccgugccuggcuuauuuuacuuaacauaaugaccuccauguugaugcaaaugacaggaucucauucuuuuuaauggcugaauaguacuccauuguguauagauaccacauuuuauuuauucauucaucuguugauggacaccuagguugcuuccaaaccuuggcuauugugaauacugcugcaguaaacauggaaauucagauaucucuuugauacacugauuuccuuucuuuuggguauauauccagcagugggauugcuggaucauguaacucuaucuuuagcuuuuugaggagccuccaaacuauuggccacagugguuguacuaauuuacauuucuauuaacaguguaugagguuucccauuucuccauaucuucaccagcauuaguuauugccugucuuuugaauaaaagccauuuuaacugaggugagaugguaucuccugguaguuuugauuugcauuucucugaugaucagugauguugagcaccuuuucauaugccuguuugccauugguaugucuucuuuugagaaaugucuauucagauauuuugccccuuuuaaaauuggauuauuaaauuuuuuuccuauagaguuguuugagcuucuuguauauucuaguuguuaaucccuugucagaugaguaguuugcauauauuuucucccauucuguggguugucucuucacuuuguugauuguuuccuuugcugugcaaaagcuuuuuaacuugaugugaucccauucuggaucauauuguuuaauuucuauguguuuauauaauuuccaaaauuccucuugugauugauuuguaguuuuauuccauuguggucagagaagaugcuugauauuauuccaaauuuuuugaauguuuuaagacuuguuuugugaucuaacauauggucuaucccugagaaugauccaugugcugaggagaaaaauguguauucugcagccauuggaugaaauguucuguaaauaacuauuaggucuauuuguucuguagugcagauuaagucugacauuucuuugucgagguucugccugggagaucuauccaauacugaaagugggguguuuaagucuccagcuauuauuauauuggggucuaucucuuuagcucuaauaauauuugcuuuguauagcuggguacuccaguguugggugcauauauauuuacaaucauuauguccucuugcugaauugacuccuuuaucauuauauaauaaucuucuuugucucuucuuacaguuuuugucuugcagucuauuuugucugauaucaauauagcuauucuagcuauuccugcucuuuuuucauuuccauugucauggaauaucuuuuuccaucccuuuauuuuuagucucuuuguaucuuuauaggugaaguaaguuucuuuuaggcaacagaucauugggucuuguuuuuucauccauucagcuacucuaugucuuuuugacugcagacuuuagucuauuuacauucaguguuauuauugauaaguaaggacuuacuccugccauuuuguuauuuguuuucugguggcuuuacagucuucaauuccuucuuugcuuucuuccuaucuuccuuuuaaugaaggugauuuuucucugaugguauguuuuaauuucuuucuuuuuguuuaauuuuuugauauccauuguauguuuuucuauuuuaccaugaggcuugcaaauacuaucuuauaacccacuauuuuaaacugaugacaauacugauugcauaugcaaacaaacacacagaaagaaaacuaauaaaaacucuacacuuuaacuuuguuccuuggcuuuuaauuuuuuuuuuuucucuuuauaucuuauuguacugucugugucuugaaaaguuguuguaguuacuauuuuugauugguucaucauuuaaucuuucuauguaagaugagaaguuuauacaccacaauuauaguguuauacuauucuguguuuuuuaugugugcuugcuguuaucaggaaguuuuguaccuuuauaugauuucuucuugcucauuaacauccuuuucuuucagauugaagaacucucuuuaguauuucuuguaggacauaucuaguguugaugaaaucccucaacuuugucugggaaaguauuucuccuucaugcuugaaggauauuuucacuggauauacuauuuuagaguaaaaggguuuuuuccuucagcacuuuaaauaugucaugccacucccuccuggccuguaagguuuccacugaaaagucugcugccagacauauuggagcaccauuguauauuauuuguuucuuuuuucuugcugcuuuuagaauucuuucuuuauccuugaccuuugggaguuugauuauuaaauggcuugaguuagucucuggauuaaaugcuguugggguucuauaaucuucuuguacucaaauguugauaucuuucucuagguuugggaaguucucuguuaucaucccuuugaauaaacuauuuaccccuauauguuucuguaccuccucuuuuaggccaauaacucuuagauuuacccuuuugagaauguuuucuagauuuugugggcaugcuucauuguuuuuuauucuuuuuucuuuugucucaucugacuauguauuuucaaauagccugucuuucagcucacaaacucuucugccugaucaguucugcuauugagacucugauauauucuucagcaugucaguugcauuuuucauuucuagaauuucuguuuaauucuuuuuaauuauuucaaucccuuuguuaaauuuaucugaaagaauugugaauucuuucuguguugucuugaauuucuuugaguuucuucaaaacagcuauuuugaauucucugucagaaaggucguauaucucuguuucuccaggauuggucucuggugcuuuauuuaguuuauuugaggagguuauguauuccuggaugguguugaugcuaguagauguucuuuggugucugggcauugaagaguuggguacuuauuguagucuucacagucugagcuuguuugugccuguccuucuugggaaggcuuuccagguauucaaagggacuuggguaacaagcccaauaacauugugucuuuuguagacuuguagagguaccaccuaaguggucuuggauaagauccagaagaauucucuggaucaccaggcagagacucuuguucuuuucccuuacuuccucccaaauaaauggagucucuuucugucugugcuaaacccccuggaacugggggguguggugaugcaagcacuccuguggccaccaccacugggacugcacugggucagaccugaagccagcccagcacugggucuugcccagggcccuucccuucagggcaguaagcuuccucaggccccaggcguguccagagaugcugucuggaagccacagauuggggucaaauacuuuaguaguuuaccugauguucuguucuacugcggauaacuagcacucacacuacaauacaaaguucuucucacucuucccuccccuuuccacaggcagaggggccacucccuguggcuaccaccaccuuugguccacaggguuucugccaggccaccaccaauauucacuuaaagcccaagggcucuuccaucagcuuguggugaaagcugccuggccugggacuuacccuucagggcagugggcuccccucuggcccaggguagugcuagaaaugccguccaagaguguuggccugggccagacacgguggcucaugccuguaaucccaacacuuuggaaggccaagacggguggaucaccugaggucaggaguucgagaccagccuggccaccauggcgaaaccccaucucuacuaaaaauacaaaaaucagcugggcgugguggagugcaccuguaaucccagcuacuuggaaggcugaggcaggagaaucgcuugagcccaggagguggagguugcagugagccgaggucacgccacuucacuccagccugggcaacagagcgagacucugucucacaaaaaaaaaaaaaaaaaaaaaaaaaaaaaaaaaaaggaguguaagccuugacuuggggaccccaagaaccugcuuguugcucuaccucacuguggcugagcugguaccuaagguguaagacaaaguccccuuuacuuuuaucucugcuuuucucaaacagaaggagucuuucacuguagccaccacagcugggaaugugcugggucacaccugaagccagcacaucucagagucucauccaaggcccaugacgcacuccuuggguaucgcugcugguuauucagggcccaagggcucuuuagucagcagguaauguauccugcuaggacuggguuuuucccuccaaggcaguagguucccuuuuggcccggggugggucuagaaauguuguucaggagcuagggccuauaaugcgggccucacaacucugcccagugccauauccuacuguggcugagcuggaauccaagauguaagacgguccucuuuacucuuugcucuuugcuccuuaagcagaagaaaggagucacuucuauugcagcugccuuuguuugggggauggaugaugcaagcacucuuuuagcuaugccggcugguaucucccuagaucacaugccacccuaguccacugacuauaagcccagccuagugcuaguagcugaggaguuggaguccuugugcccuagacuguauuucaaguuuaucuaggaccccagagcuuuucagcccacgguggugaggcuugcagggaaacucaaguucugaccacugggauggaugcuuccugucuagcuggggcagguccaaaugcucccuccaugugcuggcgcuggcugagcccagcccagcuuuauucuccacugugacagggcagcacugaguucaguguaaaggcccccagccacuguacccucccuuucccaagugcauagguucugucuccacaccacauggcuggcugcugcuagggggugagggagggguggcauuggcgaugcaagaccaucuuuucugcccuccucaaugccucuuucaaagauaugaagucaaaaccagccacugugauugcucaccugauuuuugguucuugugacggugcuuuucugugugcagauaguuaaaauuugguguucuagcagccgaaccaauguuuguaggcuucuuuuccaccgucuugcuccacucacucccauaucugauucuuacuuggaaauucuuacagcuaaaaaaucucuuguccagauucccugcaggauucuauagggaagaucacuuaucuuuaucauacaaccuuucacucuuacuguuauaauucuuauuuaccucucuacgaaugaauaguauagcucugugauuucaggcaaguuacuuaaucucucuguguuucuuugcuguuaaauauaaacugugucagccucuuaagaguuguuuugaggauuaaaugagguaauuccuagcacagaguaagcacuuacuaaauaauagcuauuacuauuaucucucuucagccagcugaagucuuagagggcagugccuucauaguguucuuuguaucuucugcaaguacuuaucugauuugucccagaauuaguaaaaaauguuuaauauuguuuccugauuucuugagccuugcugguguguauaagauagaauuuuucacacugggcuuccuuggacaaguuucauaagaggugcuuuuuuguaguucaaaaacauuggauucaaauuucaucuguaaauuuuaacuguuuaaaaaaacaacaaaaaucugugagcucaaauguuauaaaauagaauuuuaaguaauaaagauuaucagugucuuuacaguuguucacaccuauaaucccaucauuuugggaggcuaaggugggaggaucacuugaggccaggaguuugagaccagccugggcaacguagggaaaccuugucucuacaaaaaaaaauuuucuuuaauuagccaggcgagguuguguacacaaccugagcaacagaucaagacuaucucaauuaaaaaaaaaaagacucucauuuuauuaacaugcugcuaaauuuauuuuuaugcuuuuccuaucaucuuuugaaauugaagaugauccugauauugaaggguaaacucuuaaaaacaaacugcaaaacaagaacuuguugccauuugcaaauauuucucuccauaaauuuuaauugugugaauuuuaaaaacacaaaaauaaguagaauaggauacaggaaugcaacugacacauaaccucugcuuucauugauuuguauuacucagaugaggcuuauuguugccauugauugauuuuuauaauaaauucauucuauaaauuuaaauaaaaauauaccuguucuaauuaaguguggauuuaccuacuaccuuuggaaagagcagacauugauaaauaacuuacuuguuuuuauguauuucuuugauaagcguuuguuacacuauuguuacguaauagguuuuaggcucuaagcuaacaauauagguuugacaggcuacaacugacagccuuugguuaaacauaaacucauuggguuuccauauaauugugcauuuagaagaauacuuuauugcuuuaagacuuuuuggaaacgcugacuuguaaaguauccuaugucuuugagucagcugacucccaucuuuuacuuuugcaggggcccagcuggaguaagagcccaggcccuggauagagauggaaaucugguagaagauuuuguauuugaugcaggaguuggggauauuggaaaucgcauucuucaugugagaaaugcaccuucuccugcugcuacuucuuccauugcaauuucuggaaugauugcagaugaaguacaacaaagauuugaauuauaaauaaugaaaggagcuagguaugcacuguaaucuucaugucagcaacaagaauguacuaauugcauucuuuaauuuaaaaaaugguuuuuaaacuuuaguuuuuaggucaaagauaaccacugcauuguuaaaaugauguaacauagaaauaauaauuuucuacaaaaauuagccaggcaugguggcgcaugccuguaaucucagcuacucaggaggcugaggcaggagaaucaauugaaccgagcagacggaggugagcugagagcugagauugcaccacugcacuccagccugggugacagagcaagaaaauaauaauaauaauaauuuucaaaauguuaggcugggggccguggccagcacuuugggaagccaaggcagguagauuguagcccaggaguuugagaacagccugggcaacauggcaaaacccuguuucuacacaaaguuagcugggucuggugccucuguaguuccagcuccucaguaggcugaggugagaggaucacuugagcccaggaggucuaggcugcagugagcuuauguucaugacacugcauuccaggcuggaugauagagcaagaucuugucucaaaaaaaaaaaaaaaaaaaaaaaaaauccagccugggcaacauagugaaugaaaccccaucucuacaaaaaauacaaaaauuagcugggcaugauggugugugccuguagucccagcuacuugggggcugaggcaggaggaucgcuugagcccgggagaucaaggcuacagugagcuguguucaugccacuauaccccagccugggcaacaaagugagucccugacucaaaaaauaaaaacaacaacaaaaaauaaauuccaugcuuauuuacuuugcgaauaaagaggcaagguacaguuuuaucuguccgaaucccugacuuuuauuuauuuuuuuuuucagacggaguuucacucuuguugcccaggcuugagugcaaugguacgaucuuggcucacugcaaccucugccucccggguuccagcgauucucuugccucaaccuccugaguagcugggauuacaggcgcccaccaccaugccuggcuaauuuuuuguauuuuuaguagagacgggguuuugccauguuggccaggcuggucucgaauuccugaccucaggugauccaccugccucagccucccaaaaugcugggauuacaggugcgagccaucaugcucagcccugaaucccugacuuuguuaaugaccuguccuuaccaaccaugaccuagagaagauuuggcuuuuuaagaguuuuggagaaagauggcauaaaaauagauuauuuccuuaaaucaauuuuuuagcauuacgcuaccuaagcucguuuggucucucauagacaagaaaauacauuauauuguagguuacauucuuuuaauuuugaagagucacaaaacucacauuauuuagagcaacaauauuuguauuuggaaauuaaaaauucaugauuucaagaaaauacauaaaauuuacauuuuugaguaguuugaauaaguuucuaucuuaauuauaauauuuguaggaaauaacaaaacaaacucaaagccuuuauuauuuccagucucuuuguaacugaugugguaugguaucaucaugaaaucuaaacagugguacacugagugguuguccuguucuucaaucucuguggcugagaacugaaauaacuuagaagagacagauuuuuaugagagcaguuuuagaauccugacacugauguauagaacuccaauuuaaaaaaguuauuuaucuauuauaucucugaucuuuagucacacuaaggcucucaaaauguuggccaagauugguaaugauucauacguacuugauuuuucagggcuccuauaaacuuguauagggauauuuuuccauuuuugauaaauaucuaacuuugaggcauucacuuuuguaaaccgcgaaagugccuuacauucaccucaugaguauuuuaaguugaugcccagugcugugguauauccuguauauauguguuuugugguaucuaucgaaauuauucuuauaauuuagaaaguuagaaaauagaaauuguaaaugaaaauguggcgaccugacugcagaacuuugaguacugaaccacauuuaggugaggcauuuucauccauucucucugauuugcucucucaggauucaucuucuacuguguaugucuucuuuccucuuagcucuccaaagcuguaugauggaugggugagaaggaugugcauuuugguugauaggaaaaauguuucuguuuucuuccuuuuccccucacuucaagcauugaugauuacauugauugagcuaccucauccauuaauuugaaaggcuacacuucaucagcucauguuuaagaaguagcacaucccagguaaacagaguaggccauuauucaacucuuaggaugaguauauuaaaagcauucagauaucaaugacagaagaaacaagcccuaauguuucuuuauaacagcugauuccugcaagaaaugcaaacacaggauauuuuucuguuccauuacaagauuacuaagagauggaaaauauuaucauucuguauuuugucaguaguacgauugcauacauacuaaguuguaaacauugaauuacaaaaaaugauuguccuaauugaagcaguccucaauccauuugagucuguacaauacccugaaaaggaaacaacaggugcuggagaggauguggagaaauaggaacacuuuuacacuguuggugggacuguaaacuaguucaaccauuguggaagucaguguggcgauuccucagggaucuggaacuagaaauaccauuugacccagccaucccauuacuggguauauacccaagggacuauaaaucaugcugcuauaaagacacaugcacacguauguuuauuguggcacuauucacaauaguaaagacuuggaaccaacccaaauguccaacaacgauagacuggauuaagaaaauguggcacauauacaccauggaauacuaugcagccauaaaaaaugaugaguucauguccuuuguagggacauggaugaaauuggaaaucaucauucucaguaaacuaucgcaagaacaaaaaaccaaacaccgcauguucucacucauagaugggaauugaacaaugagaacacauggacacaggaaggggaacaucacacucuggggacuguugugggguggggggaggggggagggauagcauuaggagauauaccuaaugcuaaaugacgaguuaaugggugcagcacaccagcacggcacauguauacauauguaacuaaccugcacauugugcacauguacccuaaaacuuaaaguauaauaauaaacaauauauauauauauauauauauaaaauacccugaaaaauaaaaaugaaaaauuuguugaaaguguuuugaauauguagguuauucugcuuguaaaacguuuuauauguaugucaauaggguuuuuuuguuuaauacugauauaauaaaguuuuauguauuucugacagaagaaauguauauuaauauuuaaaauauuuuaaugagccuugguguuguagagaacauauuuuuuaguuccauaaaaacuuuuaugcaaauaaauuuuuuuauguguaaaacauaaacuguuugcuuuagauagauagcagccaaccuuuuuaaaaaacucauuucuguguuaguauauaauacaaaaugagguugagucauuuauauuuuggguaaaaaguggagcauuuuagauuuuaacuucagaguguuugugaggaacucuugauguaccagcaaguauauuuuugguguuucauguuacguagcuuaacucuuuuauccauacauauauguguauaucaaaguccuucccuugauccucucagcauuagcacuguuuggggaguugccuuuacuguuggcagaauuccacuuucccugaggccauuuggaaaucuaccuaguagccugugggauaaccuuaacucuuagaacuuucuucaaaggaugguggugagaaugggguauacugccaggcccuggccuacgggaguuuguagggccuacuuuuggaggcaauccaacccugauggcuguaccuaugagcuaucccuguaaacacaggagacauggugucuauauuguuuaaggacuggcucugcccuccugggcccuuaaucugugucuagacuucuuggucagagguuuccucaucuuucugcgcauacacuauuaucuaaagaucuuguaaacauuuuugaguuguaaucguaaagucaguuucuaagcuuuucuaacacacucaaagggaguuuuugaaaucucuucaucagggcuuaagguagaaggacagggugaaaugguugggaaagcaaaagcugccucgagauguuuucaaauaguuuguacucauuaaauagcuuaagaauggaaauaaacccugaagcccugaagggaagaacaguguugauaccaaccaacucuacuuuucuggccucaaauccuagaaaguauuguggguuuguuguuguuguugauguuguuaauugcuuguauuuucugcuuaugggaaggaucucacauuaaaguuaucuuauuuuaa

SEQ ID NO: 192359 - RNA, 34664 nt, Homo sapiens
ccacaaaaauauauuuaauaagcuuguuauauaaaaucaaacacuuaacauugucaacauuucuucaguuauucaaacucacugauaucuaacugggaguaguuuguauucuggaagacuuccuaagcuaaaaguauauuuacauauuuacaacacauguaaauauaacugaagaacuacuucaaauaauguugaaauucacagaauucuagagauuuauaguuauaguuuagaaguaucaccaauuuguuugcaaucaaauguacagcacuaauuaugaaaaauguuuuaacuauuaaaccaaaaggggagaaaaacugggagggaaauauaugguguuaaaguccugugauaaauacuuagaaaauuaaaaaguaauaauauacauucgauuuaaugaccaaaaauuuuuuuugaaucccugguugucauuuuugguagcuuaacccagucugucagaaggcaguaugcuaugcugucaggaacucuccacugccucgucagagccaugcuaaaugcaguaacagcacuggcugaaaauaaggaagaugauguuagcaacuuugaguuucacgcaccuucccaauacaggcuaaguauuccugcuuauauguauuccugaaagauuaaaaggcccgucacccauucauaccaaaaaauacuuucucaacaugcuuuaaaaggauuccuuauuuuguuuuuauuuuuuuauuuuuuauuuuuugagacaaggucuggcucucucucucucaggcugcagugcaaguggugcgaucuugacccugcaaccucugccucuugggcucaagccauccucugaccucagccucccaaguagcugggacuagaggcacacaccaucauacccggcuaauuuuuuuguauuuuuuguagagauggggcuucaccauguugcccaggcuggucuuaaacucguggacucaagcgguccacccaccucggccucccaaaaugcugggauuacaggagugagccaccacgcccagcuggguuccuuacuuuggagaggggagacaaacauacaucauauauaaauauuuaucacaauaagguuccaaauccuauuuuauauuucaacuacaucaugguaauauuuaaaccaucccuuuccagacaauauuucacacuacagcgguaaacuuuuuuuuuaaaaaaauaccgcagauucuuuuuuuuuuuuaaagaagguacuacugcuguaagaaguuaacaaguaauaauuuccuauuuaacaucuguucauaaugacauuuccgcugcguuuuuuuccaucaagaauaccaaaacaguuuccuaauauacaguauuugaaaguguuugccauauuggcucuuaaaaugauagacuaauuuuucucauucaauaaaagaaaauuucuaauaacaaaauacauguaaaguuagaauuuuauaauuuccacaaaggaagcagcauuuauuaaccagaguacuuguuugcaauuuuuuaucugugaaaauauuuuaaagcucuuacaaaacuuaaauuuuuaaaaaaucagcucaaaaauuuuuuccauguuguugggcauaccacugcugucucugcuuucgguuuuccaacucuguaagaagggcuugucuguaugcuucauacauuuuaacaaucugcuccaauucuuucaugaagagcaacuuuagcauucccugguauguauccaggucagccagcuggaagaguucccacuucagaauguggucauaucuguuuuaaaacacaaucauauauauguucacaacacauacauaaacauguauuucuagcaagaaacuagucuguuuuuuaaaaugucaacuuuauuuauaacuaaacaaaccauaaguuuuaauuaaaaauaacugggcacagugguggcgccuauuauagucccagcuacuugggaggcugaggugggaggcugaggugggaggacugcuugugcccaagaguuugaggccagccugggcaacauagcaagacccuguuucuaaaaauaaauaaaucaguuuuuuaaaaaucugaguuauuaacugcuauuuacauauaauucuuuguugguuuguuuuuuugagacagagucuugcuaugucaccaggcuggagugcaguggcgugaucucagcucacugcaaccuccgccucccggguucaagcaauucuccugccucagccucccaaguagcugggauuacaggcaugcgccaccaugcccagcuacuucuguauuuuuaguagagacagaguuucaccauguuggccaggagguucucaaucuccugaccucguuauucgcccaccucagccucccaaagugcugggauuaacuuugggagccaccgcgcccggccuacauauaauucuucuaagcaaaggagaaaacugcuaauauuacuucauuucaauuuaaguuaaagaauaccuauuucuuuaaauuacccauuauucuaauauuaacaccagacaaccuugaacacagauuucaaacuacagugguucuauaauuucugaagaacauauuuugugcuacuuauaaguucaucaaaaguuaacugucaggaacuuaagaauacuuuagaccauauugugcuugcaaaugauaaugcacaaaaauggauggucauuugcaucauucauguugaugcaucuuuuugaggaaugcuauucacaacagcaaacaaggaaccaaacagaaggagaaaugaagaggaacccucaauucguggcucuaaguauucuugaggcugaguacacagcaucuaaaaaaacaaacaggaaaacuaaagaaggaaagaauaaacuuuuuaaaaugagagaaugaguagacuauagaaggcuucaguguggugaaggauucacaaaagauucuguuuacauauaucauggaagaccauuaguagucuuucagugguaaguagaucccugcuuagcaguaguaccuuuaguagucggcuacauaguuccauuucaguaugugaugaagacagcacuguaauuaauauucucauuuuaaagaugaaaaacacuaaaaccuaaagaggcucuuuaccucuugcaaaagugcuuagugacuaaaaguucaaaaaggaagagaacuauggaccaagaugcuucaaaauagugguuuucaauguuaauauccacuaagacuagacaaagaacuugaauuagggaaacgcauguuauacccgaaauuauaccucucaaaucauacugcagagcagacauaauaggaagcuuugauugcaaacucuagcauuauuuuuaaugaucguuuauaguauuuccuacccagugguucuuugauauuauaccauuuucuuucaaaaggacugucuaauauuuuaaaaugagauuuuaaaaaagggagauagaaaacauaccgagcaguuagugugagccacuauacuuggcauuuugacauguuucuauucaacuugaguauguguaacagaaaugucaguaauacaacaugcaaaaacuggaagguaaauauauuuaauuggacugccaauuucacucaguuacuugagagcugcaaauuuauuaauagauuuagauuucuuugguaggaagcucuguucuuuuuaaugggaaacuccaaccacuugugaacauaaauuagagugauacuguaagaaauacucaaugagccuccaugaagaaacaguuauaagguauuucuuagaacauccaccauucuuguaacuuaagauuuuaugugcuccuuggaaacaaauucauaauuccuaacaaaaaaucuuaaucucccagaguuagcuaagaggcaauucagcaaugucuacuaagucaagaugguuaccauuuauaccaggugaacuacaacaauguuaaacuaaucuaucaucuguguacuuucuagcaaggaaaacaaagaacaaaaauaagaugguaaauauuauacuuauuuuuaagacacgaauaucauucuguauaaguauucaaguuuugucuaaaggaagaaaaaaucuucaaacaauuuugucaguuuuuuuuuuuuuuuuuuuuuuuuuaagagaugaagaucuccuaugucucccaggcugaagugcaguggcuaaucacaagcacaaugccacuacugaucggcacaguaguauuaaccugcucccuuuccaaccugggccaguucgccccuccuuaggcaaccugguggucccugcuccugggaggucaccauacugaugccaaagaguacagacauccgacuggcauagugcaucacagcccagaacuccuaagcucuaacaauccugacucugccucucaaguagcuuggauuacaggugcaccaccaugccuggccaaguuucugacuugccaaucagcauucagcaucaagaguacgauuauggguagaagcaacaaaaucagauuagagaaaauccuucugggggaagaaagugcacuccaagaagggcacagaugugaaaaaacugcaaagcauggaauggaaauccuauuccaaauucuuuccucuguugcuucuacauaguuacuacccuucugccuauaaucaccuaaguguuccuucuuuuucugaaaaguauaaacucccauucuuuccuucuuaacuagccaagaaauuugcuuccacaaguuuaacuuuuagucauuuauacuguauauacacagguaaaucauuccgaaaauuggguguaaaacacuccaguaguccaugcuucuagcaucucuuucacucuguuuuuccuagggcaguauucuauucaaauacuacuuauaaauaagccauauauacaaaugccaguugcuauaaugcuaccaaaaauaaccuguccacacugcaugcugacuucaagaucaacagugcugcuauccucagcuccagguaucaccauguagccuaaguccccugcacccacccgccauaacacuguguccacuccucccucuuuuucaccuguauccagagcagggucaauggugacacugcaggacugccaagccacuggaauaaaaaauaccccugccacacacugcugaggacuaguguuuuggugugugugugagaaauaacagaaaguaaauauguucuugacaauguuuuugcugucaaagauuaaauuuuauuuuauuauauuuuauuuugagauggagucucgcucugucacccaggcuggagugcaauggcgcaaucuuggcucacugcaaccuccgccucccggguucaaaugauucuccugccucagccucccgaguagcugggacuacaggcgcgugccaccauacccagcuaauuuuuuguauuuuuaguagauacagaguuucacuguguuagccaggauggucucgaucucucgaccuugugauccacucgccucagccucccaaagggcugggauuacaggcaugagccgccgcacccggccuaacuuuuaaaauuuuauccuauaguucagcuugaguacaguuauaccaagcauuauagacuuuugugagcagacacaggaacauaacuuuacaaaaauuaaauacaaauuuaaaacacagucuguuucuaaaucaaguuuuagaaguauaugcaaaaauuguguugguaaauuacugugagagauaggauuaaagaauuucaggauuaaagaauuucagauucucaauugucugaaaaacaaaaggaagaaacaugcaaauuuuuuuugcaaaaaugucucuuuuuguugugauaauugauucucauuaucuaauucauagauaaccacucacccuuuguugauagaauauuaaccauuuccauccucuucagcaacauuaauuagaaucaacuagaaagcaacaggcuuccagaccucuuguuuaaguuuuuaagcaguaaagaaguauaguacuugcucccuuuuugucagucuggcccauuuuggaagaauuacaaccuauuugcuaguuuccuugaguuuuauaguuagcucacagaaccacagaauucaaaaagacuauaaucuucaggaaucuguuucuuucuguaagaaaccaggaauuccauuuaaguacuaucucuucccccaaaaaggaaagauuaugcuauuucuuauuaaacaugacuauagaguagaaauaacauacaacagaaagaauaacucuccucaaccauauccacccccagaaauacuaagguuaacaguuaggcacauauucuuccagauuuaaggaaaauaaaaacgcauacagauauuauguacuauuuagaaucagcauacaaacauacagcuguaggucaggugguaucaagggacaaagaaaagaggaaaauaggaaagaaaaugccaucugcuaucauuccuuuuucuggcacuaguaggggggcagucagggucucucaugcucugucacccaggcuggagugcaguggcacaagcauagcucacugcggccucaaacuccugggcucaagcaguccucccaccuuagccucccaaguagcugagaucacaggcauacaccacagcaugcugcuaauuuuuaaauuuuuuauagagacagaguccugcuauguugcucaggcugaacuugaacuccucagaucaagcuauccucccaccucagccucccaaguacuugggacuacagaccaugcaaaaagccuggcuaauuuuuaaaauuuuucuguggaaauggggcucucguuauguugccuagacuggucucgaacuccuggacuuaagagauccuccugccucagccucccgaagugcugggauuacaggugugagccacugugccaagcccagguccuuacuuuuaucacaaguacuguaucacuuauuuacaaauuaaucuucuccuaugagaauguaaguuucuuacuuguaucccuaauagcagaggcccgcacacaaagaaaugaagauucuauaaaugucugaagaacuaauauuucuaauuaaugauuuucacacauuauaaacuaugacauccuuuauucaagucacguauuacuuagaagccgaauauuauuaagaguaaaauauggcacacuacuuggaucgagcagcccagagacuccauucagcccuucacucacuccucaaacaaauuuguguuguaaauguacuuacuucacaggggcucgugcguaaaccugaagccagucaggaauuucugcaguaugauauggauuugcagguaccagaagggacugauuucuuucaguuugcuguggcugguaugugacaggaggugguugaucauaccgagguacacuaagaagaaaggagugacauucuuuaggauaaaggucuuaaaaucuaaacaagaaauuauaaagaacaaauaauacuuaagcauuuuucagugugccuucuguccaaacugacuuacaccaccugaaagguaauguauuuuuaagauauuucuucuggcugguauuuagucuuuucaaaaacagguucaaaggaggauaugaaaaagcuggaacuaaguuuuaaccuuuauacaaaggcuuaaaacuagaauaguaaauucccacaagaaauagucaucagcuguaaauucauaucagaaagguugacaguuucuaagaaaggauguuuccuuccucccguaggcugaaaauggggguuaggauauguagugacgcagcagugaguauuguguuugaaauaucucuauccaaugcagauaacuuuucaacuuuuaccaacucaagagaacauaugggagucagaguugaucagaaccuauuuuaagucacagagauuaaaaaaaaaaaagaccauacuuuaguucuaauagccuguguaugcuguggggaguggagauauuauaugggaaaguguaaggaaagcacugaaccaccugaagguuaauagcugaacucgaagcggccaaaagggucuauuugagaccaaaaggggucugcaccuucaaacauaaagauuuauguguauauguggccaacaagcauaugagaaaaugcucaacaucacugcuuauuagagaaaugcaaaucaaaagcacaaugaaauaaauaccauuccacaucaaucagaauggcuauuauuaaaaagucaaaaaauaacagaugcugguaugguugcaaagaaaaaugaaugcuuauacacugcuggugggaacauaaauuaguucagucacaguggaaagcaguugggagacuucucaaagaacuuagaacuaucauucaauccagcagucccauuaaugggacuauuucuacaaaggaauagaaaucauucuaccauaaagaaacacgugugcacauguuaauugcagcacuauucacaauagcaaagauacgguaucaaccuaaaugcccaucaauggugggcuggauaaagaaaaugugguaugcagacaccauggaauacuacccagccauaaaaaagaacaagagcauguagucugcagcaacacugauggaacuggaggccauuauccuaagugaauuaaugcaggaagagaaaacuaauaccacauguugauagguaggagcuaaacacugaguacacauggacacaaagaagggaacaauaaacauugaggccuacuugcgggcagaggaugggagaagcaugaggauugaaaacuaccuaucagggaccgggcgugauggcucacaccugaggucgggaguucgagaccagccuggccaacaugcagaaaccccgucucuacuaaaaauacaaaacuuaaccaggcuucaugaugcaugccuguaaucccagcuacuuggaaggcugaggcaggagaauugcuugaaccugggaggcgaagguugaggugagcugagaucgcgccacugcacuccagccuuggcaacaaaagugaaacuccgucucagaaaaaaaaaaaaaaagaaaagaaaaacuaccuaucagacacuaugcuuauuacccgggugauaaucuguaccaaauccccaagccaugcaauuuacccauguaacaaaccugcacauguaccccugaaccuaaaauaaaaguuagggagaaaaaaaagaaaaugugguguauauauaacaauggggagaaaaaaaugcauguguauauuagaaaaggucacuguuuacuaaacugggauuaaaauaagguuagauuaugcugugguuaacaauuuuaaaagaucaauaugcaaauggaacugaauucuaucuucaacucuucuuuccuaaauagguucaaaggaaaauguucuuugauaguacaacugggggugaagaagaauugggacuuugaagucagguacgccuggauuugaaccacagcuuuaacacuuacaaacuauguaaauguaagcaaaacuccuccuaucccuaagccucagccuccauacuuguaaaaguggaauaauaaauucauaccacaggugguuguucucaggauuaaaugaccuaauguaagucaagaauuuuguauaaggauuggccuaagauagacaaccagacaacuaguaauacuacauaugugagcuuaagggcagcguuuauucucucuuguucaacuucuaccaaguugcugagagaaguaaauuaacuaauuaugaaauugcuuuuaaaaaacuauuaaaauucuguaauaacauaagguuaaugaugauuguauuagucuauuuucacaauguuauaaagaauuaccugaaacuggguaauuuauaaagaaaagagguuuaauugacccacaguuccauaauugggaggccucaggaaacuuaaaucauggcagaagaugaaggggaagcaaggcacaucuuacgugguggcaggagagagaaagaagggggaacugccacacacuuuuaaacuaucagaucucaugagaacucacuaccagaacaacaugggggaaauggcccccaugauucaaucacuucccaccaggucccucccuugauacauggggauuacgauuugagaugagauuugggugaggacacagagccaaaccaugucaacgaacagaaaaguaaacucucaaaucugguuaucuggacugcaacaaucauugccaccugaugaccacaccacagguuugauucuuucaaaggacaacaaccucaguaguugaauaaacacugauugggugccacuacauggaaucaugggaaaaaacagauuuucaaaguugaauuaauaaauccaaauacauaaaauaauuaaaacaacacaauaaugauaaagcuuaguuuuccaguugauaauccuaaaacacauuuucauaacuauuuuaaugguucuaagaaaauacaaauguccacuauaaccaaaaaacuguauuaugccagaugacacuaagcaacauuuaucaaaaugcagaugauauuuuacucauuuuuaaucuuguggcucagcuuuugaagcucaaaugugguuaauuugaaauauuugcaacuucauuacuaaacuaauacuagcuuuuauguacuuugaaauccaguguguauuuacacuuacagcacaucucaauuuauauuaaucacauucaagggcucaacagccacacgugacaacuggcuaucaggcagcacagggcuaaaagucuggcaacaaagcagaucuacccagcccaguaucaaucaaaacagcacaaagaauuacuggcuauauuuauuaaacagaaaugggauguuuuguucagucccaauuuucacuuucuugucuaguaauagcaagaaacagaacauacaaucaugucugaaauagaauaaacagcaaaauguuauaauucaauuguacauucugacuuaggggguaggucuguuauuauuuguaaaaauuuaaguguaagaaggcagaagcuuuaauuauuuaauuuucuggacaccuauaacaaaaacauucuggcauuacuacagcagaaucugaucauaagaacaaugaucuuguuuuugagguuuuuuuaaagagaaaaguauuuuuuuaacuuauuaaagucauuuauuacuaaauguauguccagagaaaaauguaaauuuugaaauauaaggcuuucaaaucucaagcuuuaggaugcuauucucuuagaugaaaauaucaguucaaaaccuaacauuagacaaucccgaaacaaaaaguugaaaauaaaguugauacuguaccuaggagcacagggaugccuguauugggccuucuuauuugugugaucuacauaauagguuccaaauucggaugacucaacucguucccauccaggaggaaguccuucucgcucaagaggauggcuccagugaguuguauuuguguuaugaucuauauaauauuuucucccucucauuguccaguccacagaccagccaggaggaagggguaaaucuucagaaccaugguuagucaaauuuccuaaagauguagcagcaacucucccaauaccuacggggaaagagaaaaugauagagaagaaacagaacaauuauucaaugcaaaaaaugugccagcuagcaaagucacaacauuaacuauccugauuguacucuucuauuuaaauucaugauuaugcccauuaugaugguuuucauaaaacuagucgguauuacuauuaaggaauuauaaaaagggggaggaacuagacuuugaaauuaguagaggguuuuuuggcugaugcuuccaucaacaggccauacaaacacuuaacaacagguugagcaucccuaauccaaaaaucugaaauuugaaaugcuccaaaauccaaaacuucgagagcugacauguugccacaagcagaaaauuccacaccugaccuuaugugaugagucauagucaaaauucagucaaaacuuuguuuuaugcacaaaauuauuuaaaauauuauguaaaauuaccuucaggcuauguguagaagguauauaugaaauauaaaugaauuucauguucagauuugggaucucuucccaagauaucuuauuauguacauacaaauauuccaaaauaaaaaaaaaaauccaaaaucucaaacacuucugguccuaagcauuuugggguaagggauaaucaaccuguggcaguaaagcuacuuaaguauguauacugccaaaagaaaagugggaaaaagaaaauuuccccugauuaaagauuugacauuucagcuuuaaaaaaaauguaaaaaugaacuuguaaaaccauucccgguuauaaauucuuaaaaguaaucuggcugugcccuagaauuauuaaguaagcuuaagguagcaggguuaaggucaccauacaaaaauuaauauuuauauauuaacaaacaacaacuggaaacaaaaguuauugagauaauauaauuuauaauagcuccaaagaauugugcaggaccaauaugcuaaaaacuacaaaacacugaugaaagaaauaaaaaaccuaucacauuaacggauuggaagauucgacauaaaguuaagaugucaauucuccugaaauuaucuuuaucuuuauaggagucccccccuuauccaugggggauccauuccaagaccucccguagaugccugaaacugcagauaguaccuaacccuguguaugcuguguauuuuccuauacauacguaucuaugaugaaguuuaacuuauaaauuaggcacaguaagggauuaacaaaaauaaaauugaacaauuauuauaauaaaaacugggugaauguaaucucucucccucucucuugaaagaucuuguaccauauucaucaauuuucagacugcaguugcagagguaacugaaacuguggaaagcaaaaccauggauaaagcgagacuacugucauuccaauaaaaauuccggccgagcgcaguggcucacgccuguaauccgagcacuuugggaggccaaggugagcggaucaccugagguccggaguuugagaccagccugaccaacauggugaaaccccgucucuauuaaaaacacaaaaauuagccgggcgugguggcggacgccuguaaucccagcuacucgggaggcugaggcaggagaauugcuugaacccgagagcagagguugcagugagcugagaacgcgccauuacacuccauccugggcgacgagagugaaacucugucucaaaaaaaaaaaaaaaaaaaaauuccauggaguuuuuguagauacagauaguuauuaaacagauuuuaaaauguauacugaaaggcaaaagagaacuagaguagccaaaacaauuuuuuugaaaaagggauaaaguugaaggacucacacuaccugauuuuuaaggcuuacuauaaagcuacauuaaucaagacaguaugguauugucagaagaacagacaaauagauaaauggaaccaaacagagaauccagaagaacacccacacagacauggucaacugauuuuuuuauaaaggugaaagggcaauagcggggaaagguuuuuccaacaaaugauguugcaacaacuggacauccauaugcaaaaaaccuaaucacaaccuauaccugccaccuuacauacaaauuaacuaaaaauagaucauauaucuaaauuuaaaacuauaacgcuuuuacaagaaaaaaauagaauaaauuuucaugaguuuaguuuagacaaagaguacuuuuuuuuaccaugaugcugaaaguucaacucauaaagaaaaaauacugauuaaauugaacucugucaagauuaaaaacgcuugugaaggacacuaagagaaagaaaaucaagcuguaaacagggagaaaauguuugcaaaucacauuauuagccaaagaacucugaccuagaauauacaaagaauucucaaaacucaacauuaagaaaacaacccugagccugcugcagugacacgcaccuguaguucaaccuacucaggaagcugaguaggaggguuacuugagcccaagauuucaggucuguagcacacuaucaucaugccugugaacagcuacggcacuccggucugugcaacagagugaaaccccuucucucaaaacaaaaacagaagaagaaaacaaaacgacccaguuaaaaaaaagggggguaagaauuuuuaacaggcacuucaccgaagacaacauauugaugguaaauagcacgugaaaaaaugcucaggaucauaauuagccgugagagaaaugcaaauuaaaaccauaaugaaaugacaauacacgucuaugaaaauggccaaaaaaccaaacaaaaccugacaaugcaagugcuuacauggauacagaacaauuggaaugcccauacacugcugguguggaugcaaaaugcuacagucacucuggagaacagcuuagcaauuucuuauaaaguuaaacauaugcuuuucauaugcuacagcaaucccauucccaaauauuuacccuagagaaaugagaagucaucuucacacaaaaucccauuuguggauauuuacaaugacuguauucauauuugccccaaaguggaaaugacacacauguccuuuaacagaauggauaaacaaacuguggugcaacuguacagugaaaucuacucaggaauaaaauggaacuaauuauugguacaugcaagaaucucaaagaugaaucucagaaguaucaugcugagggaaagcagccagucucaaguggcuacaaauuguacaguuccauuuuuaugagauucuuccaaacacaaaacuacuaggacagaaaacagugauugcuaggaacuggaggugagggacaggaguugacuauaagaggacaaccuaagggaauuuuagaggguguuugaaauguucuguauucucauuacacaggcauuacaugaaaucuauacauauguuaauacucagaacuguguaacuugaaaaaaguuaaauuuacuauacuuuuuaaaagaauaaucuggcugcauaauuuuauucucacacaagaauacuaauaguuggccgggugcgguggcucaugccuguaaucccagcacuuugggaggccgaggcgggcagaucaugaggucaggagaucgagaccauccuggcuaacacggugaaaccccaucucuacuaaaaauacaaaaauuagcugggcgugguggcgggcgccuguagucccagcuacuugggaggcugagacaggagaauggcgugaacccgggaggcggagguugcagugagccgagauugcgccacugcacuccagccugggcgacggagcaagacuccgucucaaaaaaaaaaagaauacuaauagcauauguauaacaaaucaccccgaaacucaguggcuuaaaacaagaaguauuuauuugguucaccacagguuggugauacuggcugagcucaguaaguuuuuuccuugauauuugguacaaguuaucuuuacugucucauuacuugaugaaaguuaucucuuguauaacuuucaauaugaagcccuacugaugaucagaccuccauuucuucucugacuuaagcugcuauuuuuuuuacccuuagcucacucuguuccagcuacacucaccuccuggaugcuguucucaaacacggcagguacuggcuguuuauucucccuagaagauucuuccuucagauauucucuuggcucacucucacccucuucaagccucuucucaaauguuucaaugaagcuuauucuuacuauggcagucuacaucugcugagcuucuacuuaccguuuuacuuuuuuaaaaagcacuuuaaccuuuuaacuuauguaauuuuaguuuguuuauuuaccuacaagaaucccacaaagaagauucuuaggacaggaaucuuuguuuuguucacagauacaucuccagucucuagaacagugucuacagaauaaagcacauaguaaguguuaaauaaauaagcugcaguaauaaagacaguguaguauuaguggaggagauacacacaucaaugagacagaaacugcauaaauauuuuccuugauuuuuggacuuauuuugccucuuucacucccauauuuuacuaguucugaaacgaagguguuuuuuauaaucaagagaguaaaucuguuagccacuaggcagcaaauacagauguauuaucauugcuggugcauguucuaacacaguccuaggaagacaguaugugguucauacuauuauuaauccucauuauuuguaacaguugcaccccagacaaaauuuuaacauaaauuugaaucccugugccugaaagguacaaggauacagcauuuaaaugaaaaguuaguguguuaacagaagacugccagucaacccaaggcccuaacugccaaauuuagaauaucucagaauggucaaaauaagaaagacugggugaccauugaggugugaaggaguaccaugccagagcaaaacaucuacuagucaaaaguucccagcugacuuugaagagcuuuuaaaauuacaguuggcuggaaacuaaggcaaaaugaaaacaucaaguuuaccuuuaaagaaaggcaaaugaaacagaccccagugacaaaagguaauuuagaagaaacuuuaaaauuaagguaaaugcuucaauucaaacucagauucuaaagaaggauauguaaguguauggauaaauacggguuauuggcaugugguuuaagaaacuguuuuuauuuaaauacaacauacaaugcauaugcauaaggcuagucacugcagcaacaucuauaguugcaaaaggcuagaaaucaaccaaauguccaauaauagcaaacuggaugauuacacuauuacacgcacagaacagaguacuauauuauauagcuguaaacaugaaugaagaugauuucuauuuauugcccuggaauaauauucgggauguauuaugugaaaaaagagucuggacaguacaccaccauauauacauauauguaguagccagccaguaaggugaaccugggccccaauuaucccuguccuccugggauucacacccuugucugugugaccaauaguuuauggcagaaaggauggugugugacuucugagauuaggauauaaaagaccgugcagcuucugccuuggucaaguguacuugcucucucaucacucacccugggggaaaccagauaccauaucaugagaagcccaugagugaggaauugaggccuucagccagaacugaagccuccuguuaacagccuugugagugaacuuagaagcggaucuuuuggccgggcgcaguggcucacaccuguaaucccagcacuuugggaggccaagguggauggaccaccugaugucagaaguuugagaccagccgggccaagacgacaaaacccuaucucuacuaaaauuacaaauaauuagcugggcguggcggcacaugccuguagucccagcuacucaggaggcugaggcaggagaacacuugaaccugggagauggaggaugcagugagccgagagcgcgccacugcacucaagccugagcaacagagagagacucugucuccaaaaaaaaaaaaagaaagaaagaaauggaucuuucagccagagcgaagcuucggauaacugcagccccagcugacgugugugaacuccaacuucaugagagauccugagucagaaugaccuggcuaagccgcuuccaaaauccugaaccacagaaacugagauaauaaauguuuauuguuuuaugccaaugaguuuggaaguaauguguuuuacagcuacagaaaccuaacacaauacauaugaaagagaauaauaugaauacauauuuuacauauauauguaauuuguaucuauuuucauaaaguguugcaaugaaauauguaacaaaaauuaauaaaauuggguauuuacagggggaggaaggaaaugggguggaagaggacagggguagaauuaauuuucuaaaugcauucuguuuuaucauuuugauuuugcaaccuuuuaaauauccuauguaacuuacaacaaaauuaaaucaaaauuuagaaaaagcaaucccuaaaaagugaaaacaaaaugaaguaaacaaaucuaagaguacaugaagcagcuaaagcauacuucagaaaaauuaauucaaagugaauuuuauguauuacuuauuuauuguuauuuauuuuugagacagggucucacucugucacccaggcuggagugcaguggcacaauuacggcucacugcagucucaaccuccugggcucaagcaauccucccaccucagccucccaaguaggugugacuaugggcaugcaccaccaagccuggcuaauuucuuuuauuauuuuuuguaaagacagggucucacuauguugcccaggcuggucucaaaacccuuagacucaagcauuccucccaucacagccucccagugugcuaggauuacaggcaugcgccccugugcccggcccaaagagaauaaauuguacuuccucaucgggaaauauccuaaauuuaaaaaauaaacuacaaagaaaucuucuguuuuauucaguaaucauauugucgaugauacuauuuuuaaagcuaguuaugcuacagauaaagcaaaugaauaguuacauaauugucaacaggaaccaagauuuucaguaugagaaaaaaauaaaaaccuaaggcaaaaagaagguaguucaaugugaauguacuuacugccaacaaacuguacacuuaaaaaugguuaagaugguaaauguuguuauguguauuuuaucacaauuaaacauuuuuuuaaaaagcuaaaaguaaaaacuuggaaaucuuaaacugccaacaguaugaacucauaaugaauuucuauuuccagaaagcaacaaaacauauuucccagauauguccauugaaaaggucuacaagcauuaauccaccaaauagcaaugaguacaagagugcaaucccugaauacuauuuccccaucgaaaggaaccagggauccuuagaaugguugaguacaggacugaggcagaaaaugcacaauaugagccuggaacaucuagucacauuagaaagcaaagagaaauaaaaaggaaccaacauugaaagggcuccugccaccaaagcagcagcaauuuaaacaucaaaaggaauuaccacaccaauaauuaaaacuaaguauaaaaaucuuaaaaucaaccagcucaucuuggagaaacggcuucugggucagggaaaauacaugauaauauggaacaugagaaaaacaucagacuuuugaaauugaaaaaaaaggcugggcacaguggcucacgccuauaaucccaacacuuugggaggccaaggcgggugcaucaccugaggucaagaguucaagaccugccuggccaacauggcgaaacuccaucucuacugaauauacaaaaauuagccaggcgugguggcacguggcagugaucccagcuauucaggaggcugaggcaggagaacugcuugaacccgggagguggagguugcaaugagccaagauugugccacugcacuccagccugggugacagagggagacgucuaaaaaaaaagaaauugaaaaaaaaaugaauugaaauugagguacaaucuacaaaacauucuguacuccucaaaacugucaaggucauaaaaaacaaaagacugagaaacuagcauagauuaaauaagacuaaagacauacaacaaugaaaugcaaugcaguacacucuggaaugaauccuagaacagaaaauaaacauuaauaaaaaaaugauaaaauccaaauaaagcuuggcguuaaaaauccaugaguucaugguuacuuuuguagguggcuaggguaucaauucaucauucugaaauagcaaacaaaggaaaagaucuagcauucaacccuucuuuccuauaugaacagcaaccaaauaauugauaaaguccuuaauuauaauauuccaacuaauaaagaagaaaugacagaauucaaguaucaaaauuugcaacacuuagacauacuuuggagauauuucagguuugguuccagauuacugcaauaaagugaauauugcaauaaagcgaguuacgugaauuuguuuguuucccagugaaccuuaaaguuaucuuuacggccggacacgguggcucacaccuguaaucccagcacuuugggaggccgaggcagguguaucacgaggucaagagaucgagaccauccuggccaacauggugaaacccugucucuacuaaaaauacaaaaauuagcugggccugguggcgcauacuuguagucccagcuacucgggaggcugaggcagcagaauugcuugaaccugggaaguggggguggcagugagccgagaucaugccacugcacuccaaccuggcaacagagugagacuccaucucaaaaaaaaaaaaaaguuauauuuuacaauauauugcagucuauuaagugugcaauagcauuauaucuuuaaaaaaaguacaggucuuaauaaaaaaaauuguauugcuacaaaaaugcuaaugauuaucugagccuuuagugaguucacagcaucuuuuugcuaguggagggucccgucuccauauugauggcugcugacuaaucaggcuggugguguuugaaggcugggauagcuguggcaauuucuuaaaaacaacaaugaaguuugcuccaucaauggacuuuaccuuucaugaaagauuuuucuguagcaugugaugcuguuugacagcauuuuacccacaguagcauuucuuucaaacuggccucaauccucucaaauuccacugcuacuuuaucaauuaaauuuauuuaauauccuaaaucauuagucauuucaacaauauuuacagcuucuucaccaggaguauauucuaucucaagaaaccacuuucuuugcucauccauaaaaagcaacucaucuguucaaguuuuaucaugagaccagcagcaaugcagucacaucaucaggcuccacuucuuauuuuaguuuaguuugcacacaagugcaauuccuugugaugucccaaaacaauuacaauaguaacaugagcaaucacugaucacagaucaccauaacaggcagaaaugaaaaaaguuugaaauauugcaagaauuaccaagaugugacacagagacaugaaaugcgcacgugcuguuggacugccacaaaccuucaauuuguaaaaaacacaguaucugcgaaacacaauagagcaaagcacaauaaaaugagguaugccuguaauagugcuagccaaugaucauuaauggcugccaaaaaccaauaauagauaaaaggcuuauggagaacuucaugaugauggaugaauuaagcugacaucuguacccauggcugcaucuuaacaucacagacaaaucagucauuauaugucacuggaaccuaugcaauagaaaguacacaacauuaucuaugcaguauucuggcaaaaaggaugcaagaacaaaaacagaugcaagaacaaguagaucacccuuguucgguacccuuucaaaagaaagcuaacauauaauuuuuuaaagauggugacaauaaaacagaacaaaacaagccuuuuggugaaacugaccuuaggcuucuauuaaacugcaauugaaaguuuaauauguauaguuuaagcaacuucaguacuuaaagagaaaauauuuaaacagaaaagaagccaauguaugaaacacauguacacagcaaaugacuuuaauaucacaucguagaaacacaaaauuacuuuacauucuaauauguucauuauguuaaaaaugcuuuacagccaaaaccaagcauaacaauguaacaauuuuuucuaauguauagucaauucaguguauuuauaugaguuacuuauaaaagccauaauauuuuggcuaacagagcuucccucaggaaauauauaauagaaacaaaauucuaaauacugcauuauuaaaaacaaaagcugccuuuuuuuuuuuuuuugagacagagucuagccucgucccccaggcuaaagucagugaugcaaucucggcucacugcaaccuccaccucucagguucaagcgauucuccugccucagccucccgaguaggugagauuacaggaaccugccaccaugccuggcuacuuuuuguauuuuuaguagagaugggguuucaccguguuggucaggcuggucuccaacuccugaccuuaggugauccaucugucuuggccucccaaagugcuaggauuccaggcgugagccacuauacccugccuaaaaacaaaagccuuuauaguaauuaaaaacaagacaagggccaggugugguggcucaugccugugaucccagcacuggggggccgagguggguggaucaccugaggucaggaguucacgaccagccugaccaacauggagaaaccccaucucuacuaaaaauacaaacuuagccgggcaugguggcauaugccuguaauuccagcuacuagagaggaugaggcagaagaaucacuugaacccaggaggcagagguuguggugagccaagaucgugccauugcacuccagccugggcaacaaaagugaaacuccgucucaaaaacaaaaacaaaaacuauacagguuuagagcguauuaaaaguuuguggcaauuucaucuauuaagaaaacccauacuuccauauauguacugaacuugccuaaaucuagaaccacauguacucuuacauuuaaacaacauuagguaccaaaagccauaucugacuauaaauuugggauucauauuuaaaggaagcacaaagaccucucuguaaauacucucauuuuuaaagccugacaauuugauaaaggagccaugaaguacccaaaaaguugcaaauaggcacaucagcuuuacuaacgcuauuaaaaaacuccaaugcccuguaaagccaugauuccuaaacuuucuuagagauaucuauuaauaauuucaaaacauaccccaacuguauuuuuuuuuuuuuuuuuuugagauggagucucacucuugucgcccagguuggagugcgguggcgcgaucuccgcucacugcaagcucugccuccuggguucaugccauucuccugccucagccuccugaguagcugggacuacaggcacccgccaccacaccuggcuaauuuuuuguauuuuuaguagagacgggguuucacuguguuagccaggauggucucgaucuccugaccucaugauccgcccgucucagccucccaaagugcugggauuacaggcgugagccaccgugcccggccccagcuguacuuucugaaagcacaaugugugauauauuuuuucaaauuauuauuugggauaauuuuacaaaaucuauugagauaaauguacaguacaaaacaaugcaaaccacuguucuaaagcauaaagcauuaccaaaacagauccagaagauuaaaaaauaaaaaagcuaugucaagcucuaauaaaucauuccuccaguaugaguucagccagaaagcucaaacuucaauaacuaacaucccaaguaugugggaaaagcacagaacacaaaacacucacuuuuuuuuuuuuuuuuuuuugagacggagucucacgcugucgcccaugcuggagggcaguggcacaaucuuggcucacugcacccuccacaccgcggguucccugguucaagcgauucuccugccucagacuccugaguagcugggauuacaggcacacaccaccaugcccagcuaauuuuuguauuuuuaguagagacgggguuucaccauguuggucaggcuggucuugaacuccugaccuugugauccaccugccucggccucccaaagugcugggaaauacucacucuuacaaaggacaugugcaaacaguuauggauguguauucuauccccagcucuuuccauaugucuuauuucauagccaaaacugcucuaggagguaguacuauuaccaccaauuuacagaugagaaaacagguucaagugaauuauuuuaccaguggucacacaacaagugguauaaggucaaaugcaaaccuguuacuaaccauguaaucucagcaacaaaagaucaauuguuauuuauucuuuaaagaaaaauaugacuaccacuaguaaaagaaaaagcaagccaccaauuuugauccaaaucagugggaaaaaaugguaacuucaguuuuugagugacaagaacaaaauuaccuuucuguaauuucaaguaguccuugaaaguaauaaacuggauucacaauuaauccucaaaacagcuucuauuugcaggaauuaacugcacaaacaccuucuauuaauacaaaguaaaacauucacacacuaaacauaugacuuagucgaagacacagauaaaguauuauuuucucucucagcuaucaguagaugugccaaaaaacuuaaucucauacaaccaggcagauauuuaugagaucuaccauuaugaauaagacucaaauaggccgguuuccaaauuuuguaguggcuacagagaauaaaauggaucuagagcucuaacacaguuccacagggucccuaguaauggaugcuacacauuauuagcauguguuauaaucaagauguugauaaaaagaucuaaguauuaaacucaaccaaaugcuuucucucuuccucugcaaaauaaauacagaaaagguggugucucuaaagauuaucaaccccuccucaaaagauucugguuacacaaauauuuacacauuacccgaguaacugcaaauccaguauuucuugauaaagcucacacuuuucagucugauuuuuguauccugauuucuuuagucaucuuuaaacguuuaaaaauguuuucgagacagaacuaaaauuuaagcgcaaaacaaaggaauucagucugccuuuaguauuccaacuaaagacuuccuguuaacagcaggauuccuuucuuuggaacauacaguaagugcgugacugguaugcggccaagaacauuaaaggucaaauuuucuaaucugaaaguucuacagcuaaacguagaacuuucuaggcucuaaaacuuucugagauuauacaacuuguuuuugugcuucuacuaaauacaauaagcugaauuuaacccuugacacaagguguuuccugaaaaucuaauaacuaauugacaggaauuacuauugccauuaagucauuacaaaacaaauuuuccaaccuuuuuaugcuuaugacaaucaaaauucaauguuucugaaaauagaucuaucgcacaaaccuauccuauccuccuacaaacuuacuuucuccuuucuauucauucaaauuccuugaaccuuauucagcauaaauccuaaaaauauguuuuaagucuucucaaggugaauucaagaaacuuucagcuacugucucauauucagauuuuucccuuguggaagaggcaguuauuaggcuuuucuguuuggcauguaauugguuauuaaucuuucccugcaacuuuagagauuccuucaaaaaaaguacuacuuuuuucuacaagguaaaacauuaaaucuauauugcccugauaaaaauuaaucuuaucaaaugaagucucucaagcucucaagcaguguaucaacugcuguaaagaauuuuuuuuuuuuuuuuuuuuugguugggagagauaccuuauuaccugagauucuucaacuaccugcaaccuucuuuaaaccuaacgcaaucugauauaaaagagccugggaugagacuucgaaggcagaagucuacugucucauuaaaacaaggucuuggcuauuccaugaaaucaaaucuuauuucagugcauguguguuccaauaaaacuacuguauugcaggaggcaagucuaucuggccuauggguguagcuugcugacuccugcugaagccucccucauaaaauuaaaaacacccucaagauuaaaauuacgguaggggcccgaauuuugauaaaauauuuuccuucucuuuuuccaccuccauguaugacugcuugcaaagucauuucaacaaauggcagucacuaauaauugucuuccuguggcagccccugggcaggcugcccauaagauuaacaaaccuguuucuuuuaaagaacaauaauccagacugggugcugcggcacaugccuguaaucccagcacuuugggaggccaaggcaggcagauugcuugagcuugggaguuugaccagccugggcaacacugaaauucagucucuacuaaaaauacaaaaaauuagccaggugugguggugcaugccuguagucccagcuacucaggaggcugaggugggaggauugcuugagcccgaggucgaggcugcagugagcugugaucaugcuacugcacuacagcccgggcaacagagcaagauccugucucaaaaaagaaaauagaagagaagaacaagaaaacaaugauccuagaucacacagacccccuugauaguuuccagaauuuggacuggccaaacaggccaggccacuuugaucacuggugaucucaccuccugcaaacucuucugcuaagcuauagguuuaaacaguaaccugccauuuuuucccagcuuucuuuccauaguaacuggcagucacaaacacuacuguaaaaccuaagacuggucuucgagauauuuuucagacuuugcuuacaaguggaccaacugacaccaaauggaccaguguuccaugaacucaaccaaggaacugacuuggucuugugacuccccaauuucccagcaacugauucagcacaugaagacagcauugauaacccuaugaucucauaccaguccaaucaccagcacccauccccuagcccccugccugccaaaucaucuuuaaauaucuuagcuucuccagucuuggcggugaugacucugagaaacauuucccauccuccuuacucagcugccuugcaauaauuaaacucuuucuucuuuacaguaucugcugucucaguguucugcucuauucggauagcagacaagagcccagucaggugguaacauuguuuuauagcauuuuuuggauacauaauuauuugcacauguuuaugggguacaugugauauugugauacaugcaaagaguaugaaauaaucaagucaggguauuuaggguauccaucaccgugaguauuuaucauuucuauguguugggaacauuucaaguccucucuuuuagcuauuucaaaauguuaacuguaguuacccuacucugcuaucaaaccuuagaacuuauuccaucuaacuuuauguuuggacccauuaaccuaccucucuuuaccuccccucccauccuucccaaccucugcuaucauucuaucuccaugaaaucaauguguuucgcucccacaugugaguaagaacaugagacacuucucuuucugugccugauuucccuuaauauaaugaccuccaguuccauucaagcugcugcaaaugacaugauaaacaugggagugcagguauuucuuugauauacugauuucuuuuccuuuagauagauacccagcaguggaacugccggaucauaugguaguucuguuuucgguuuucugagaaauuuccaaacuguuuuucauagugccuguccuaauuauuguaacauucccaccaacagucuguaacaguugccuuuucuucacacucucaccaguaguauauuuuuuugucuuuuuaacaauagccauucugacugggguaagacaccucacugugguuuucacuuacauuuccuugacgauuagugauguugcacauuuuuucacauaccuuuuggccauuuguaugucuucuuuugagaaacgucuauucauguccuuugcccacuuuuuaaugggguuguuuuucuuacuguuggcuuccuugcauauucuggauauuagucccuugcuggaugaaucuuuugcaaacacuuucuccuauucaauauguugucucuucauucuguuguuuccuuuacugugcagacgccuuuugguuuaauauagucccauaugucuauuuguuuuuguugccugugcuuuugaggucuuagccauaaaaucuuuguuagaucgauguccugaaguguuuccccuacauuuucuucuaguacuuuuauaauuucaggucuuaagucuuuaauccaucucaaguugaauuugcauauggugagacaagggucagauuucauucuucugcauguggauauccaauuuucccagcaucguuuauugaagaaaguguccuuuucccaaugcacguucuuggugcuuuuguaaaaaaaucaguuggcuguaaauauguggauuuauuucugcauuaccuauuuuuguuccauuggucuaugugucuuucuauaccaauaccauauuauugugguuacuauagccuuauuugugguuacuauaaccuuguaugugguuacuauagccuuauuucgaagacagguagugugaugcuucuagcuuuguucgguuugcucaggauuacuuuggguauuugggcuccuuguugguucuguggaaauuuuaggauuguuuuauuucugugaaaaaugacugguauuuuaauagggauugcauucaaucuguagauuacuuugagcaacauggucauuuuaaugauguuaauucuucugacccaugagcaugggaugucuuuccauuuguuuuugugcucuucaauuucuuucaucaguguuuugaaaucuuguuauuuauuuauuuauuuauuuauuuugagacggagucucacucuguugcccaggcuggagugcaguggcgcaaucucagcucacugcaagcuccgccucccggguucacaccauucuccugccucagccucccaaguagcugggacuacaggcgccugccaccacgcccggcuaauuuuuuuauuuuuaguagagacaggguuucaccguguuagccaggauggccucaaucuccugaccucgugauccacccuccuuggccucccaaagugcugggauuacaggcgugagccaccgugcccagccugaaaucuuauuuuuuuaaugacauacuugaaucugaaaacguaugcaauuaacuuguacuuuauuuugaaguugugacuggaaaguugcuuuaaagucugucuuuaaacuuagaaaaauuaucucaaauugcuccuaagagaggaucaguagagauuuaguucuuauaguauuuccucaauuauauuuggcaaauuagauuuucaaaacaagaguuuaacuuguuauuaauuccucauauuuacauacuuaaaccucagguagaaaaguauuacaagcuaucagugacgucuacaauauaggugggaaaggugaacgcaaagaauaacacauauucuauauuaacaguaaacauagcuauuucuguucucccucagcuaccaaaaacugucuuaagccuccagauuuaaaaccgcuggguucauucacucauucagccauuuauuuuugugagcaucucuuaggcagucaugugcugugcuaauccuaucugacucuucccucuccuuuguccuucaaaccccguuaguggccaagucccauuaaugugggcgugucccacuucuccucuuuccaaauuucugaaguauaggucaaguccucauuaaccacugaauaugcaccaaauggaagauuacgcagucauuaaaaccacucauaaaaaguauacaacaugaagaaaaucauucaaguaaaaagaacagaaaacuguacaaaauauuauauaaucacauccauguaaaaaaagaauuuggcauggaaaaagaugaagaaaauaacauacuaagaggaucucugguggacagguacuuugccuuuacguuucugcauuuugcaaauuuccuguaauaagcaguuauuauucuagaagaaaauauaaaugagcuuuauuuuuaaaacuuacuauuuuaguuagauaacaaauuauuccugagguucagaacugcauaucagaaauaaccaaaauaaacacucaagcaugcagcuaauucuuuaaccuaauuccuuaaaaacuaaaaggugcuuuuacccaugccucuuacugcauuuccacaugccuagaaaaccucuccucuacaauguuccagugagacucugaugucagcuuucauaaaauaaguuguucuuaccaacuauuccacauuauuuuuaaaacuucagugaucugcuuucuccuaaacucuaauucucauuuuuccuuuaaaagcauccuagauuugcguuuuccuauuaccacugguacccacugguaccugcaauccucuuuucucuaggaaucuacccuuaauucuaguacaaaacuaaucuuuaaacacugcuuucauaaaaucacuugucuuuccgaaaugugcaagagcuuccacuugacucaaaucuaagccuauuguugaaccacaaaucuccacucaaccuuacaucuuauuucuucaaaccaggcagaacuacacuguuccuuauauuuaaaccaugccuacucuguuuucauugugcuauucccaauuuuccacguaaaauguccuucuucuggcccuuguuaaucuaaaggccaagcucaaggcccacuccaaguccuaccucuuccaugaaucaucucuuuaaguauuccagccuauacucaucucucuucugauucccuguugcacuuacaguuaguaucacaaaguauaacaauuuuucugugaccauuguguauagauugguuuuguuuccacaaauaagguacuagacaaauaagguaccagaaagcagagaccaacagacccaaggaaaacgcuagacacauaaacaguuaauauuaaaugaauaaauuuuuucuacagucaaaauacuaaugcuccaaaccauuuuuaagucgccuuauuugaaguuaugugagccaaaaaguaaaucugucucacauuuuauuuuuauccugccaaaauuuaaagucuauaacuugguagaaaaaaaaaaucagacaagaaaguuuaauuuucaucucacuucauuuuaucugguaaaaccaggacuucaggaauaaaguagaauuguacauuucucccaucucuucugcuccuuucagaaguaucuccaacucaggagauauggaaaguaccuucuuuucuuaaauuauaugguaauuuuuuuugucuguuacaaaaauaauaaaaagacaugcucaacacauaauuaaccauaugacaauaagucuuuuugaucaacucaggaaauaauucuugaacuacuuuuuguugagaaaaagggcaggaucuagcgaaguaaugugguugcucaggguaucacugagcaugcccaguuguuccuacucuucuuuccuuucccaaguuugucaagugucucugaggacuccgucaagugucucugaagacuuacccuucccauuauucuaccaaaccuaaaccuaaauucagcccaacuggagacauuaaauucucuagguuuucaagggucacagcauuaagagucuagacagccuugagauaaauaccaaguuuacauaacaugaguuaauaaaauaaauggucacaaggacucuuccauucaguguagauuaacaacuauuugcacacaggcuuaagcaggaugagcaaaguggaaaaacauuucgcuaguaguauuuguucgugucccaagaaaaucuagaaaagaacaucuuuuuaauugacaugucaauaaauauaaacuacuauauuauuuauaauguuaagcuaccugaagcaugccuccccugauucuguggcauucuuuggaagagaucaugguuguauucauaauaucuguagucuucaugugcacgaucuccaaguggccgcuuucucugaccaucaaaaaaauugucugaauaauaauaucgggaaccagagucuccauuuucaacagcaaaacuaacuuccguuacaaaugacugagaagaaccauacucucuagggacaucugcuagacuucuggcaagauaagaaggugcagauaaucuguugcuuucucuucucauuauuucaugagguguucuuugaauuggaguucuaaggaaacucugguuucuugaaacuacaucuccagaaguugaaaaggcauuagggcuugaaucuggaagacagauaucaguucgucuuggaauuguuggaccaugccggaugaaugaaggcauaagaucuacaauaaaacaaaggauaaaauuacccuuucaucauuaaguaacaaaaguuuucgaaauuuguucauuuaugucuaccaccccaaaaucaaaaugucagucaacuuaagaaaacacaauuuuaaauuuugguuuaggaugguacuugggcauuuuaaauugaggaagauuaauauuuucccaaucaaaugaauuuauauaacuugcauuaauggacuaugcguaaaagcucagcuagaauaaaauguauucugcauacuaccauacauaauaugauaaaauaucaauaaucuuaucuaugaacuacacauuaaugaaaugcucaugaauuaauguauaaaaauaggaaauaauauaacaaauugauaguuucuaguuaaguaguuuauuuuguuguucucacuucauuuuagaaacugccaaaaauccuucuugaagcaaacacaauuucaaaaauagaacuuaaugcuacucccaaauauguaaaaguggauuccuuuaaaaauuaaaaaauuaguagcucuuucuucucuuggaauuaccuagcacuagcacaguaaucaaaagcuagaaagccaaaaauuuauguaugaaaauugaaaauaaaaagcucucauuucaaagaagcacacaaauguagaaguggcucaaaaaaccaagccugaaacuauguaauuauaauucaaaauaguagauaauagaacaacagcuuuuaggauacaguacuuuuaaacacgaaacuugaaaacagcuuaagacauucccaguuagaaagcaaauaccuuuaaaacaagacaaaaaccugaauaugcagacccucuuauuauucaucaaguaaacaauauuggagacacucauauuaauaagcuucagaaacuaacacuggacagaaacaaauaucugaauaaauaaggcucaacacuugauguaacgacaacaaaacaaaguagaucaaaaguuauuugcuuaacugugacaaacauuaacaaaacugcacguucuacacauguaccccagaacuuaaaguauaauaaaaagugugacaaacauaauucacgauuucaaguaaugucugauaaacuuuauuugcagcaaacagcaagcuaucacuuaaaaacagccagaaaccuaacugcaugugugacugaaaaucaaguuguuaaaaaaaaaaaaaaacaacuuaaaaaucaaguuucgaguuacugauguacucaacugacauauauuuuguugaaaguauugcaaguaccaccauaaaucuggaaggcugacaaugugguuaugauggaaaaacaugcucucccaucugugugaucuugggcaaauacuagaaaccuaacuuucccaauuacaauaugagguaauacuuaagucacaagguuacuaccagcuuccaagaaggaaacuuaagcaaagggcccagggcgcaguaagagcaccaaaauaccagcuccaugccucacaaauguccugaacacacaagaauuaaaaauucaagagauucaacucaaaaaucaaauacuuacauuaagaagaaaagcagcgggggaccggagguggggauugggagugggaucuacccuauuaaaaaaaaaaacuuuucgagggggggguucucuaauacgauagaaauuauuuugaguugccuucuuggaaucucacgaauauagccaaauacaaaggcuuuuggcucucugcucugcuguguaagagugaugaggcuuuggguggcggcuacaagaacgacgguaugcuuuucaccuucucaagucugcauccggcagcaggacuaaggaauucugccccagaguucgcacaacuugcagcacagucgagagacacccgcaauguuugcaaacaugacgcacaucucgacgcaucuaaaagaguaaaaagugucccugucuaauuacuuuuacuccuauagcauuaggugauaagcaauuuaaauguuuccuacucucucuuccaguaaucaaaaccaacaacucugccugguggggcgaggaagucuguuauuuuuagggggugcucuuggggggguuaggcgcgggggggacuaacccaaguuucuuacucuuaugggcuuucaaucaacgaauaccacuucagacacaagaaaaucucaaaaccaguauuucacgcgaccaaggacgaaggagaagcccuggagacccgccggcgcccccgccaggguccccggagcaccuggccgccugggccaggugugggcacgccccgccugacacucacuccgaagcagaggcgacgucuccuucuucacguacuuccccugcaccucggccggcuuggacacuucguuuuugguuuucuuucgggacagcauccuucucgacgaggcccgaggccgcgcugaacugccucccuagggcuccgcgccgggcgccggccgucuccgccgccaccuccgccggcgccgccgccuccuucccucccgagccgccgccuccgccgccgccuguccggagcccggggucgcccgcagggacugccgcauguucagggcgcuaagcgcgccggccgccgcucagucgcuggucaguuccuucccggaagucggcccgcucugcgacgcugcucggggacgccgugaggaaagcccagcgacgccgggccagggccagggccaugguccgccgcgggccgccgaauaaccgcuaccac

SEQ ID NO: 192360 - RNA, 27205 nt, Homo sapiens
guuauugguuggcaguucagccaaugagcgggccuguuacuaguuugcggcauccugugguauaggggaagcgcuccgggccuggaaucccuacgcgucccuuuggguuuagcacgaugagcucaaucggcacuggggugaguucgcugucugucgguguaauaguuuaaccuaaggauugggguugaagggaacucggacagaccacaugggguucgcggacccggggugcucugagaccgccuucggcugggugggccauuugcagcuguuuggagaccggucgucuuuauccccuauaugcuaggccugcgucucaggugaccgugacuccugaagcuuuucagcgcagguguagccggcuuggcgucgccgcagugagguuuggagccgcuuuggauugcugagucacuuucuucagccacuuagggaaaccgaaaguggaaacucguggggcuugaaauaguguguucucuugagaaccaccgaggcagugagauuugggauuccggggucuggagaucgugcuuuuuguggacugcguuugcaguuccuagggugcugcugauucacaggccuucucugucuuuaagugugcagaucauugaccgcucaguuuaagagucacuggaaauccugucggaacagaacuaauaaaaauggucugaaaaacaaucugaugaauccuucaguuuuuccuuucucguuuuuccuauacaaauuaccuaacagcgcuuguaggcauuuauuccguaaacguuuaaaugguuacuuaggaacuuaacagcuucagacuuuucauagacuguugaggauuuugcagugggacuuguuaacuuguuuggcuuuccuuuguuaaacguauugcauaugugcagucaguuuacuccuuuuauguacuucucuauauagaaaauacaguuucuaaaagauuuauugguuauuugcacuagaguuauugaauaaugaguuucucaguuccucaauuucuacuucuuaacaagauucucaugcucagccuuaaguucaaguaccgguguucuaaauuugauaauaggcaacuuaugucuggaaugguuuaauccauucaguuaugaaugcuaaaguucugccauacuuuucuuggauaaguaaaugcucaauauuaaaucuuguagcaaacugacuuugcaauuauauuaauauuaccuugaauuaauaguauuucauucuacaaaccuuuuaaagaauacuugauaauguaaccaugugggauauuuuaguaacaaugguaggguuaaugaucuggguuuaacagaucaggaaacagacucagaaaguaccacugcugaaggcuuuucuucugucuucauuucucccaagaacuccagauacgaauauuuguuugucugcuugacaugucuguucacuugaucguuuaauagucauuucguacugcaugugaaaguagagcucuggguuuucuccucaccuugccauuuugcaucuacuacagucuucagcucagugaauggucauaugaaaaaaucuguuauucaucuuuaauuccuuuuuuuacuuuacucccagaaccaacgcuuuagcaaguuuauuuuuuuauuuuuauuuuguuugagacggagucuugcucuguugccaggcuggagugcaguggcacgaucuuggcucacugcaaccugugccucccagguucaagcaauucuccugucucagccucccgaagagcugggacuacaggugcgcaccaccacgcccagcuaauuuuuguauuuuucguagagaugagguuucaccauguuggccaggauggucuccaucucuugaccuugugaucagcccgccucacccucccaaagugcugggauuacaggcaugagccaucacgccuggccuagcaaguuuauuuuuauuauuuuuauauuuuacucuacucucaaaaaauauucccuucuaccucuucucucgucuaagcuacuaccgcuaucuuuggaacaccuuaucuuugcuucuguuguucucucuacagcuuauuuuccgcauaaagccagaaugauguuuuuaaaaauauagaugauaccacucccccugcuuaaauuucucauugcauuuagaauaaaauacagaguccuuuuuccauccuggaagacacaacauaaucuggcccucagcuaccucacuaacacaguuuacucuucuuucugcugcuuacagugcuugggacacagugaccuuauuucuguuucuugacugugcuagccuuauuucuacccuaagaucuuugugccaaaugucaagaagacuuuuccuucauaucuuaaauggcuagcuccuugucauuuagguuugacucagccuaaauauaacugcccagaaggccuucccugaugauguagucuguaguaguucauugcuuuacucuuuuauuuucaucuuagugccuuuucugauuuacugcuguaccucuagcaccuagauucaugucugaugugaaacugaaggacuuaaugaaugaguauaccuuuguauuccguauaguaacauaauagauacucauuaacugcuuggugaaugccgaaugauuuguuugaagucuuuuaguuuguuaauggcagaguuaucguuacaaauuuaaauguucgaacuccagugcugguucuacugccccauauuaaucuuuuucaaaaaugaguuuuguagucugggugaaaaguguucugacuucaccugggaccuguauccauuacucuucaauagcugaaaucgaagguauauagcuuuaucuuagcuacuguugcugcucugacaaguuucccuuuccucucuugaaagcaaggucuuuguugggauauaacagguuccugauguuucagccauuuagaggggaagaaacuguauggucauuacugccaaagauacaagcuuacuguugcccuuuucuccuuaaguaugaccugucagccucuacauucucuccugacggaagaguuuuucaaguugaauaugcuaugaaggcuguggaaaauaguagguaagaaacauuuaaccagguauuacaugucuccuuuuauuuuauauauuuuuggcgauuaggcuuuguuauguuacuuugguacaaauuaguauauguccccaaaucucaauuuauucauuuccagaucucuuucuaggccagaugcuuuccaugagccccaguccuauauuucucguugauuccaggauuauccacuuagauuuuccauguugcagaguguauaaaucacauucauuaucaucuuuuuguuuuccauuuucaaauucuugauuuguaucauaggcuuccucagccauuagguuugugaccuuguuauuuuuuauuucucauacaucuuguguuuuaaaugucuuaugcaauuagucacauguucgauucagcaaagauuuuuucuaugucuguuucuguuuugagaccugagucucacucugucaccuaggcuagagugcaguggcacgaucuuggcucacugcaaccuccgccuccuggguucaagugauucucuugccucagccuccccaguagcugggauuacaggcaugugccaccaugcccggauaauuuuugcauuuuuaguagagacgggguuuugccacguuggccaggcuggucucaaaccccuggccucaagugauccgcucaccucggacucccagagaguagccccaguccuauauuucucguugauuacaaagagcugggauuauaggcgugagucacuguggccagccuaaauacgauuuuaaaaagucagauuuaugcaaauaugaggaaauaucuuuaaaaaauugaaaccuuaaaaacgaauguguuuuuuccugaaugaagaaaaaaugcagccgggcgugguggcucacgccuguaaucccagcacuuugggaggcugaggcgggcggaucaccugaggucaggaguuugagaccagccuggccaacaugguaaaacccugucucuacuaaaaaauaacaaaauacaaaaauuagccgggugugauggcacacgucguaguuucagcuacuugggaggcugaggcaggagaaucacuugaaccuggcagguggacguugcagugagccaagauugcaccacugcacuccagccuaagcaacagagacucugucucagaaaaagcuaggauuuuaaaaaugagacguaguuucacucuuguugcccaggcuggagugcaauggcacaauguuggcucaccgcaaccucugccucccagguucaagcaauucucucagccucccaaguagcugggauuacagacaugcaccaccauggcccgcuaauuuuguauuuuuaguagagacaggguuucuccauguuggucaggcuggucucgaacuccugaccucaggugauccgccugccucagccucccaaagugcugggauuacaggcaugagccacggcgcccggccuaaaaguucuucuuuuuaaagauguauuaaccuguccuuugauacuacacccaaagugaacaaaugcuaguuucuuauuuuaaaaaaaaauguuuauuuauuuuaaaaaagaggcauggucucacucacuauguugccucggcuggucuugaacuuuugggcucaaguaauccuccugccuuggccucccaaagugaugggauuacaggugugagucacugcgccuggcuuauuauuccuuuuuuuuaaaaaaaacuuuuuuugggggcaggacauaggaucucgcuuugucacccaggcuggagugcaguggugugauuacagcuuacugcagacucgaccuccuggucucgagcuauucuccucccucagccccacaagguaguugggacuacaggcaugugccaccacgccuggcaaauuuuuuguagagacaggguuucaccauguggcccaggcuggucucaaacuccugagcccaagugauccgccugcuuaggcuucccaaagugcugguauuauaggugugagccaccgcacccagccgaagucuuugaauucuuaugaaaauaauuuugaccucgaagacugccugaaaggauuucagagauuuccagauuuucaagaauguuuuaaacaguguggaagauguugaguugagauaauuaagacaggcuuccugcugggcgugagccacgccuguaauccuagcacuuugggaggcugaggcagguguauugcuugagcucaggaguucgagaccagccugggcaacauggugaaaucccgucucuacugaaaauacaaaaaauuagccgggcauggcagugcgcgccuguaaucccagcuacuugggagguugagacaggagaaucacuugaacccgggagauggagguugcagugagccaagaucacgccacuguacuccagcuggggcaacagagcgagacuccaucuccaaaaaaaaaaaaaaaauagggacagaguuucaaaauguuggccuggcuggucuugaacuccuggccucaggcaagccuuucacuugggccuuccaaaguccugagguuacauucugaccuguacugcuugaguucaacuaaguuugcaaaccuuuuggggaaauucauuuaaauaggcaguagugaagaggaaauguauucuagcauccaggauaaccucaaagacauggaaucaaaaaugaacaugagguuuuugaagguugacagugagguaaccaguagaguacagaauuuauaacaggaaauugaauaugcucaggggguucugccagacccuuaggaguuuaaacuugcaaggggagccauggaagacaccuaaaguguuggggaaggagugucagaaauucuuagaaaauuuguugugugcaucuguuguucauuuuucugggaggaaaugccauaguuucaucagauuuuaagaggccugugaauaacacaauuccccugcuuuuuagauuguggaucccuuuuuagauucugacuauggcaaaaugaaacacagcuaggaauuaggcuggucuuagauuaaacggauuagagaaguagaaaagaugguguaguaaucuaggccugaaauuauaaggaucccaaugcugguauaauuauuguaaagaaguggacaugaaggaaauuuugaagaaaaaaauuaauaguaaauagaagcucaacauggaggauguagagcuuggugaugcuauuauccaaaacagagaaguugugccgguagucccagcuacugaggcugaggugagaggauuacuugagccucagacuucaauucaaucuugggcagcauggcaagacuccauuucuuuaaaauuaaaaaaaagaagaaagagaaaguugagauaauuuuaccagaaaacuguacaaucaagcauugcuuauuuugucucuauuguuuccgaucagaacuaccuuuaucaaaaaggaauagaagaauaaaguguaacacauuuucaucuugaaauggcaacaaguaauuucuccacauuuuacuugagguuguguguguguguguuugagacagggucucacucuguugcacagacuggugugcaguggugcaaucuuggcucacugcagccaccaccuaacugggcucaagcaaucucucaccucagccucccagguagcugggacuacaggcguguaccaccaugccuggcuaagccagguuucgccauguugcccaggcucgucuuggacuccugggcuuaaaagauccuccugccucagcaucccaaagugcugagauuacaggugugagccaccaugccuggucuuaagagguuauuuuaagaucuuuuuauuuuaaacaguuguagcagaacauauauuuuauuuuuauauacguauuagaagcaauauguuuauuauggaaaaauuggaagaaagagaugagcaaaaggaagaauaaaucauaauccuucuacccagagcagucacuguuaacuuuuuaguuuguaucuaaccuuuuaugucuguuauguaccauuuuuaauggacaugaauuuaugucaacauuuguuuauaacaugauuaucauaagccagacacugagccauauuguguuucguuagcaucauuuuuauacuuacauauuaauauauuuuuagucaaaugauguacuagauucuggagggagggucacaugauauuuauauggauuuaauguauuuauuacacuuuaguguguuuucucuuccugguuuucaaauguuuuaagguauuuggcaugccuuaaauguuacuuauuuuguuuuuuuguuaaacuuaaguuuaugaaguuucuuuuauuuucaguuaaaaaacugauuuucuucuccuuguuucaguacagcuauuggaaucagaugcaaagaugguguugucuuugggguagaaaaauuaguccuuucuaaacuuuaugaagaagguuccaacaaaagacuuuuuaauguugaucggcauguuggaaugguaaggucauguuuaaaauguuccuuuuugucuuguccaauuucuuuugaaguaacugauuggaauagaucacugugcagucacaaaaguaaucagagcaaguuacugcauuuguccaguucacuguccaguagaaaggcagcauucucauaaccuuauuagugaugggggaaaaaccaaguugcugaaagaagagcaggugagggagagggcuggggaguaugcguagaaaugagaucuuggcagcacacauuacuaaugaagguauaugcuugagaggugaagaaucuuuagcuuucuguaucucuuguggggaucacugucaaaguaaagaugccaucagauagcgaacaccuuuauauaagguggaacaucaggaaaggauguuuaaugaaaaggaaaagugaacacauccauaauaguuucauagggcaucacugaaauuaaguuauucaugcagcugguaucuaaguuaugagugacuaaauugcaagccaagccauagauacaugacugguauauacuaaaguuacccuacauagauggcagacuuggcuuagugagaaccacuacugaaagaaaaaaaaaaaaaagaaucaaaugauucuaacccugccaccugaaaaggaaaggaagaaaggagaauaucucuauauuagguuuuaugcugggagcucuuuacauaaauuaccuuguuuaaucuugacaacccagugaagguuauaucaaugucauuuucuuuuuuuuuuuuuuuugguuugagacagagucuggcucugucacccaggccggagugcaguggcgccaucucagcuuauugcagccucugccuccuggguucaagcgauucuccuaccucagccucccaaguagcugggacuacaggugcccacuaccaugcccagcuaauuuuuauauuuuuaguaaaggcaggguuucaccauguuggccaggcuggucucgaacuccugaccucaagugauccaucugcccgccucagccucccaaagugcugggauuauaggcgugagccacugcgcccggccuaaugccauuuucacaggugaaaaaacagaugcacagcaaguaaagaaaagcugggauucaaacuugggucugcauguuacucaagagcccuuucuaaaugaaaagacaccuuauaugacccacaucguucagcugauagcuuucuuauaucuaaaugagauuuaauguuacacacaaacacaaaaaguacugguaaaguauaaccaguaaaccauaaagcuaauuuuuuucuucuucaaagauuauuuuaucucaacaauauguuucuccugaacagauuuuuuuauuuugcugcaaaugacaggauuuuauuuuauuuuuugagauggagucucacucugucauccaggaaggagugcaauggcgcgaucucagcucacugcaaccucugccucccggguucaagcaauucuccugccucagacucucaaguagcugggauuacagacauacgccgccacacccagcuaauuuuuguauuuuuaguagagacgggguuucaccauguuggucaggcuggucucggacuccugaacuccagugaucuacccgccuuggccucccaaagugcugggauuauaggcgugagccagcgugcccagccuagcauuuuauucuuuuuaaaggaugaauaguauuccauuguguauauauacauuuucuuuuuacuguuuuuuuguuguuguuguuguacagauuuuucucgucacccagguacuaagccuaggacccaauaguuauuuuuucugauccucuuccuccucccacccuccacccucaaguaggccccauugucuguuguuccugucuuuguauccaugaauucucaucauuuagcuuccacuuauaagagagaacaugugguuuuugguuuucucuucuuguauuaguuugcuaagaauaaugcugaacagauuuauuauugccagugaaacugauauguuuugaugaaacuugcuacauuguaaccuagcuaguaggaggugaucuuguauucuuuuauguacuagcaaaaguuaauauuuugaaaaaaauuaugcaugcauauauauauguauguacacacacacagaggucuugcucuguugcccaggcuugagugcaguggcaugaucauagcucacugcagccuugcgcuccugggcucaagugauucuucugccucagccucccaaauagcugugacuacaagugugccaucacaccuggcuaauuuuuuaguuuuuuuaagagauaugaucuugcuguguugcucaggcuggucuugaacuccugggcucaagcgauccucccgccucagcuucuugaguugcugagauuacaggcaugagccaaugugcccugucaacauuagacauugaagagggcuggagaaaauuaagacuuaauauccucccuccuuccacaguugucaucuucaagugauuugagaauuauaugacuuuacaguaagcuuucucuaaagcaacagaagauucuuuaagugauguaacuuacuggcauggguuaccuuggggaagcuauucuaaacacgcguuuccuugucugcaaaacaagagugauaauaguacuuggcacauacaguuguugugagguuaaaaauuauuaugcaaaaugcuuaacauguaaugagugcucaguaucucuuaguaauuaucauuauuacuauuacuggguagcguaggaaaaaaaggcuauuaaagauugugauaccacuuuuaaauucuguaacuguccugggcuagaggguuucaaaaacuugguugguuuaugguaccuuaagugucucaguaguuuuucucauggcuucccuaggccgaaaauaccuaaugguuucauuuauuaaguauuuagauccaaagaacuuaguguuuacauccuaaaaacuuaguagccguuuuuuuuuuuuaaauacacacauagugaaaaauauuuuuauuuaaaaauuaaaauguuuuauuuuaagcaaccaaaauuucuaguauauacacugcacaaccucccaaauuuggauguggccacugucauuuccuguuccacacugauuuuugcacaguacuuacuuuuuuucacagcaaccacuaacagccaagcuucucaaagaugugguggcauugaaaggaauguaguaaaacgaucuaauguucaaacggaacuacuuggacauuuuucuccaaacuuagaaugugccacacuaggccaggugcaguggcucacaccuguaaucccagcacuuucggaggccaaggcgggcggaucaccugaggucgaaaguucaagaccagccugaccaacauggagaaacccugucucuacuaaaaacacaaaaauuagccgggcgugguggcgcaugccuguacucccagcuacucgggaggcugaggcaggagaaucccuugaaccugggagguggagguugcggugagccgcgauugcaccacugugcucuagccugggcaacaagagcaaaacuccaucucaaaaaaaaagauaugccacacuaacaugugauuucacugcagugccugaggaccucucggcacauacauaguaacugcaauucuguuuuuguuuuuguuuuuguuuugagacaaagucucauucuguugcucaggcuggaguguaguggcgugaucucggcucacugcagccuccgccucccgaguucaagugauucuuguggcucagccuugggaguagguaggauuauaggugcccgccaccaaaccugacuaauuuuuguauuuuuaguagggguuucaccauguuguccaggcugguuucaaacuccugaccucaggugaucccccugccucggccucccaaagugcugggaucacaggcaugagccaccgugcccggccuaguaacugcaguucuaagccgcaaaucuugaaagaggaaugguuuaucauuguaguuuauucagccaauaggcugaaaaaagauuugcgauugugccuuuuagaacaaaacaguuacagguugaguaucucucgucuaaaaugcuugggaccagcaguauaucggauauuuuucgauuuuggaauaucugcauuauauacucaucagcugagcauccuuaaucugaaaauucaaaauccaaaaagcucuacugagcauuuccuuuuuuuuuuuuuuuugagauggagucucgcucuguugcccaggauggagugcaguggcgcgaucucggcucacugcaacuuccgccucccagguucaagcaauucucugccucggccucccaaguaacugggauuacaggugccugcaaccacgccuggcuaauuuuuguauuuuuaguagagacggcauuucaccaucuuggccaggcuggucuugaacucgugaccuugugauccaccugccucagccucccaaagugcugggauuacaggugugagccaccagguccggccugagcauuuccuuugagugucauguuggcacucaaaaaguuucagauucugaagcguuuuaaauuucagauuuuuggauuagauauccucaaccuguaauaacuuuagagaaaagaacaaauuugggccgggcacggcggcucacacccauaaucccaacauuuugggaggcugaggcaggcugaucaccugaggucaggaguucaagaccagccuggccaacaugacaaaaccaaacccugucucuacuaaaaauauaaaaauuagccaaucccagcuacuggggaggcugaggcaggagaaucccuugaaccugagaggcaaagguugaagugagcccagauggugccauugugcuccagccuaggugacacagugagacucugucucaaaaaaaaaaaaaaaaaaaaaucugaccaagacccaugguuuuuauucguuauaaugagguagugguaguaaaucaggggaagaggauuuaugauagaaguaguccugaauauuggccgggcacgguggcucacgccuguaaucccagcacuuuaggaggcugaggcaggcagaucacgaggucaggagaucaagaccguccuggcugacauggugaaaccccaucucuacuaaaaauacaaaaaaauuagccgggcgugguggcaggcgccuguagucccagcuacucaggaggcugaggcaggagaauggcaugaacccaggaggcagagugugaagugagcggagaucaugccacuguacuccagcccuggugacagagcgagaccccguaucaaaaaaaaaaaaggaaauguccugaauaugaacauuggacaaagcaaugaaguuauacuuacuaaauuucuaaauuauaauuucauacucaagcaucaaaaugccuuguagagagaccuuuaagccaaaaaaguuuauuuugaaugguaauacuuguuaaaaaaauguuuaauaagucuuuauuaauugcagacuuugauuugugauaggaauguguuccucuaguaaauuggugcuuuuuuuucaggcaguagcagguuuguuggcagaugcucguucuuuagcagacauagcaagagaagaagcuuccaacuucagaucuaacuuuggcuacaacauuccacuaaaaguaaguugauaacauauugaggaaccuuuuggacaguaauagaaguuuauuaauaagcucuucugcuucccuccauagcaucuugcagacagaguggccauguaugugcaugcauauacacucuacagugcuguuagaccuuuuggcugcagguaagaaauuuugugaauuauucaaaaggcagaucuguacuauagauauuuauuauguuccccagcaucuuagccuuuuacauacuuaaaaauagaaacucgucgauaaguauuagggcaaugauuaaauaaaacaguguacauagaaacuacuugaggcugggugccauggcucaagccuguaaucccaguacuuugggagguugaggugggaggaucccucgcgcccaggaguaugagaccagccuggccaacgcagugagaaccuaucucuacaaaaaaaauuuaaaauuuagccaggugcaguaucacaugccuguagucacagcuacuuaggagcugcuugagaggaucauuugagcccaggaguugaaggcuggaaugagcuguggccauaccacuguacucuagcuggcgcaauagagacucugccucuuuaaaaaaaaaaaaaaaaaaaaaaaaaagguuucaauagugaaaaggacuauauagaucugaagugauuauaaaacaaggaacugauaacaaugacuuuaaucugauuauaauaagcucucgguguuagucccugauauucuuagguaauuuuaaaaauuacgucucacaauucccauuaggcacgguuucucuuucuguugaagugcugauauuuuauugugggguaaaguggagauucagcugcauaaagaccuggaauagguauaaauauucaaauuuggcuucacagagaagacuugugacuagauuuuucuaaaaugaaaagacauguuuggcuuaugacuuaaaacagucaaacauguuuggucaaaauaauacauauacuaacaucugagugcucagcuguaguccuaccuuugaguuguuuaucaucagucauauuuaauuacuaagauauuaaagaaaacuugaguuuuauucuauugguaauauuacauuaggguuuuguuuuuacuuuuugagacaguuacugucaccugagcuggagugcaguggugccaucauggcugacugcagcuuugaccuggcucaagcgaugcuccuaccucagccucccaaguagcugggaccacaggcaugggccaccaugccuggcuaauuaacaaaauuuuuuuuuguagagacggggucucaccaugcugcccaggcugacauuagucauucuuaagcuucucaguuaaauuacauuaugaaacacuuuguuuucagaccauguaaaauaccuuucaacugagcucugaguucaucaguuaacuucucuacucuuuuuaagggaguaagaauaguagagauaacuuuuuuucauaacuuuuuuuuuguuuguuuuguuuuguuuugagauggagucucgcucugucgcccaggcuggaaugcaguggcacgaucucaggucacugcaaccucugccucccggguucaagcuauucuccugccucaaccuccugaguagcagggauuacaagcaccugccaccacgcccggcuaauuuuuuuauuuuuaguacagucaggguuucgccauguuggccaggcuggucucaaacuccugaccucaagugauccaccucagccucccaaagugcugggauuacaggcgugagccaccgcacugggccagagagaacuuuuuuaguaaacaucuauugggcacugaguuagucauaaauguggagacacaggugugaagucacauugauaaaauauuagugauaugauaaagggacaacaauuagggaacggacucuuucuggacaggaggcaaggaagagugugagauguagggagacuugguaguugcaagcacaggaacugguaugaaaauacgugcgccagagagaguuaaguaugcuugguguguagaguaugagguuuagagaugauacugauguaggaagggguccagucauauaaaagucugugcuccaugcugauuuucuucaaagaaauguugaaaggcuuuaaaauagugacaaugagcuauauauccugaaggauaagucucauaucgguagaaaauggaaggaaaugacgguagggaugggaauugaauaguuaaaauauuccgcauauaagaugauguguaagaugcugcugauuucuuuucuacucuaaggcaaauauaguugucccuugguauuugugggggauugguuuuaggaccucccaugaauaccaaaauccaagguugcugaagucccugauauaaaaugguuaaguauuugcauauaaccugugcauauccuccuguauguugucaucucuagauuacuugcaauaccuaacacaguguaaauagcuguuacacuguauuguuuagggaauaaugacaagaaaaucacaguuguucaguacagaagcaauguuuuuugaaaguuuucuaucugugguuuguugaauccacagaugcagaacucauggaaacagugcccacuguaugucacaauuucagaaaaucaguauuucauacaaucagcuaauagccuaauuuguugagcacagaaaaauacacugaaccaauucugauuauugcagagaaaugauuggcaggauauugggaaauagaaugaaggguggaaagaauuucacauggauucaguauacucuccgucaggaauuuuguucccuugaucuuuuuguguuuaugccuuauuuauugggcccucucauaguugugguuuucaucuaucguuacuccuuucccuguacugcuagacuuuccaggagaccuucaucagaaagauuaauacuaaacaaacaaaagcuacaugaauuuugaauaaucucauguaauaguuuuaauuaauugaaaccacuguuucaaaguacuuacugaguuauauguguauuaguaauuuaucucagaaagaaaauauaacugcauuuuaaaauaauuuuuucacaaauacuuuuauguuauugccaugguuuaagcuguuuguauacuuucaugcaguuucauguuagggucuuacagugugaaugacggugcgcaacucuacaugauugacccaucagguguuucauacgugaguaauuuugaaucauuugaaauucuauuuuaguuuaaugguauuucauuagcauuuaagucucauuauaagauuauaugaaauuaaaaaaaaacucauucaaggaaaguaauuuuucuuuuuuuuuuuuuuacaacaaccucuuguccaacagaauuuuuuuuuuuuuccuuuuugggggaacagggucucacuguggcccaggcuggagcacaguggugugaucacagcucacugcaaccucugccucccagguucaaacaguucuucugccucagccucccggguagcugggauuacaggugugcaccaccuggcuaauuuuuuuuauuuuuaguagaaacaggccuuugccauguuggccagacuggucuugaauuccaguccucaagagaucuacccaccugggucucccaaagugcgaguauuacaggugugagccaccaggcccagccauguuuucuuaucauuaauaacugauacgaggcagaggaaagauuuuuuuucaguauguuauuuauagaaacuguauagugcauauaguauuuugaauaugugauuuuccuuuauuacuauaaacacugucuuaaaacuguauuuaaugucuuuuuuccucauucuugcccaggcuggagugcagugacacaaucauagcucacuucagccucucaacuccugggcucaggcgauccuccuaccuaagccucccaaguagcugggacuacaggcucaugccaccaugccuagcuaauuuuuguauuuuuuuggugucuauagagacaaggucuuuccacguucccagggcuggucucaaacuccuggccuuaagcaguccuccugccuuggacucccaaaaugcugggacuacaggcgugagcaucgauguccagccaugucaucccuuuuauuuuauuuauuuauaagauggagugucacucugucucccaggcuggagugcaguggcucgaucuugguucacugcaaccucuuccgccuccuagguucaagcaauucuccugucucagccuccugauuagcugggauuacaggcauguacuaccaugccugguuaauuuuuguauuuuuaguacagaugggguuuugccauguuggccagcuggucuccaacuccugaccucagguggucugcccaccccggccugccaaagugcaaggauuacaggcgugagccacagugccggaccuaauuuuguuucagacagcgucucgcucugucacccagacuggagugcaguggcgccaaaccuccaccuccccaguucaagcaauucugccucagccucccgaguaggcugggauuagaagcaugcaucaccacacccggcuaauuuuuguauuuucaguagagacgagguuucaccauguuagccaggcuggucucgaacuccugaucucaaguaauccgcccaccuuggucucccaaaaugcugggauuauaggugugagccaccuugcccugccuucccuuuuaaagagaagguuuaaaugugauuucuaagagcuuucccuaaauuauuaccauuuuuuuuuuuuuuugagacagagucuugcucaguugcccaggcuggacugcaguggugcaaucuuggcucacuguaaccucugccucccggauucaagggauucuugugccucagccucucaaguagcugggauuacaggccuguaccaucacaccuggcuaauuuuuguauuuuuaguagagacagacuuucaccauguugcccaggcuggucuggaacuccuggccucaagugauccacgugccucagauucccaaagugcugggauuacaagcacuuugugugagccacugcacccggccuguuaccguuucuuaacuguuuucuuauccuuacauuuuugucguuuuuacuaauugaagaaaaugaagauucuuaaauauauuuugcuguaacagaaguauauauguguacauccuuuuuuuuuuuuuuuuugauggagucucacucuguugcccaggcuggagugcaguggcgcggucucagcucacugcaaccucugccucccagauucaagcgauucuccugccucagccucuggaguagcuggcauuacaggcaccugccaccacaccuagcuaauuuuuuuguauuuuuaguagagacaggguuuuacaauguuggccaggccggucuccaacuccugaccugaggugaucugcccaccuuggccuuccauagugcugggauuacaggcaugacccaccacacccagcugugcauccuuaucuuuaaaaaaauuuacaaaauaauaaaauuggggguuuagaguacugaacucauaggaauuaacuuuauuucugucucucaggaauauauaauuucauuuuucauugucauagugcuaaaaucuuuuccguuccuguuccccaaaaugucuuaaaguguauaugauuacauaauuuacauauuuuuggauauaccuuuauuaaaaauacagguuguuuuggaauuguuugguauuuuaguauuuuugagcccuuuggcauucaucagaauguguuugacuauauuuuucuauacuugcuuuuaaaagucauuuagcauccuuucacuagguuauagaaacauuaguagucauuaauuacauaugauaguguacuaauucagugauuauauauauuuuuuucuaaauaggguuauuggggcugugccaucggcaaagccaggcaagcugcaaagacggaaauagagaagcuucagguaauaauuaaugcuugaauuuuuacuaugucgucauccuaaugcagugaaauuuuaucaccacagacauuucagucuaaggcagggauguccaaucauuuggcuucccugggccacacauaaaauacaccaacacuaaugauagcugaugagcuuaaaaaaaaaucucaucauguguuaagaaaguuuacgaauuuguguuuggccccauguggccuguggcuggggaagcucgguguaaggauauagugugguuugauguugagaguuuaugaagcugcuaagucacugaaugggaaagcugguaacauauuaucuguagaguuguguuauacaucccuuuauagauucugaauaacugcuauaaagccucaaucuagaaaaacacaacuuuugauaugauuucacaaaauccuugaaaccuauuuaugaaucucugugagcucuaguuugaaaauuuuguuuaaaauuuugaguuaauaaaaaguuauauuuuuccuauauucuuucuuuggaacacagcuuuuaugucuggcugugcuccaccgguucucuuagcuuugcuccuagccagguaaggcauaaagccuacacucuuacgacuacccacuuuuucuuucacaaaauucagcuauuagugugaaaaaguuuucuuaaaaacuugguuuuccuuuuagccaugcguugaucaacuuaaagacuucauggauacuguuucaauauuauugauuaccugucagaaacuugccuaaaaagcaggcauaccauuuaucaguguuuugguaaacugaagugagauacaauuucacauacauuuaauguuaaugcuguacuagaacccugcucaacuaauuacucauucaacuuauuuaagaccagcuucuagaaaauacuuauuagugcuuggcauuuauacaaugcuaaguucuagaacccccuauaaaaccuaauuuguuucguauuuuaguaaagcugacaaaaggaucuuagaggucauuuagcccaagcucaacugcagauuaaacacacugcauaggaccacagaaucagcugguucugaacaguauccagaccuuaugagucuuagaccuauguucuuuuccauugcacacuuacuaguaugaugcuagguuccuaucuucuacucuuuuccuuuuguuuucaucucuccauacuauuauauggaaauuugaaaauuagaauauuuaugucaguugagggggauuaccccuguaauccuaccaguuugguaggccaaguugggaggacugcuugagcccaguaguuccaagaccaggcugggcaaaagaguaagacccuaucucccaaaacaaaauguuagcgaggugagguggugcgugccuguagucccagcuacuugggaggcugaggcaggaggacuguuugagccccagccaggaguugggggcuacagugagcuaugaucacgccacugcacuccagccagggcaacagagcgacaccuuaucucaaaaaaauaaaggaaauuagaauauuuagagcaguuacuaucugucuuucuguaguuaaauccuagcaaggaaugggaaaaacaauaaaucccagagaaaaaucaagaaaaaaaaaucacuuuaauugaggaacacuuucaguuugugacaaaauuaugcugugaaucagguguugcaaauuauggcccacugccugcuuuuguguaaguuuuauuggaacacagcuacauucaguccauggcugcuuuuagaauacaacaguagacuuuaacauuuggaacagggaacagaaaccagagccauacagcuaauaaacuugaaaauauuuacaaguugaugcuuuacaaaauccaucugcugaccccugcucuguaccauuguucucuucugauggucuguuuacuaaaaaauaaaaacuucacaaacauguaaaaaauagauuugccauuuaaaaugugcuuuucaaguuugacuuuuuaggaugcaauuaauucacuaaauacagaacuuaacuaaggacaaaaauuuaaagaucagcauucuuucccuucccaucacgcucaacuuaacaugaagaacuguaaacauccuaagcuuacaacaaaccuaucuaguuagacuucaguuaaccacuuacacaucccccucccccaugaacuauuuggaaaaagcugcaggcguaauauuggaucccuaaauacuuuauucuccuuauaccauuaucagacccaaguaucaucuaauaguccauaaucaaacugccuaagcaguuucuacacugucuuuuuaacuauuucaaacuaucaagguucgcauuuucuuccuuagaacuuuuagucuuuuucuuccccaaaauauuugaguccaugccaguugccuuuaguuguacccaaauaaugguuugucuauuuccuaaaaguaguacucuuaaauuuaaauuuaguguuauuuuuguugucauuguuccuucuuccucaugugguugugcaggcagagcuugagcauccagauuucaaaauuaaaaaauaaaagauaaucuaguuuaauauauaguaguugaaucaccuuaagucuagacugcuguaugagcacccauuaucuuucacuauauuccaucaucccccaacauauccacaguagaugaagggcaguuugcucaaacauuguuuugauccugucaugucuguucagaaaugccugucuauucagaaacccacgucuaauaacaaaaucuuggacugguuacuaucaaaacccaacaacauacagacuccucagcuaggcccuagggauauuuuucuaccuugauuuccaaauguucauugaaagaaugcuuaauucuaauuuggaaaaaaguuuuuggcuucccacuucugcuuuacacguucaucuuucuugaaaucaaauccaauccaaucuauauucuaagaaccugcucaaaucuugguucuucaaagcuuucccugguauuuugcauuuuugcuuugaauaguuccacgaaggauaacuucuuacuccuuccuucaucuuucuguaucuugcauauaguaaauauuaaugacuuguuugcauuuuguuauccuaacuuggcuauaaagaaaaucagaugucuucaccagucguucaaacuucaggucugccuacagauucauagauggcuguggauuuuuauaauuuugucacaaaguuagugguaacuacagguuaucucagaauaucuuuuuuggcguauaaauuuuuuucuuuuccuuuuuuagacagucucucucucugucgcccaggcuagagugcaguggcgugaucccggcucacuacaaccucugccuccuggguucaagagauucuuaggccucagccucccgaguagcuaggguuacaggcgcgcaccaccuccaugcccagcucuuuuguauuuuuaaguagagacaggguuucaccauguuggucaggcuggucucgaacuucugacuucaggcaauccggccgccucggccucccaaagugcugggauuacaggcacaagccacugcacccagccuggaguauaaauuucaaaacauuaaaauaugaaucaggaaacuucgauucuggucuuuuucagacuuuagguuauuuuccuugguuuuauaucugaguauaaaagugaaaauaguuauuacacaaguggaaaauguucuucugaugaacaguauacauuuuauuuucuauagaugaaagaaaugaccugccgugauaucguuaaagaaguugcaaaaauguaaguugaaauuuuucuuaccauccacaaaaauauuucauuugaccuuugcauauauauauuacauuaauccuaagaagcuguuuuccuguaaaauaacuuaguguauaauuuuuagaagguaaauuuaacauucuaagaagccucacgaaggaagaaaauguuuuuaagcaauauuuuuuaguaguaaugaauaggaugggaaaaauagcuugacaaaauaaacuccuguuacagguuaaggacauauaccauuagggucuuaauuuguuagcucccaacuucucaaaucucuuaaguccuaauaauaguaaucuuaagauugccucuauuguaagaaugcuuacaaacuuuauagguuacaacuaauuauuucaauacaugauccaugaagcuggcucauuuauauaaucugcuauuuauuugggaaagauauguuucacuuuuucagguuuauuauaaaaguuccuauaacaagguaagaagagcaguauuacaaaacauuucaacaaccagcuuaagaaacccugaauaguuuauuacagguauauaaaguagaauacuauuaauauguaacagguauuuggacaguaaacaauaaaaaagucaauuaaccuggguagugauguuucuaaaauuuugugauucucuagaucaaagaguguagacauuugguauuacaaaaagauuccaacaaaauacguuguguagccagcuuuuuagauucaaaaguuauggauaaucguaauucauaacaacucuaaguauuccacauuagaacuacauaaacaaggucuagucaaucaccugucuguaugguaguguaucagguuuuacaucuaacaauacguggaagaaaaaaauuccaaugggcucuauuguuuaauaaacauacuauuuacaucacacucagagucucuuauuaaccgguccaucauuacugcuacugccuuuaccccucuugccaccuccuccccuccgcccuccuaguuucaguugugaagcaagcagaagccauucuaugauugucaguuaauaauggcaacacuaggaaccaacaugcagcagagcugcuaagaaaggaagucagauaucuuccuugaauuguauaguauguuaucaugauauacucuguuuccuucaccgaaccaauccuuugaaguccuucuggaaaucaguucuuaccaucuuuuauauuuagguauaaugguagucaucuguuaaguguuccauguuaggaaagccaucccuucaucauuuaagaaaauggagcagcauguuaucuuuuacuuaguuguagaaaaucaagauccucucauauuauagcaagguuuuagaagacccuccaaaaaguaagguauguaacucagugcauaguauuagauaaagcuauacucugcuacuguacuuaauuugauacuuuuuuuuuuuugagauggagucucacucugucguccagacuggagggcaguggcacgaucuuggcucacugcaaccuccgccucccguguucaagcaauucuccugcaucagccucucaaguagcugggauuacaggcgcccaccaccacaccuggcuaauuuuuguauuuuuaguagagacaggcuuuaccaucuuggccaggcuggucuugaacuccugaccuugugauccacccaccuuggccucccaaagugcugggauuacagaugugaaccaccgcaccuggccucuugauacuuuuuauguuacuuuaauauguugcaugacagugccuccuucuuugcuguaauuuguaagguacuacaaugugaaggccagguuauguggcauauaugccauuauaaaauggacaaggagcuuaaaaagacuacugccaagaagcuauagguugaagagaccacuaauaauugcaagcacauaaauuaguuuuuuuuuuuuuauuuuuuugaaacagagucucacucuguugcccaggcuggagugcagugucgugaucucagcucacugcagccccuaccuccuggguucaagcaagucuccugccucaguuucccgaguaguugggacuacaggccuauggccaccucaccuggcuaauuuuuguauuuuuaguagagacguggguucaccauguuggccaggauggucucgaacuccugaccucaugauccacccgccucugccuccccaaagugcuaggauuacaggcacgagccaccauguccagccaauuaguugguuuuaaauauauuuaaguuaauggacaaaauauucuaaaagggcacaguuaaugacgccucuuccuagugaauccguguucuuuaugagguaucuuuuauaguuguaucuuuuuuuuuuucugagauggagucucgcucuacuguagcccaggauggagugcaguagugugaucuuggcucacugcaaccccugccucccggguucaaggaauucuccugccuuagccuccugaguagcugagauuacaggcgcccaccaccacaccuggcugauuuuuguuucuuaguagagacaggguuucaccauguuggccaggcuagucucgaacugaccucaagugauccauccgccuuggucucccaaaguguugggauuacaggugugagccacugugcccagccaaguuauaucucuaaagcaaugugcaaaaauaaacugaacuuggguugauuagguauauucaacauuugucgggagaguagauguuucauuuuauuucagucccuguguaauuugucuucucuaauguuaaauacuauguagaaugugucuguguaauuuuauagauacuuuuauuauggauggacauucuaauuuguacugacuuugggucugugaacuacuucaauguuuggagguuaccaaaaucuuaccuuucccuuuucuauucuagaauuuacauaguacaugacgaaguuaaggauaaagcuuuugaacuagaacucagcuggguuggugaauguaaguuauuuuuguacauuuauuugccuuaggaaugaucuguaccacagcuaauuuacaacugaguguccuuucuaauauaaugaaagcuaaagcaaauuuacuagguugucuaaugaagggaaaguucugcuuaauaauugacuuaaguugugaacacguuauuuuuugaaacauccauuucaugguuuuaagauacuaugcuauaaauuaaugcucaggauuuauaaauagcauaauuuacuuucauuuccauaagaacuuaauauguaggcacauauaaucucauguagaagcagcacacaaaaauauucgaguauuacucauaguacaacuuugcaaccuuaggugagucagauauguggauuggguagauccuaugguauacugcaaguuacaauaugguacucaauuuaaaauucauuuacacauguggcuuaauuuacaguaacuaauggaagacaugaaauuguuccaaaagauauaagagaagaagcagagaaauaugcuaagguaagccacagcacaaaaacuucucuuggccagguacagucagggaaucacuuagcccaggaguuugagaccagccugagcagcacagcaagacccccaucccuaauuuaaaaaaaaaaaaauucucuaaccaaaauuauguguugaauaauauaaauagacuggggugguuucuaugaaauaacacugagaguucaguugaacuaaagauagaaauuuucuagguuaucucuaguggguaaaguugccuugguuccaaaaaaaaaaaacuugggagguuuagacugcaaagaguuuuuuaggacuuuuaauacuuuaaauauuuguucuuuuuuuuuuuuuuuuuuuugagacggagucuugcucugucacccaggcuggagggcaguggcaccaucucugcucacugcaaccucugccuccaggguucaagcgauccuccugccuccgccucccaaguagcugggauuacaggaacaugccaccauaccuggcuacuuuuguauuuuuggcuucaccaauaauacagagacggguuuucaccaggcuaguuucaaacucuugaacucacgugaucugccuacuuuggcccccguaaagugcugggauuacaggcaugaacacugcaccaggccucuuaaguauauauucuaucaaagauacagucauugcauguuagagcaacauuugcuuaauuaacuuugcuuggguaucuuauucugaaacuguucauucaguuacaaguagaggaauuuaaccacuuaauucagguuguuguagcuuaacuugcccacaggugugggauauaacaauuuuaaaaaucaauuuuaaacaccuguuuucucuuaacaggaaucucugaaggaagaagaugaaucagaugaugauaauauguaacauuuacuccagcaucuauuguauuuuaaauuucuacuccaguccaauguaacuauuuagcccuggauuauacauacuguccaauuuucauuaaauuuuugucuuauaacuauu

SEQ ID NO: 192361 - RNA, 75230 nt, Homo sapiens
caauaggaguucguguagaagcgagucugcucaacagcuuguuauuugguggauuguggcaguaaaucggggcgaguggggaacccggcgcaggaacugcagccgcggcugggaguggugcugcccggacgggggcccacggaggucagaggggaggaggacucuggagcugacagcgcgcacuucacccgcaguugguagguggggagaggggaauccggggauacugaauggacgaaguggcaguagcagcagcugcugcugcccgaggucccggugcaguuggaagcuuuggagguggggagagggaugcuaggcaaguggcacggcgagcgcaagggaaggggccagccauugaccagcggcagcaacugcaggaaccgccgccgcaguugcagccgccuccucguccgcuuccucggguucccgggaaaauggcuguggggcuggccgcgccgcuaaguuugcuuccgcgcggugaagagcgggcugcuugggggagccgucccccaacuccgcggcgcguccaccucugcggaguccguggcaggacucgaggggcuacgagcugauaccucucugggcuguacaaaaaguugaggcgggcgcugggaggaggcagcggcugcugcggugcggcuccccuccccucccacacccuguccgggccaccuccccuccuccuccccuccgccccccgcccccucccccacgcgggucccccggggcucuggcggcucccggcugaaggccgcggccccugccccuuugggugaaggagcgcuucuccuuucugacauggugcagagcgaaggaaggagagcaauggcgccgugacacuccgcugccgccaccgcgggcccggggcgggccgagggggccgagcggcggaggcggggcgcgggccgaagucgggguauccgggggaccgcggagcggaggcucggcggucgucuccgcgggggaccuggggaagcccgaagggagcucuggccuuuuccggagcuaucuguccuggagcuccgaguugagcauuccgggucaaaguggccagcgaggcgggggcgcggugggccgcuggcgagcuccggggcggaacgggcugcccuuuggcgcucgugggguucucgcugcccccucagcuccugcguccuggcugcccucguaaggggucuugucccuuggcuggugaggauucugccccuccccgcuggcguuuguuuacuuucuuucccuuggucgcuccccgcaguugacugauuaugucugugccugucuuucccccuccccauaguucuagcgacugcgaagauagcucgcugagcuggaaccccacagaucaccaacaaaaaugaagguaaguggagucaacucugccccgauccucgcgcccugaacacugccaauccuaaggcuagugccguggaaugucauuuguuuugcuacucaaaauugauguuccuacugaucagcaguuucggcauaggaggauguguugaaugggugaaaaaugaucugugugucuaaaugcggaguuuaggcccucucuguagcaguacuuuggaaaggcuggugcagccuuucaauuguuguccauucggauaguauuuuuaaacacuuccuguguuggcagcaaccuuugcagaaguaaagcuuuuguccugcuuugguucuuugggggauuuuuuguaaauuuuuuuucuucccgugugccaaugcgauuuucuaaaagaaagaauacguggauuaaguaaugaagguaucauuucuucuguguguaaaaugaacuuauguggcuaaaauauuugaaguugaaguauaauaauaguuuuaguuaaaucuuuccaauaaguauuuuaaaacauauacuaaaaagauacauauucuacugaggaugacugcaaauaucaguauguggaugguuaaagggaaaggaucucauauagcguucuugaaugcuguggccauugaauguuucaggucagauuuuuguuugccaaaagcauuccuauucaauuuguauuuuuuguaaaugcacuuacuuuaaaagguacccaauuccugucuuauuuacuguuucagcauauuaagcucugaaauauagcauuuucccaaacuuucucgugguuuucuauuuucucgaaguaaaugacauauuuaaccuucuuuaauauuacuugggaaaacuuauuagaaaacaaaaaaucauuuucuacuucaaaacguaucuccaaaguguacacuguuaacuuugcacuuaacaauguuaaguugaacuuguauggauacacuuuaacuuccggaaaaaaaaaaaaaagguaaaaugacagauugagauagcaaucauccuguuacuguaaaaauuaaaaugagugguagagugacauuucuuacaucuuucuauguaucauucuggucguguccauuugcugaaaguagauguuucuuaguaacgcuuauuuuuuuauacuaagaagauuagugugguaaacuagguauaccuacaagucuggagccaucaguucauaucugcauucaucggcugaauucagacuuaaaaccuuucaagugcagcuuuuagcaaaugaauuuuccaaaugauacuuuccuuaugaaaagauguuaccuuuauguggcuaugucaauaaacaauuauguauuguuaguguuaauauuaguagcaauauuucuuuuaauuugaaaaauuucaggaagcuauaaaugaauaacuuaguuuuaugauauguguaauaugaaauauuuuuucuguuuuuuucuuaucuuucugcuuauauaauaguagaauuuuugaaaaauuuuguaucgagacaaaacauuauuaaucacugauaauuuugaauuacaacuuuaaaacauuuuaucauaucaggacaucagucuauaaaaugaaagguugcuaaucaaguauuuaggguauuuuucaaauuuucaaugauauuaauaagcaagucauuuuaauauucuuaaugcuucaaacacaaccuuuuaaugagacuugagguuggaguagggaggcauaguaaugacauucacaguuuuauguuccuuucaccaggcggcagaugagccugccuaccugacagugggaaccgaugucagugccaaguaccgaggugccuucugugaggcaaagauuaagacugugaaaaggcuggugaaaguuaagguaauauuuguuuuuaugcaauaguuuuauuaacucuagauugaagaaauuuggggagagagagacugcaaaucagcauuuuauugagucauuauaugaaaacccuuuauauaccaaacuuaaaggaaaagcacaucaaaaauaaagaaauaaaaaacucaaaaggagaaauuauuccaaaaugcuaccaucaaaauaccaugcucaugauauuuccugucauuuggcucuuaacuauuugugguagcauacuuggacuguaaucuauuuucuccccucauuuaauguucagguagagacaauuuuaguguuuaggacaauacaaauacaacaggaauuauguuuucaagacaguguaaaaaagcauuuaaaaaguuuauuuugugacugggcguagugucucaugccuguaauccaagcacuuugggaggccgaagugggcagaucacuugaggccaggaguucaagagcagccuggccaacguggcgaaacccugucucuacuaaaauugcaaaaauuagacccggcgcggugacucacgccuguaaucccagcacuuugggaggcugagguggguggaucaccugaggucaggaguucgagaccagccugaccaacauggugaaauccugucucuacuaaaaauacaaaaauuagcugggugugguggcaggcaccuguaaucccagcugcucaggaggcugaggcaggagaauugcuugaacccgggaggcggagguugcagugagccaagaucaugccguugcacuccagccuggguaacagagcuagacuccaucuccaaaaaauaaaaaaauuaaccuggcaugguggugcacaccuguagucccagcuacucgggaggcugaggcaggagaaucgcuugaacccaggagguggagauugcagugagccgaaaucacaccacugcacuccagccugggugacagagggagacuaaaaauauauauguauauuuuuggcugugugaaguggcucacaccugcagucccagcacuugggaagccugaauggggggauugcuugagccaaggaauucaagaccagccugggcaacauagugagaucuugucuguccagaaaaaaagauaaaaaguauuagccaggugugguggcaggcaccuguggucccagcuacucuggaggcagaggugggagaauugcuugagccugggaggucaaggcugcagugagcugugauugugccacugcacuccaggccggaugacagggcaagacccugucucaaaaaaaaaauuuuuuuuuaagaugcuuuuacucugaaauaacuuuuuuuuuuggugguuccugccaguaauuuucuuauaugaauauauuuuuaauagucuucguuacuuuauacuuagauaccuccuaugcuuauuauaaacauuuuuaacauuauagagguauaucauauaguuaaugaaguccuccuuaaaaaauuuuauuuaaguugaugaauaauaauuuuacauauucaugggcuacauagucauguuuugauacauauaauguauggugauuaaaucaagauaauuugcauaucuaucaucucaaacauuuuucauuucuuuguguugggaauauucaguauccuccucuuagccauuugaaacaaugugauauagcauuguuaacuacagucauccugcugcgguauagaacacugugaaaguccuccuugauacgacuccaaagagauuugauguggucuuccagauuuuuuuuacugugccagucauaaaauuauugucauugguauuggaucaugcuguauugcaguuugcuuuauucacuuauauaucugauguuuuccuaccagaauuaagcaccauaaaaggaggaaacgucugacuuguucuaugcccaacacauagaguagugccugauacauaguggacccucaaaauuuguugaaugaaucagugaacuagagcagugauuccuaaagggucccuccagaccagcagcaucagccuuacuugggaacuuguuccaaaugcaaauuuuccccaccccagaucuacuucaucagaaacucuggggguaagauccaguaauuguguuuuaauaagcccuuuaaauauuucugaugcauguuaaaaguuuaagaaucagguugggcacggugggucauuaaucccagcacuuugggaagccagagugggcagauaacuugaggcuagaaguuugagacccaccuggccaaaauguugaaacccugucucuaguaaaaauacaaaaaauuagccagacaugguggugcaaaccuguaaucccagcuacuugggaggcugaggcacgagaauugcuugagcuggggaagcgaagguugagacccugccuaaaaaaaaaaaaaaguuugagaaacauugacuagaggagugugauuuguagguuaaauagauguaucuaugauuauuauaaaauuuauguuucaguuuucuugaugaaccuucaaguauuaggauaggaugucaauugacauucauuucuuuuuguuucauacaguguuuuuaucaugucagcuauauaggauuugauuacucuauauuuauuugggauucuuuaacaauucaaauuugguauuguggcucuuauuuacuuaaaauuaauacaaugauuguuuuaggaggucuuaccauacauuaccuagauuuugaauuuauuuggaccaucuauuauuuggaccauaguaaccagccaucuguuacggaugguuacuuuaugucuuuagauguguaguagaagggagcacuuguuuguaucagugcauauuacgauuauugcuuagcuucacuuuauaaaggaucagaguucugguuuuaauuuguuuaccuuucauauaggcaauacaguuugauacuguuguuuuucuuuguguacuugguggcaaucagaaccuuuugugacuugauaaaaagcaauaaaggcaguuuuuuuuuacaguaaucauuaaagauuauuauauaguucauuuaguaaacaguuauuaagugcugauaauaugcauugacacuugcuaacuguuggggauauagcaaugaagggaagacucagcccucaaggagcucacaguuaauaagagaauguaauaaguauuacauuagcaggggucaccacauggugcuaagaaagcauaaauuaaagacauuauuguuauaguguuacuauaaauguauuuguuuuaaaaguaauaugcaaauuauugugcaaaauguuuuucagguacuccugaaacaggauaauaccacacaauugguacaagaugaccaaguaaaggguccuuuaagaguauguauguuguacgguuuaaaaucugaaauaaucauagauuuauaccauauuuacugaauuuacauuucuacauagacuuaacauuuuaugagaacguuaaucagaaaacaauacauaugaaggguuuaaauauaauuaguauaaauugugauauugcaauggcuguauucuguuuuagauacuaaacaucuucuagaaggguaauuuaauauauauaaacauguuaaguuuuucaccuaccuuucuguuuugaauucuugaacuggauaccuggcuuuguuuuucacauuguugcuguaucugaggugauguuuagccuucuaaguugaguaucauaaccaucaaucuuugguuguucuaauuuaccaaguaaacuauguucacuuccuaauucaauuuaaugaauaccuagauuauguuuuccaugcauuucuggccauuuguuuauguaauaaaucuguuauaucagaguaccacuuugguuaauaucugauauacaaaggucuggaaacugaaagaaggucaacugguccaucccuaucucuccaggugaaccuuuaucuaaaagguaccuuaaauacaaaugcugaauccaauauucacuauuucugugaaagaaaauggaugcuauuuugguugucuuauaauuuuacaguucuucgauuuaauuuucuugaaggcaaugugauauaguggaaaagcucuaaaguaagauuuaagagacugggcugucaugcuggacucugcauauuauuuucucuuucugaacggcaauuuucaguguguaaaguagggguaauaauagcuaccuaacuuuugucaaaguguuuuggagcucaaauugcauaauaaauagauaaguacuaugaaugauaaagaucucagacaguguaagauagaauuaucauaaguaugguguuuauuuuucuuagcuagauuauauaguuggugggagugauuugguuuauuuguuuaaauuugguaaggaaauugggauuucacauuuuagguuggagcuauuguugaaacaaggacaucugauggaucuuuucaggaagcuauuaucagcaaguugacagaugcuaguugguauaccguggguaaguaauuaaguaauuuaacacagauuugauuuggagguugcauguaucuguguuuuguggauacacugaaucauuguguugguggagaaauauauauuauuuccugucaguuuacuggauauagcugacuaaaauucuaagaaugcccuguagguaacaaaaauaauuaucucuuacaguaaguuggccacuuuugucuauuucauccaaaaauguacuucuauuuuagguuacuuugauguuucuuuucaagaaaguuagaucacaugauugugaucacuuuuucuauaauuacaauuaaaauugcauaguugcgaucguuacuguauugcuacauauuuuauacaaggguaauguagauguugccagacaauuuacagauuuaaaaaauccugaccaugguagauucaagaauaggugauuguuaacuuaguuuuugauuuuugauacagugugggugcucauauuaacagcuuucaaggucgggcauguuggcucaugccuguaauccuagcauuuuggaaagcugaggcggguggaucacuugaggucagaaguucgagaccagccuggccaacauggugaaaccccgucucuacugaaaauacacaaauuagccugguauuaguggugcaugccuguaaucccagcuacucuggaggcugaggcaggagaaucgcuugaaccugggaggcggagguugcaaugagcccagaucaugccacugcacuccagccugggcgacagagugagauuuggucucaaaaagaaaacagcuuuuaagaaaaauauagaugcuccuaauaugaaugcaugaaugcauucuuaacauuccaugcauaagcuuauacuggcuuuagauaacuuuauuguauuaauagugagaagcaacaagugucauaauacuuguaaguuaaaaccuuaaaguaguacuuaaauaguugcugucauuauguugaugagaauagcauuaaguaacauuuccaaaucuccucucaguacuuucaaacugcacaauccuguggauaacauccaaucuauagcauuguugguuuuuauacuuauuucuugguuuaagugguauaauuauuuugugguuuucuuguagaaauaaaagaaugaccauuuagguuuacuuuuaguuuacuugauuuguugcuuuggguaaaaaucauucacauccaguugaugcucaguguugugaagaacuaugcuuugguuaaaaauuucucugucuuacccuguaccuucuauuaguaguaccaauuugcuguguguaaguacuuuuuucaaaccucuuugaugcuucuuggacuuacuagaauuuaguguugguucacaguggugcuauuauucugaacuacauauuuuuaggaagcuuaguuguggcuacugauaguuguuaaauuuuaaaaacuaaguggccagaugcaguggcucuaaccuguaaucccagcacuuuaggggggcgaggugggcggaucaccugaggucaagaguucaagaccagccuggccaacauggcgaaaccuugucucuacuaaaaauacaaaaauuagcugggugugguggugggcgucuguaaucccagcuacucaguaggcugaggcaggagaaucgcuugaaucugggaggcggagguugcaguaagccuagauugugccauugcacuccagccugggcaacaagagcaaaacugcgucucaaaacaaauaaaaacuaagcuuaauguuaacucuuagagauuaaguaaauacaucuuugcuuuaucaaacuaagaccugauaaaaauuacagguguguguagaaucaccggaaaauauaugaugcauauucagauauuuauauugcaccuuauauuuuaacucacuauaaagguuguacucacuuugaagcuuuacugauaaaaugcgcaugcucuauagaaggauuacuuuucagguuuucucauuuuggguuucuuuaucccagaguaguuauucaauuaugaauagcaaccuuuguccucuacaugaguagcguuuuaguguuucuaaaaacuagucacugcuaagcauucucuauggugauuuucuguguuggauaauuacagaagaaauuguauaauucuuguucucaaagagcuuuagaaucuuaauugcauauaauugagguaucaagcauuaguggacauaagaaucacuuggugcuugcuuagaaaaaugaggauuugaggaccccaagccucuccaauuaguaggccuggggauggcaguacaagaauguuuuaauaagcaugucagugauucugaugcagguaguucacacuuauaaaaacagggaaaaacagauuuauuugggagaaaaauucaaaauauuaaagauuuuugcacuuacgugcaugaaggaaauucauaaaaagauuuugaaaggcacuguuccauucagaaaacucaagauagcacugcucuaaagaacguuuagauauugaaggaaguggaucacauaaagaaugaucagaguauaaugaccugaguuaccaguugguuuaaaaaaaacaguacaaugaaauguaaaaccucuugggucaugaacauccuguauuuuucuuucagugaguaccuacuaccuaccuauuagguguaauugcucuuuucuggaauuuuuuuugauuucuaguuccuagcaaaguauuacauggguauagucagaaaauuauucagaguguuuaugacguguguuaccuuuuuugguuucaugagauaccagaaauuaugucagauuauuaaaaauaaaacaagaggauaccacauugcugguuuggaucaaauaggaguuaugaucauuagugaucuaaaguuaucauuagagucagugauauuaacuucuucuugcauaauacagguaucaauuucccuucuguuaaacaugauuaaccaauuuugaaagagauuauggauauaguaugacucaguuuuuaaaaaaucugguaauaucuuacccucuaaugguuuauuucuuguuuguuuguucguuuuagagacaggaucuugcucuguugcccaggcuuuuguucaguagcacuauuguagcuuccugcagcccugaauuccugggcucaagcagucuuaccgccuuagccucccaaaguguugggauuacaggcaugagccacugcucucagcuuccccuuuaauguugaauaguaaacagcaccaacucaaggggauuuuuuuguuucuguuuuuugagcaauagaaauauuuccucuuccuaccauuccuaccauaguuuacucauugauaguuguuauccuugccauuaaagauaaggaaucuguaauauguggaaguguguuaucuguucagucauucaaaagguguuaaaauugggauuagaauucauaccucuauccagcccaaaucucuaguuauguuuuuuaaaaaaggaauuaauauguccaguuaaauguuaccacuaacuccugguaaauacaacugucaguaagacauuuugaagguacucucuguuuugccuuuuuguaauauaaaaacauauacuugaaaaguaaggaaaaguuaaaggauagaaauuucaguaauucuaguaauuaacuuugaaaauguacacacacagaucauuuaucaaguuuagcacuaaaaucuaucaucuguauuaauguuuuuguaacaagaagugcuuaagauucagauuauuuuguaccuuguaguuacuguuuugaacaucgguuauaucagauuuuguguaaguucuaguuaauauugaguagaggagguuuagauucaacuggugaauuaauuaaauuuuguagaauguccugcagguuuauaagguuuuuaauguagucagacucgcuuaugacaaauguuauaaucaaaaucaaccacaaaauguuuucaaacccagguggcucuucuacugacuagaagauaauucauuaagaaauaaaguaguaaacaaaaaaaaguguuuaauccuaucauaggcuuuaacucauuuuuuaaauggccuucccuaagacuuaguauucccaugauauuuucuuaauguaauuauguauuugaguguuaauuucuuaaauuuucagauuccuggaguuuuuuuuuguuuuuuuuuguuuuuuuguuuuuaccuuagcugcugagggacuucuauaguuaucacaguugauucuaugaauaacagaacuauugaagcuaaagcaaucuugaucaagaagaacaaaacuggagacauaccaccugauuucaaaauauacuacaaagcuauaguaaucaaaauaucaugauacuggcacaaaaauagacacauagaucaguggaacagaauagauaccccagaaauaaauccaccuauuuauggucauuugaucuuugacuagggugccaggagcacauacuggggaaaggacagucucuucguaaaugguguugggaaaacuggauaucuacaugcagaagaauggaaguagacccucaucucacucgauauacaaaaacuaacuggaucaaaguggaucaaagacuuaagacuugaaauugucaaaccacuagaagaaaacauaggggaagaggcuuuaugacacuggcccgggcauugauuuuuuuuuuuuuuuuuaaugaccccagaagcacaggcagaaaagcaaaacuagacaccugggauuacaucaaacuaaauagcuuccacacagcaaaagaaacaauccagagagugaaaagacaaccuucauaauuggaaaaaauauuugcaaacucuguauuuaauacgggguucauauccagaauuuauaaggaacuuaaacaacucgauagcaagaaaacaacccaauuuuuaaaaugggcaaaaggcugggcacgguggcucacgccuguaaucccagcacuuugggaggccgagacaggugguucacuugaggucagaaguucgagaccagccuggccaacauggugaaaccccaucucuacuaaaaauacaaaaauuagcuggguguggugguacaugccuguaaucccagcuacuugggaggcugaggcaggagaaaugcuugaacccuggaggcggaggcugcagugagccaagaucaugccacugcacuccagccugggcgacagagcaagacuccaaucuaaaaaaaaauaaaugaaaauaauaggcaaaggaccugaauagaaauuucucaaaagcagacguacaaauggcccacagguauguaaagaacuguucaacaucaguaaucaucagggaaaugcaaauucaaacuacaaagagauuuuaccucacaccugcuagaauggcuauuaucaagaagauaaaagguuacaagcacuggcaaggauauggagaaaagggaauccuugcccgccauuggugggaaaguaaauuaguauagccaucauggaaaauagcauagaaguuccucaaaaaauuaaaaauagaacuaccauaugauccagcaaucccacuccuggguauauaaccaaagaauuaaacuaguaugucagagauguaucuguauucccauguuuauugcagcacuauucacaauagccaagauaugggauaaauuuaagucucuaugagcagaugaauguauaaggaaaaugugauauauauacauaauggaauacuauucaacuuuuaaaaagaaggaaauccugacauuucuuacaacaugguugaauccaggggacauuaugccaagugaaauaagccaggcacaggaagacaaauaccauaugaucucacuuaaaaagucaaacucuuauuagagaguagaguguugguuaucaggggugggggcagcuugguuggggugggcggggggugagggauuagguaaaugucgguuaaaugauacaaaauuucaguuagaaggaauaaguucaagagcuccauuguacaacaugaugguuuuagccaauaacaauguauugcauacuugaaaauugcuaagagaguagauuuugaguguucucaccacacacaaaaaaauaagccugugaagugauccacauguuaauuagcuugcuuagccauuccacaauguauacauauuucaaaacauguuguauaagauaaauacauacuauuaauguuaaauuuuuuuuuuuuuuuuugagauggagucucgcuuuguugcccaggcuggagagcaguggcgcgaucuuggcucacuguaagcuccaccucccagguucaaaugauucuccugccucaguuucccaaguagcugggauuacaggcauauaccaucacccuggcuaauuuuuauauuuuuaguagagacgggguuucgccauguuagccaggccagucucgaacuccugagcucaagugauccaccugccucugccuuccaaagugcugggauuacaggcaugagccuccgugcccggugaaauaaauaauuuuuuuuuaaaaaaacuacuggccuuaccuagggcauccguauguuuuaaauuuuaaaauguuugcuucauuaugugaagaauucuauaauuuuguuaaucauaacugcuguacauggauauaacaauaaugauacuuaauuuuccaaagucagaauucaugacuucuuucucagacuucauuuuauacuucuguuucaugccuauuaugucuuuugauauccccuuaacuaaauuguagcucaucaguuaacuuucugauucuguuucuuuaccuauaaaaggaggauaaugguuccuacuuuguagaggcuguugugaggauuaggacaugguagaagcuuaauaagugauagccaauuauauuuauagacagauaaaauuaauuuacuguuauuauuuuacuaucuuucaguaucagugcugugauaacagggaaaugggucuuuguauuuaguaguugaucagauccuuuuauuugaauucuagcugauuaggguuaggauuuguguguuuguuugcauuggcauuacuuugucuaauguguuuaguaugguugguguuacugugaaagucucagcuuugucauuuuccucuuaauagauuuuaauauuuuaaucccuauuaggauucucuagagagaaccaauaagauauagauagaugauagauagacagauugauacaagaggggauuucugagagcagugguccccagccuuuuuagcaccagggaccgguuucgugagagacaauuuuuccauggauggaagugcugggggaugguuucgggaugaaacucuuccucuuuagaucaucaggcauuagcaucucauaaggaaugcacaaccuauugguagaucccucgcuugugcaguucacaggcauuugcgcuccuaugagaaucuaaugccacugcugaucugauaggagguggagcucaggugguaaugcuugcuugcccaccgcuaaccugcuguccgguccgguuaccaacaggccauggacugguacagguuugugaccuggggguugcagaccccaguauuagagaaauuugcucaucauacuaugaggacugagaaugaccaugacagguucucuguaagcuggagaccugagaugccaauagcuaggcucuauccaagucagaaagccuuagaaccagggaagcugaggauauaauucuuagucccaggccaaagccuugagaagaucugagggacugcugguauaaggugcagagucccauagccaaagagccuggaguucugauguccaagggcagaaggagaagagugucccagcuccaggagagagaggaaaucccuuucucucauuuuuuguucugucugggccuccggccaauuggaugguacuugcccacagugagagugaaucuuccccaccugguucacuggcacaugugccaguuuccucuggcacacccagaaguaauugcuuuaccacuucucuagguauuccuuaauucagucaaguucacaucuaaaauuaacugucaaaauaccuaacauaguaacagagauaccacuuuugguuauauguauguucugcuagacucaaugaacaaucuauucaaaagccauuuuuggaaaauauaagacauuucauagaauuauuaaauccuuguagucugacuuuuuuuccucuuagcaugcuauagaagacugaacuaaaaagaagcuagacuugcuauauacaacauuaauuauuucacucuuacaaaaauuauacucuucagugccuacaaauguuauguucuuuuagaugagagcucuaagauggaaguuaagagaggaacuuucuuuuagauggagcuucuucaugguuuugaucaucagggaugucaugauugauaaguucauaauguuguugguuuuauaaaaaacauagaaauauagaaucagggucucacuuuguugcccaggcuggacugcaguggcaauuauagcucccugcaucccugaacucuugggaucaugugauccuccuaccucagccauucaaguaguuaggacuacaagcaccugccaccauacccagcuaauuuuuaauuuuuuuuuuguaaagacggggucucgcuguguuagccaggcuggucuccaacuccuggacucaagggauucuccugccuuggcuucccaaagcaccaggauuacaggugugagccaucacaccccugccccccauuguuggguuuucuauuucucuuucagaaaaucuugcaaaauuacaaauuuauaaaguacccaacauacauuuguauaauuuugugaauuaaaaaaaucuuagucuggguucaguggcucacaccuguaaucccagcacuuuggaaggccaagguggguggaacacuugaggccaggaguuugagaccaaccuggucaacauggugaaaccccgucucuacuaaaaauacagaaguuagccgggccuggugacgugcaccuguaaucccagcuacuugggaggcugaggcacgagaaucacuugaaucugggaggccgagguugcagugagccaagaucaugccacuacacuccagccugggugacagaaugagacucugucucuaaauaaauaaauaaaucuuaaauuauuucuuuuuguucacuuaagguugggaggguuccuauauaaaacuguaaaauaguuguuuguaucauaauccccuuuugagcaaucucuuuuuuuaaaaaaaaauuucuauccaugauaagguauauuuaagugaaaugaauuuuuccuuccaaaaaucugauuuuauuucaaagugauuauugaaauuuuugaauuguugaaauucaaaaauugcugaaauauuuuguuuaaaauguugaaauuguugaaauuuuucaucagaacauuuugguuuagggcugccauugauuaaugauaaaacauuauagaaaauauuuuguuauauaaauuuuggaguguuggucuuacauucacauuuuccuuuuucauaccuccauuuaaaugugugugugugucuaguaucgucaucuuugguauuguaggcauuaagaaaaguugaaaaccuuucagguuuuauucuuuuugaaaucuuauacuuacagauacuaauacuaacaagaauuauauuguuugguuugugauaauuuaaugauuuaaaaacuuuaagagaacagugguuaauuuuuuagacuugacacuauaugaaucauaguuuuuauaucaaauauuuagcacccuauuacucaagugcagaucagugauguaaucauuggaggauguuguguuuuaaccugucauugugccugcagcuagucauuaauuucuggaucauugacuguguauagcacagcugcuuuuuuagaaucaugguucuuugaguaugugcuucgggaguuuuuaauuuuuuccacauugucuccugcauguaaaagaaucuaagcuagguaucuguagucuaagagggagaacugauugaaguaaauaaauauuuaacauguugaaagcuuuuauauaauuuucuuucaaaaaacuuauucauuaaagguaagcguaggauuugaaggcaaaguguuugcuaauaaaacaaccuuuucagaaaauaauucaggauuauaauuucauagguaaccaauuaaaaaauucuaagauaucaaaugaauguaauguagaauuucuuuuuguuaacacugacuuauucuguuagaauggaaaaaaguaucuagaauugugaaaauuaguacuaaaucuugauaauuguuuuuggguacauauguaugcuuucuuguuaagugaauauggauguuaagugucugaaguaaagauuauaucuuauuuuauucauaaccuggggcaaugagguaccuucugagagcauuuucuuuuuaauaaacuauaaauguuggaugcuaaaaucagaauacagucucaaaaguuaaaccuauacaauuaucaaaauaauauauuguuagugauuaggagaauauuagggauaaauuguaaaauuccuuaccccauuuccuugaaauguuuaaauauagucaaguaguacgauuuuguuuguuuguuuguuuuagacgaaguuuugcucuuguuguccaggcuggagugcaauggcgcaaucucugcucacugcaaccucugccugccggguucaagagauucuccugccucagccucccgaguagcugagauuacaggcgugugccaccaugccuggcuaauuuuguauuuuuaguggagacaggguuucuccauguuggucaggcaggucucgaacucccgaccucaggugguccgcccgccucggccucccaaagugcugagauuacaggcgggagucaccgcgcccggccaaguaguaugauuuuuuaaaauauguacuaaaggccaggcgcggugcucacgccuguaaucccagcacuuugggaggcugaggcaggugaaucacaaggucgggagauggagaccauccuggcuaacauggugaaaccccaucucuacuaaaaauacaaaaauauuagccgggcguggugacgugugccuguagucccagcuacuggggaggcugaggcgggagaauggcgugaacccgggaggcggagcuugcagugagcugagaucgcgccacugcacuccagccugggggacagagugagacucagucucaaaaaaaaaaaaaaaaguaguaaaagcaaaaaauuugagaaagcaucuauguaauuaugauuuuuuuuaaaguuucuuucuuucuuucuucuuuuuuauuuuuuuuuuuugggacggagucuugcucugucguagaggcuggagugcaguggugcaaucucggcucacugcaagcuccgccuccuggguucacgccauucucccgccucagccucccgaguagcugggacuacaggcgcccgccaccacgucuggcuaauuuuuuuuguauuuuuaguagagacgggguuucaccguguuagccaggauggucucgauuuccugaccugaccucgugauccgcccaccucgccucccaaagugcugggauuacagacgugagccaccgcgccuggccuaaaguuucuuuuuaaaaaaaccuuuauauuugucuuuuuuuuuuuuuuuuuuuuuuuugagacagaaucuugguuuugcugucacccaguggcacaaucauggcucacuaaccaugguugagccuugguuuuucgcggcucaagcaaucguuccaccauggccucuccaguagcugggaccacaggcaugagccaccacgccugcccuacaaacuuuuaucuuucuguuuccuuauuucaaccuuuauuucuaaacuucucagcuggguacagugguugaugccuguaauccgagcacuuucggaggcuuaggcgggaggauaauuugaggccaggaguuugagaccaaccuggguaaaauagcaaaauccugucuuuauuaaaaaaaaaaaaaguuuuuuuaaacagacuacuuacauccuuuucuaacaaaagaaagaacuuguaucuuaugacuuuagaauuuggcagcugguacauguguaguagguuaucaugcaaauaaauagaagcaguagaauaauucaauagcaauaccaggagucaguuucuggaaguuagggguacucuaauauuaaacuuuuguggaaaaauccauaauacuuuuuuuaaucagguuuuuguucauucuucuaggauugcaguuaauuuaauauuuaugcuuugacuagguugcuaaugaguuaagaaggugguucuguagugauagaaaucaaaaaagcagauggaaauacuuaagcagucgugggcagccauuuaaccuguguuuuugguaucuguagaaugaaaaauauggcaugguaugcucauuguaaagguuuugaaaaaugacuaaaauaaugguucuuacaaauauuaagcucuaauuaauagcaauaauagcauucugugcuuuuaaguuuuuauuucauuagugugcauaaauucucuguuaucuuuugcuuauuauaguguuugaugauggugaugagcgaacauugagacguaccucacuuugucugaaaggagagagacauuuugcagagagugagguagggugacacggauggacgauuuggauugaacuacagguacugaucuagagguaaaacguaauuuaauuaaucuauuucuuauacagacacuugaccagcuuccauuaacaaauccagagcauuuuggaacuccaguaauugcaaagaagacgaacagaggaaggagaucuucucuuccugugugaguuuuuucauauaugguaucauuuuaauuacaauuauuauaaccuuaaacaagggauuuuguuaggauggcuaaauucauuuggguaagcuuuccauagcauauuguauccuuauguuagacauuuuacccugaguggaccuuguucuuaauuauucccaauauuugcccaggaaugauaacaacucuuacuucuaauagauuauuuuuguuuuaaguuacuuugccgaaguuuuuuuuguuuuguuuuguuuuugauuuuguuuuuugagacggagucucgcucuguugcccaggcuggagugcaguggugcaaucucggcucacugcaaccuccgccuccuggguucaagcaauucuccugcuucagccuccugagaagcugggacuacaggcaugugccaccacacccagcuaauuuuuuuuuuuuuuguauuuuuaguagagaugggguuucaccauauuggccaggcuggucucgaacuccugaccucgugauccaccugcuucagucucccaaagugcuaggauuacaggcgugagccaccacacccagccugagccacugcgccaggcccaaaguuuuuaauugauaugaugauuuuucuauuuuaagugaguauauguuuuuuaucuuuuacuucaaaaacauuucaaacuuaaagauugcaagaauaauacacgaauaucuguguaugaaugucuauauacucuuuuuuuuuuuuuuuuuuuuuuuuuuuuuuuuuuuuuuuggugagauggaguuugucugugccaccaaggcuggagugcaguggcaugaucuuggcucacugcaacuuuugccucccagguucggugauucuccugccucagccuccugaguaguugggauuacagacacaccaucacgccuggcuaguuuuuguauucuuaauagagaugagguuucgcuuuguuggccaaauggguuucgaacuccugacgucaagugauuugcccgccuuggccucucaaagugcugacugggauuauagauaugagccacugcaccuggccuaaugucuauauacucuuuaucuagauuuaccaguucuuaacauuuuucacacauuugcuuuacgauucccucucuauauauauacuaauuuuuuucuuuucuuuuuuuuuuuuuuuuuugagacggaguaucacucugucgccaggcuggagugcaguggugcaaucucagcuuauugcagccucugccucccagguucaaacgauucuccugccucagccucccgaguagucagaacuacaggcgcgugccaccacgcccagcuaauuuuucuauuuuuaguagagacaggguuucaccauguuggccaggaugaucucgaucucuugaccucaugauccaccugccucagccucccaaaguguugggauuacaggcgugagccaccacacccggccuauacuaauuauuuuuauauuuuguaauaauuuuauuuuucugaacuauuugagaggaaguggcaagcaucaugauccuuuaucauuaaauauuuaggaacaaggagauguucuuacauaaccaaaguaugaauaccaaauuuagaaaauuuaacgcugauagacuacuaucauaauauaugguuaauauuucaaacuuugucaguuguuccaauaauagccuuuauagcgucccccaguuccccugauuacaggauccaauucaggaucaugcauugcauauaguuuauaugguucuugagucuccuuuaaucuaaaaaaauucuguagccuuuuuucuuccaugacauugacuuuuuuuuuuuuuuuuuuuuuccccugagacggagucucgcucugucacccaggcuggagugcaguggcuggaucucggcucacugcaagcuccaccuccuggguucuugccauucuccugccucagccucccgaguagcugggacuacagucguccaccacgacgccuggcuaauuuuuuguauuuuuaguagagacgggauuucacuguguuagccaggauggucucgaucuccugaccucgugaucugcccgccucggccucccaaaguguugggauuacaggcaugagccaccacgcccagccgaugacauugacguuuuugaagaauacaagacaauagucuuguaaccuguucccuaauauguuggauuguuuucucauuguuagauucagguuauauauuauacuccauaagugauguuguguccugaaggaaagcacagcaagaaguauuaucaguuugucccauaucuggugauacuaacuuugauuaagguggugccugccaaauuucuaaacuucagaauuacuauaguuaccguuuuuccccuuuguaaaaucuguguggagauacuuugagacuauuuaaauauucuagucucugucaaacuuugauucacaaauuuuaucauguacuaauaauucuugccugaaucaguuaguacuauuaugauagcaaaaugcugauuuuucuaauuuuucauucuugcuacauuuuuugguuaucgcuuagcuauaaugaaauucuuuuccuaacgcuauggauucuaauuuuacuuaauggguuacaauucagguuguuccagauuuagccaagggagccugggagccuuuccaggauggcuucuguguucuuuugauauggccucaccauuucuugagcacuuuuucaccuucuggcaugacaagguauccuaggcucauguuaauuuuuuccugcgccaacccuggaauuggccauuucuacaagggucccucauuuauuuuagugggaauuaauauuuagaaaccaagauccugguauuagauauguacucacugcugcuggggaguauauaaugaguauuuuuaaaggcaaagucagauaacaccuaagcugcaaaccagaaaauaauaaaagaccuccgaggacccuaaauggaaaucccaacucagccauauacuagauauaucacuuugggaaaauuacuuaaccucuuuaaaguuaacuacauuuauguacauuaaaucuucacaaaaaccugcaagauauuauuauucucaauuuauagcugaggaaaaugggaacaguaaugucuugcugguuuuuguauuagauaauguauagaauuuucuuuuuuguuguuguuguuguuuuuuuugguuuuuuguuuguuuguuuuuuugagauggagucucacucugucacccagacuguaguguaguggugcgaucuuggcucacugcaaccucugccucccagguucaagugauucucgugccucagccucucgaguagccaggacuacaggugugugauaccacaccuggcuaauuuuuguguuuuaguagagaugggguuuugucauacuugccaggcuggucuccaacuccugaccucaagggauccacccgccucggccucccaaagugcucagauuacaggugugaaccacugcacccagccgauaauguauauaaauuuauuaguguguaauaaguacucaggacaugauauauauuuaauaauucaauacccaguauuuuauuucuaagcuaacuccauagacuucuacugaaaacuccuucauacuuauuuuauaauuuuaacaaguugaguuaucugguuucucagagugcagcagauuggaagaugugucaaaaggaaauacaggaaagaucaguagaugcagucaauaaagaaaacuguggagucucacagcugagaagucuaugacaagaaaaaaaggacuaaaaccauaaaaauauaaugaaccaagugguuuugagccauuuaauaagaguuaauagcucugcauacuuuaauaaacuccaacauuaucaauauauugcaggaugucuuaaaaauguaggcuuggcugggcacguugccucacaccuguaaucccagcacuuugguaggcugaggcgggcagaucacuuaaggucaggaguucaagaccagccuggccaacauggugaaaaccugucucuacuaaaaauacaaaaauuagcuaggugugguggcaugcgccuguaaucccagcuacucaggaggcugaggcaggagaaucucuugaaccccaggaggcagagguugcaguuagcugagauagcaccacugaacuccagccugggugacaaagcgagacuccauuuccaaaaaaaaaaaaaaaaaauauauauauauauauauauauaugcuuaaaauuuguugaaacuuaaggguaaacuuuaguuacccagauaaguuaccuuaaguaaaccuuauggguguuuuaaugagauauuuucauagccaguuagaaaauuaaaguuauauguuauauuaucuggcauaaaaauagaagggcaaucuuaaaaaaaaaaaguauuuggcacaauaaguauuuaauggugguguaauuagguuuuucugucccagcuggugguggcaugagagccuaagucuaagcacucauugaucuggcgaaguggacucagaguuaccauagacaacucaggacuacauaccucugugaggcuaaggaaggacccaugucuucaguuacaauaagaauggagaggcuacuacuuuaggguguaguccauuagaaauugaauugacuauauuaaauucacaauacucuguaucaaauaauuguuuguguuaggauaaugaucaaguuauucuaacuuuuaguacugaagaugaaaaggaagaagaaagcagugaagaggaagaugaagacaagcgccgucucaaugaugaauuacuaggaaaaguuguaaguguggugucugcaacggagaggacugaaugguauccugcuuugguaaguaaaguuucuuugcagaguuaaucagccgucuaaauauuuguuuuaaauggauuuuuuuaaaagcauuuaaaauauuuugaaaguauuaaacaaauuuggacuuuauuggagauuuuuuaauugaauaaucauagucagguccauaauacuucacugucuucuuugguuauucuuucuuuaauucucuguaggcuuuuauugagcucuuuuauauuucuucccucauaauauguccaauggcuuuuuacucuauucccauuaccuuagguucccuuuuuuuuuuuuuuuuuuuuuuuuuugagauggagucucgcucugucgcccagguuggagugcaguggcgcgaucucggcucacugcaagcucugccuuccggguucacgccauucuccugccucagccuccggaguagcugggacaacaggcgccugccaccacgccuggcuaauuuuuuguauuuuuaguagagacaggguuucaccauguuagccaggauggucucgaucuccugaccucaugguccgcccaccucggccuccaaaguucugagauuauaggcgugagccaccgcgccuggccuuaacuugauucuugaauucuuucuuuacuguuaauucagauuaauuuuccaguacuaacuuuuauagagaaaucguuuuuucuugcuguugugacagggucucacucuguuucccaggcuggagugcagugacgugagcacagcucacugcagcuucagccuuuugggcucaggcguuccuccuguuucagccucccaagcagcuacaaguacaggagugugccuccacaccuggcuauuuuuuuauuuuuuauuuuuuguagacauguagccucaugauguuuccaggccagucucaaacuccugggcucaagcaaucuucucacuuuggccucccaaggggccgggauuacagguaugagcugguaugccuggcugagaagucuuuuuaaaauaucauuuagucaugauagucccauucucagaaauagacaaccuucagcgagucugccuaauugaucaguuuugcauuuuuuaaauggauauuugaggccaucccuggcucucaauuuauuuccuauuuuuaauguaaacucuacucaaguucuuuaacugcccuguauuuaagauacaucacuccucuaagcauuuaucccugccuuaaauuaauuaguauuuacugaggaucugcagugaguucagcuuuguucuaagcuccuuagaagauaaacaaauacgaggcuuuaauguauugcccucaagaagcuuacuguagacauguaagagauuacauaguuauuaaagauuguauaguaaauuaaaaaaaacaauuugguacugaauggaguaagaaaggagggguucaccuaaaauuuaaggaagauuuuagaaaugacaaguuuuggauggguugguagagaaagcuaauuuuugcuuacacagagaaggaauaagaagaagcgauacacaagagaauuauuucagagaggaauaaaaaaugauuggaaauuaaugccuuuuuucuucucuuccuacuccuuuacuuccuccuccacuucuucauccccucuuaaauaucucuuaaaguucagcucaaguccuacauucuuugcaagguuucucuuaaauacucuuguuuuguuuuguuuuguuuuguuuuugagagaggaucuuuguugcccagacuggagugcaguggugugaucacggcucacugcagccuuaaccucccugggcuuaggugauccucccaccucagccuccugaguagcuugggaccacagguguacaucaccacaccuggcuaauuuuuguauuuuuguguggagaugugguuuugccauguucuccaggcuggucucaaacuccugggcucagacaauggccuuggccuuccgaggugcuggaaucacaggugugagccacugcgccuggcccuaaauauucuuaacauaaguaugccccuuugauuuuugguaucacuuaucucuaauaauaauuguggcacaaaauguaucccaaauuagacuauaauccuguaaagagcugaaaguauauuuuuagguuucuaugugcauguaaauauauuacucaguuccuagauaauagauuuaauuuguauggggaaauucugaaagucccuugaaccuuucaguuguauagaaaaauaaguaauuuggauucagaauauucagauuguagguuugccaagaguuuuuuuuuuuaauaacaaauucuuuuauuuacucagauuuaucauuuaccaggggauauugaaaauaaaaaauaaguaagacacuauucuuacauuugacgauuuuauguauaauguacagaauaauucaaguaacaguaauauaaaauaguauauguucaauauuaggacucccuggccugagagauuacauuuauuugaggaaaauacagaaagccuucacaaagcaggugcuuuugaggugagcuuugaaggauuuaaagauaguaggcaaagcuucacuagaggaaacaaaaaaauagguuaaaaaaauagcaugccuguaaucccagcacuuugggaggcugaggugggcagaucacgaggucaggagaucgagaccauccuggcuaacauggugaaacccugucgcuacuaaaaacacaaaaaauuagccaggcguggugguaggcaccuguagucccagcuacuugggaggcugaggcaggagaauggcaugaacccggaaggcggaacuugcggugagcugagaucgcgccacugcacuccagccugggcaacaaagcaagacucugucucagaaaaaaaaguaggaauggguuuguucauggaacuguuugcucugggaauccauuuuggcuaaauauuagaugcgagugggggaauaauaggaaauauagcugugaacauaauuugaaucuagggcagaagggucuuuaaaaguucaucuaaagaauuuggacauaauucugcagagaauuuuccaaaagaguguuguuauuugagcuacauguuuaggaacgugaaugaagaauggcguguuacuagaaagacuggagguggcaggaaucuauuugaaggccauuaaauaguucauagguaagguaauuagaccuuggguuaugccuacucauccuuuaaaauuuaccuuaagcuuuuccugccacaccuuuuccuugcccagguuaggugaaaucuuccuccuugauguuuucauacuauuaugugccuagugguaucacuguacuuauccuccauuguguucuuuuuguguaucuuuuuauguuugccccuccaguauacuguuagcuccuugaggguuggcacagcuauauuauuagucuaauaauuacuggcaccaagcaaacaaacaaauacuuccaucugguguuaagacagcugaugugacugccaagaauauucaauuaucuggauauacacuauucaguaugauaaccaugaaccauauguggccauuuaaguuuaaauguaacuuaauuaaaauaaaauagaauuaaaaauucagucucucaguugcaccagccacauuucaaguguuuagcaccaugugacucacugcuacuguauagggcagugcagauauagaacguuuccaucagugcacaaaggucugugaauggugcuggaauguagcagagagaggcuaguguuagggagagcaugaacagauauauuuaaucagcuuuuaaaaaauauaaaguucuauaaaggauacagagaguauuuaccaauuauauuguuaagauacuauuuucagaaguuaagaaauuaaaaaguucuuuguucauguuuuaacuuguuuuaauuacuaaggauuguacauaucuugguuaaaaaagguaacauagauuuuuuuuuuuuaaugaccagauuucaaaaaagauccuuauucaaguauauuuuuaaaaauuauaugccaaauuuucaucacagauuauacauuuuauuuuuuggacaauaauuuagcuuagaauaaauccucauauuuuuaaagugcuggucacauuugaauuuauauuucuuuucuuuuugaaauggggucucauucugucacccaggcuggagugcaguguugugaauuuggcucaccgcagccuccaccuccugggcucaagugaucuuaccaucccaaccuuuuguguagcugggacuauaggcacacaccaccacaccaggcuaauuuuugguauuuuugguagagacagggucccacuaugccacccaggcuggucuugaacuccugagcucaagccauuuguccaccuugaccucccaaaaugcugggauuacaugcaugagucacuaggccuggcccuguuauuucauuaauuauucacuuuauaaucuaaugacuauggauaaauuaaauuucuaggcaaccaaugugcagacaaaacauauaaggguauauuuuuuuguaugcaauucauuaauaauaggagcuauuuauaaugaagcuguuuuuuguaaaauauaaucuauuugagaaguuaggggauccagaauuguucuuuugaaaaauacuguuuuucugagcacaggaaauaggaaucaaucuguucuuauuuuauauuucagguaauaucucccagcuguaaugaugacaucacagugaaaaaggaucaguguuuaguucgaucauuuauugauucuaaauugugaguaaugaauccuuuaaugauguuacgugggaggaaaaaaaaaauagaauuacaaugauagacaccucccccaccaaaacuuuauuuuuaaaagucuaaucauucaugaacugagaaguuguuaccuaauagguuuugacuuuuuguaauguaggguauuuuucacuaauaaauuuuauauaaaaaaugugaacauuaugugagaacaauauuaagaacaguuuuuuuuuuagcaaaagaugguauugauuuuuuccuuaauuguaaaauucuauauuuuuaucauguacuaguaguaugugacauuuauuauuaacuccgaagcuuauuuuuuaaucucuauuacaagagcaauuauuuugacuuuuuucaugauuacaauccagacuuuugggccgggcgcaguugcugacgccuguaaucccagcacuuugggaggcugaggugggcagaucaugagcucaggagaucgagaccauucuggccaacauggugaaacccucucucuacuaaaauauaaaaaauuagccgggugugguggugcaugccuguaguccuagcuucucgggaggcugaggcaaaggaauugcuugaacccgggaggcagaggcugcagugagccgagaucgcgccacugcacuccagccugacgacagagugagacucugucucaaaaaaaaaaaaaauccagacuuacagaaacuuuuuccuaaccucaucucugcuuugugaucaaaacagugaaauuaaaaaaguuuuuugaguuauaguucucugugaaaaauuuaaugccauaauauauuuuauagugauaaaaauauuucaauauuacugucuaguaaaugugcuuuuuuacuaaaaugaaaaauaaauuucacaaauaauaaaauagacauuguugucuacaaguguugaaaacaucaugcugauaugaauuaccccguacuaucuguaggaggauuguauagauugaaauauugugaaugugaggcucucaauguacuuugaguauauacaacuucagaauuaagauaacuaacuuugcccguauuuccucuucuuaccuuuuguuaaggacuaagauaaaaacauuuuauagacaauauuuugauuuugagguuuuuauuuuucuauguguuaacaugaacuauuuaagugauaauuuuuauugaauaaauuguuuuccuccccuucuucuugauaauuaguuacucuauagcaagaaaggacauuaaggaaguagacauucucaaucuaccggaaucugagcucuccacuaaaccagguaaaauaaagaugaauuacccuauuauuuuauguuguggcucuauuuggaaaauagcaaauaaagcaagacugauacucucugguaccaccauuuuaacuguuuagaguugauauccacucuuacuugauuuuuuuuuaaugucuagauacaauauuugauuugugauuagauaaguuuaacuuuucguauuuuaccauugucucacaguauuccguaaaguaauaacaaauguuuauauaacauuauaacuuaugaaauauguuaaagcuuacuguaucauuuuauaaaugacagccgaauuugaauucagaucuuugauucugaaugccaugccuuuucuauuguucuaugcugccaauuccauagcaacugcugaaguacauuuucacucuuagggcuucagaaagcaagcaucuucuuaaaaacuagaguuguuccugauaauuggaaaauggauauaagugaaauccuugagucauccaguagugaugaugaagauggcccagcugaagaaaaugaugaagagaaggaaaaggaggccaaaaagacagaagaagaggugguagguguaauuucauguuuguaacaaaaacaucuuaauacucucuagugaaaauaauaccuucauauauuuuucccucuguuuagauucucuauuauuuguuucuguccguuucuagcauugcuuaauuuggguguugaggaagcauuuuggcucauagcauaguguguaaaucagaacuaauucuuaguaagagauuacaagaaaauacuuuucagguuaguuaaucaacaagugcaaacugguuuuuuuggggucuuuuccaaaacaacccaggagggaaaaaaauguaauuuuuagguauuuuauauguguaacucauuuaaacuacuaccauaugaaguaacuguuguuauccuacuuuaaagguaaggaaagggagauucagaaaaguuaaguaacuuucccaagcuggcacaacuaaaauggguagaagagggauuuguacucaggucuggccugucucaacuuuaaaaccucuuucagacauuucacaauauuucaaggauaauuaagguuaaaaaaaauccuauccaaaccccaaagaaaauuucauuuggcaauuugauaaaucauagaaaauauuuagauuauauguucuaagugcuaaugguuuucuuuauaauauugccaugucauuuauaauaugcauauaauuguaggaaaucauccauggaguacuucaugauugcuuauaugaauacuguuguuuauucugcaguguuguaucaaaugggauaaacugucuaguacauuuuugguuguuacgggguaaaaggguuuaggggcaagacaaagacaaugaauuuacugaaaagggggaccuauuugagcaugaaaaauauuggccuggaaaaaugugggauucuuguuucuguuuuaaauacacaaauaugaauuuaugaaaugaaacgaguauagucauauguaaugaagggcauacgcuauuucuuuccuuuuacuuccccugcaguauuugguuuuuuuacacucugaaaucagaauggcgguucauacuuacaggcugccuacagaguugccauaguaacgugcuguugguuuuaagugagcaugcucggaaagacaggaagguuuagcagaggcuuggcaguuugccaauggagguuugccagaugcuuugaaaugggcugucuuucuuuuccuuucauguaaugucugauuuuuauguggaagagaauguaaguagugcuguauaacccugcggaugcuaugcccuaagagggaaagcaaauauuugcaagucagacugaaaaauguccagacccuguacugauuaaguagaaggggaaucuaaccacuuugcauuugaaagaaaaugcagcauauagguaagauuuuuuuguguguuuaguuaccauuuugauugccaaaaacgggauuaaauaagaauuuuagguauugaugauguagcugauagggaaggacucagaaccaagcgauauucuuucuuguaaaaaagacaguaggagucuauuuuuagaauaucaauggaugaaggcuauuuuucugaaacaagauagauucugaaaugaaaaugauaaugagacaguuuggcaaaauucaggauuuaaagucagaauauuaaaugugauuuuuguauuuuaucuguauuuauuuauagauuauauguuuucaggcuaauuaggccacauuuucagggugugaacuguugcaaaucugugauuuagcuuuuguuuuuuaaauuaaccuuaggaucuuauauuguccaauauugaagaaagauuagucccuuuauuuuugcuaauacuuuuaauugcuguccguuccagaaugcauuuucccuacccccccccccccaaaaaacccugaaauuuuaaacaaagaggguaaaaagagcuuuguaggaaguggcagagggagauuauaaaauaguaaauuguaaguagugcucuuauuacaaugauuaauuucauaaauauuguaauguuuuauucaagcugugaguauacguuaguauaaaagaaugaagagcagaggcaaagcucuguuaccuauuguuugcagguaauaguaaauaaauuuuuaaagauaaggaagcuuacaaggauaguaucuuaaaaugugucaccuaaauuaugagccuguuaaaauuaagugaaucaggaugcuuuucaucuacuggaaaauaacagcaaaauuacagaauuuaggcacugauucauaugauuauuuauuuuucggauggucaauuucauagcauauguuuuauugaauuauuaaacuaauucuuuuucucuggccauacaggaagauuuucuugagugaaauuuuguugcuuuagaaaaaaaucagcugcauuucuugcucuuggguuuaagauuuaguugcugaaucauuguaacuucucuugaacaguuauuuuuuaaaaguguaauauacugauaaacugaaaagcacuuuauauacaacaaagaggaggggaaugacuaugauguaaaaugaauaaaaaucugauaagccauggccuaccuggcuuagucauuaugggccuuuaucaccauguaggugaggcuacgcuguuuuauuacauuacagaucagagucuucccaaaauguaacgaugcuaugcuuuucgugaagauucaauguugcauuacaauaaucaaaaagaucuuuuguaagguucucuaaaccacuauaacaauacucuagucuguuauuuguuguuuuuaguauagcaagcaaauuuuaugcaguagaaucauacaaguguuagauacuucugcaguguuaaugggcagugaacauuguuuuuauauuugaugcuuuggguaucuuaacuagccuuaauaaggagauuugagauucugugacuuuacaugaaagagcaccuuuuccacuuaauauuaauuugaauuccuaaguauugguaguucaggauuugaguacaagauauagaucucaugcuguuacugugugggaaaagauugaggaucugacagaaaguagguuuuaucuauauugauuacuuuaaacuugaacucaauaauuauauugaaaaaaucccugggggauauuuuuauggguauuacuuaaauguuuuuguuaagaaaauuuuguauuagaaaagauauuacuggauuuuucaccuuugaaauugaucaaaaaguccauguaaacauaaguaaucauaucaauuauucauuuauuccugauuuauauuuacuuuggauaaauauaggagaguuuucuaaggguaaaauaaauggaugguuguuuagaaaacuugaguauuaaggggaaugugaccaguguuagcuuuuaaaaucauuuuggcuuauaauaaguaggcuuauagguugggcccuuuuaaaaauuuccuauuuaguaaugaaaauuugaauucagugaauuuuuaaauaacuacugccauuucuguaauacugggaauuguuuagggaccacugauacauuaaugccuaagauuauauuccaguauuguaaaaaaucauaaguacuugaguuuguuuacucauggaaacaugaauauuauuuuugauguuuaaaucauauuauuugugcauauuuaugccuuguagauuguaaaggcauuuguugguggucauucaagauuacuuuagguauaaacuuacaguaaaugcuggauaacuuaggaaauccaugcuaaauugguggaauuuaaagaauauuuuaaauguaauguuaauauuuuaaguauaucuaauaacuuaaguugccaaugaagcauuucuaagcagauccuaaaaagccaaccuuccaugaauaauugggacuuuagcuugcaaucauauaugacaacugacuugcuaaaaucuuaaaguuuagcccauuaagcaaacaaaaaugcccuuauguauuuagcagagucuuucuucacaguguuaguguaagagucuaacccaguuagggucaucuaaucagauuaaugaggauuccacauuuguacacaaaaauauagcuacauacagcuauauuuuuauguauuaagaaaacacuuuuauaucaaugcauuuuauaguuguggucauaugauauaguugacuuguacuaaaaaucuuggauuugauagcauuuaaaugacaucuugaugauuaaaauguguaccuuuucaaauggggaaaaauuacuaggcucaguuaacugauaaaauacaagaaucauguaaucauuuauuuuaggcaggcuguuguuaaaacuguucucugaaauuauaagugccuuacuaugaauauaucaucucuuaugugagcccugaaauuuucuguagguguaaaacaggaaagaauaguaccacucuaaauuuuaugauuaccaaauuccacugggccuucagcacuauuggucaguucccaauuucuguaagcaaaucauuauuuccuccauuaaaccaauaauccuauacccacuccacacaacuucauaaagaaauugggagcuucagaugcgagcaugcuguaaaccuguuugccugcucucuuucgcucaaggcacaauugauaguguuuuguccucccuauaagaugagucucucagguuaugcuguggaucucauucccuuccucuuuucaggaaaagagagacuaucgacucucucuuuucuugcaucuuuaacuuacuccuuucaguuauauccuucucaucagcuuuuuaaaacaugcuuacaucucucccagccuucugacaaccccuccauauuuccuccaccagucuucagacaaccucugugcuuuccucuccagauaacuacauuccuucuucaucgucauggccagaaugcuuagaguuacauacacuguucaugaccuccccuuuacucuuaacucacuguagugugucuugauuucccacaacuaaaacaacuuuacuaaggucaccagugacuccaacaaacuuuuguacuaaaccaaacacauuuuugucuugauccuauuugacuguugaguaguauucaguaccucugacauaccuaacuucuuagaaugcuugauauccaugacgacaucacauuuuuggccuacuuccuaucuaaaaugauauaaugacuugauaucuauauguacaucaaagaugucucuucuuagcucaagacauuuauaucaaaccaaugaggauuuuaucuuuuuuuuuuuuuuuuuaagagacagaguuuugcucuuguuugccaggcuggagugcaauggcgugaucucggcucaccacaaccuccgccuccuggguucaagcaauucuccugccucagccucccaaguaacugagauuacaggcaugcaccuccaugccuggcuaauuuuguauuuuuaguagagacgggguuucuccauguuggucaggcuggucucaaacucccaaccucaggugauccgcgcaucucagccucccaaagugcugggauuacaggcaugagccaccgugcccggccaaggauuucaucuuaacuuguacguacucagacucaguaugugcaagacugcguucaucuucuuuuucccuaaaccuauccuuucccuggcuguccuuaauucauuuugauaaaagcaacauccacccagcuguccaagccagauacauagaagucaccuugauucuucuucucuuaacccccuguccaaucagauacccaguccauucucuucuaccugcucgaauagcucucaaauuugcccacuucguuugguuucuuuucuucuuucugccaaucuuacuccaagccacuguucucuuuaccuagccuaaugcaauaacaauaacaacuuaauuguucuuucaacauccaugcuugcccuccuccaaucuguucucuguacuggaucuacaguaguuguuuguuuuuuuuuuucuaacugaaaauauauaugugauuccuuuaggaauaaaauaauuuuagggaacaaaagagguugugguuuuuauucuuuuggauuaaaauauuucuaaagcauaucgcguaauacuaccuuuuucuaaaagcaguauaauguacauuauuuaauguaauauuuacucaagauuuaauuauugcauucuuauaauacacauacugucuuggcucuuaguccuuacacuaaaugacauaugucuguaaagauugugaauuuuucuccaaguuuucuuucuucuaagcuauauauugucaauugucaguuuuuacauaugauaacuuucuggacaguucuucagaauuccacuugggauggggcuuauugauaaccuauguagucauuuugaccuauggcucaccugaguugccagacuuacuauuuguuuuguuugcuuuucacuuuaaguuaaacgugaaguuuaacugaaguuuaaaauuuuaagcuuucuuuuuaaauuugucuuuauuugcuguuucccuaagguguugugacaaaauauaucuguuguacgagaacauacaucaagauguaccuuucauuauaccacuauuaaaacguuuaccuuuuguaggagauacaaacaaguaaagauaaccacgccaaauaauguucuuaguuuauucauggagacuuggugguuuuuaaaguaagacuguuuguuuaguccuuacaacagucuaugaaaauauguauauaaauaaauauauacauaugaaaucgccucagagugcauugccugagaaaagagagauuaugaagggagguuagauaccuuaucccauaguuucucccaaaguggacuuucuuuuucuuuuuucuuuucuuuuuuuuuuguuuuugagacagucucacuccgucacucagacuggagugcuguggcgcgauuuccacucacugcaaccuccgccucccgaguucaagugauuuucaugcuucagccuucccaguagcuggaauuacaggcaugugccaccaugcccagcuaauuuuugugcuuuuaguagggacgagguuucaccauguuggccaggcuggucucgaacuccuggccucaagugaucugcccaccuuugccucccaaagugcugggauuauaggcaugagccacugcgcccagccccaaagugaacuuucuagaaccuuacaacaaaucuccuagaaccuucucuuuauuuauauauauauauauauauauaauuaaaaccgagguuuagagagguuucagaauuuuuuacaagcuuuuaagaaaauguucucuccuccucuagacuguaagaucugugaaagcaggggaucucaggauuuuuguuuuuuccuuuuccuaccaguauauauaccuaacagcuaucaacacagagcuugcuuggcucauauuaaaccuucauuaaaugaaugaauguggauuaugcaauuguuguaguaaauuacucuuugaaacaagguggugggagauuuguuauaagguucuagaaaguucaccuuggcagggggaacuaagggauaagauaucuaacuucccuuuauaauaucucuuuucucaggcuguguacucuguaggcaaucucaauuucuuacauaauuuugugaguuuauaaaauaaauuauuuuuugcuuaagccaucuugggauaguuuucugucacuuguaguaaaaguuauugaguaacaaugcuccuugcuuguauuuuguuccacuuacuccagguaucuuccuugugguguuuucccuucgaauucauuauccauaaacaucuuuauaaaacauaggcgguuccugaugguaacccuuuauuggcuuucagcaccuucaggacgaagucuggguuuuuuaucacaggccuuuagaagucugccugaucaugaugugacccaugcccaccucuuuauucucccuuccauuauucuuccaugauaugggacuucuuauagcuccccugcugccacuuagauauuguucagaaggugcuguugagcuguaagauacauuacauugaauauugccuuuguguugcccauucccuuuguuaguauuaaauauaauaggaaagauaaaacgcaaguuuuaaaaacucagaaaaugaguaaaugauaaacaacagcugagauuuuaaaaauucaacagaugucuguaggaacaaagagggcucuacuugaauuaaagugggugaguacagcuuacaaauguucuaugcauuuaccuuaguuuuaguauuucacauuuuuaaaaaaucacacuauuuaauauauuauaaauuuaaaauuuuauacaaaaaauguaagcagcuauuggauucgcugcuuccuucccgugaguccuccaguccagacauguccucagagcugccacuucugauguacuccuugcagugcuuagcuccccacaguggagcuuggagggugcugucuuaacaucucuccuuccaugauagggaucugcccauuucaggggauucuuccugcugccuucaaacugagccucauuuuuggaggugguagggaugaaggagaggggauggagggguuguaagagcugaggagugugaggacuugugauggaguuucagaguuggggugagaaggguagcccaugaagagggccagaagagggacuauagacagcaucauaaagaaauuuaaauuucuuuauauuugguaaaaguauuuaguguuauaaaucauuaugaaugaauguacuaaaagaaagaauauaauaaaagaucuuacuuuuauuuaucaugaaggggaaacaaaguugcuuguguccaaaguaacauuauugcacaaaaaaaaguccuuugguauugaaaaaaaugagugguauacuggaguacaccgccccaccccccacccccaauacacacaaaagguagggguguuauauaauuauuaaaacuuuuuuuuuuuuuuuuuuuggagacacagucuuacucugccucucaggcuggagugcaguggugauuauagcucacugcagccucaacuuuccaggcucaagccauccucccaccuuagccuccugaguagcugggacuaggauuauaggcaugcaccaccaugcccggcuaauuuauuauuauuuuuuuuuuauagagacaaaguuucgcuauguugcccagucuggucuaaaaccccugggcucaagugauccuccugccuggcccucccaaagugcuaggauuacaggcaggagccacugagccugaccaaaaauuuuaagggauucccauagagguucuugaaaccugagaauacccaucaacaauauguucuguuacauacaauacacaguauagggaaaccacaaagaucaaguuuaguuauaccuuuccucacuuuaaaaaugucaauuuuuguggcuccgauauguuauacgcuaggaaacuaucccaagccaccaauuagaacuguguacaaguuacaugggucugaggagcuuuggguaaaguucaucaucuuuuacugacauauuuugacaauuuggacacuaucuguccaccuuccuaauguguauuggaaacuagaguugcuagcuaagaaaguuaauagcuccuacaaaaauaagauaucuuauuuuucaaauuguauuugucucuguauuacucuguucucacguugucauaaagaacuuuguuagauuggguauuuuauaaagagguuuaauugacucacaguuccacaggcuguacaggaggcauggcuggggaggccucaggaaacuuauaaucaggacaaaaggugaaggggaagcaagcauaucuucacguggcaacaggagagagagagagagagagagagagagagagcaugagcacgcaaagggggaagugcuauacacuuucaagcaaccagaucucaugagaccucacuaccaugagaacagcaagggugaaaucugccccaugauccaaucaccucccaccaggucccuccccgaguauuggggauuacaauucaacaugagauuuggauggggacacagagccaaaccauaucaguuucccaucccacuaaaaugguaggaagucuguuuacuagaauuuuugccauuuccaaaugaauaaucguucauuuucagauuuauauauuuggacaagggauaaggugaaugccagcaagucaugggccauaaccaccugugucuuuuuuuuucuacuucuucuucuucuuuuuugggacagagucucacucguuuugcccaggcuggagugcaguggcgcagucucagcugggauuacaggugcacgccagcaugcccagcuaauuuuguuuuugguuuuuugguuuuuugguuuuuuugagacagagucuugcucuguugcccaggcuggagugcaguggcacaaucuuggcucacuacaaccuccgccuccuggguucaggugauucuccugucucagccuccugaguagcugggauuacaggcgcacaacgccacgcccagcuaauuuuuugcauuuuaguagagaugggguuuuaccguguugcccaggcuggucuugaacuucugagcucaggcaauccgcccaucucggccucccaaagugcugggauuacaggcaugagccacugugcccggccuaauuuuguauuuuuaguagagacgggacuucaccauguuggccaggcuggucucgaacuccugaccucagguaauccaccugucuuggccccccaaagugcugggauuacaggcgugagccaccgugcccggccccaccugugucuuaagaacauccucaacuauucuuauuuccucucuuucucugacucuugcauuuauauuaucauaaaucuuagcucucauacucaaugaaugugaagcaagaaaacucuacacaauucauuugcacagauaucauuuucauucacaugaguaaugucuaaacuaaauggcagucauuagucguaaaauugugaguaagucaggcacagugguucucuuuucuucccucuccccuucucucucccucuccccaucccuccaucagucucucugucuuucucucugucucucucucuuccucuuccuuucaugggaagaggugaucuuuccaucccagcuggcaggacuaauucaggcaugcguucucuuccuuguggacuguuauaauggcuuccuuuucccuuccaauccaucaaacucauucuuggcugagaaauuuuaaauauacaaaucugaucuaauucucuuuagcugucucaagcuucacaucuagccacaguaucaaguuuuguuucuuuagcauacuauuacaaaguccuuuccuaaucccagccugccuuugucaguuucaugcuuacgcuguuugcccauuugcuguagcuccagggcugucuacuauuuacauuuugaagcugccuaauacuaccacugccaguucaucucgaggaaaaccauucauucccucacuugcuccuccuguauucuuugauguauuuuacaacacuuaccacaucguguuauauuggcuucuuuuaccuuucuacaccuccugccaaacucagagcagcaaaaauagaagguaccauguguucucauuuuaauccacagugcuuuugaacaaucucugauucaugguaaccauuaguagauguuugagcuuaaucugaagacaugugccuaaagucaaaaaauucacaaucuaguaguguagauagauauccaacuacuuauaauacuaagcaguauauacuaauacuaacuaaaauuggaaauuucuugaaauuaucaucaugaaugugacucuuggaucucuggcauuuuacugggugcauaguuauucuuuacauguauaaauguaaaugacuaaaugaagggaagaagucucagauggucuaguggaccucuaccucccauucuuauaacccucucgcacuccaaaacccuugaaagaugcaacagugccaggccuucaccagcagagaaauugcuaugaaaaugccauggacagagaaagcaaaccgugauagcaauuaagagccccauacaaaagucacgaaggcacauucuucuaauuggaggcguucucuagcauaugcaguuuuacugcaaggugacuagcagcaaggcuaguuuucaaaaauaauuuugaggaguggcuuauuguaagagauaagcaauuuuaauuuucacagaaacaucagauaaguuuaaaacuuuguuuauagcaucauguuuuauuuauuuuugguggaaaagaaauuuccccucaaggcauuuguuuguaaguagaauucuuuauucauuuauaucuuguuuaacuguaccaaaacuacaauuuuacagccauaguuucucgugaaaccuaaagcacucuugguuacccacuaacuuuuaaaaaaaauacacauaaaucaaauuuuaucuauaaaaauauauucuuaacauuaaaaauuuaucaaauguuggguacaaccuaauuugcaauugaugaguugauuuuguuuacuuguauuggggagcaacuuugauuuuagugccuuuuuaaagaauugcuuuuacauauauugaauauagaaguguuaccugaauucuguaggaucauaaauacuggaaugaggccugguauaguggcucacaccuguaaucccaacacuuugggaggccaagguggguggaucaccugaggucaggaguucgagaccagccuagccaauguggcgaaacccagucucuacuaaaaauacaaaaauuagccaggugugguggugcaugccuguaaucccagcuacucaggagccugaggaaggagaaucgcuugaacucgggaggcagaggguugcacugagcugagauugugccauugcacuccauccugggugacaggaagacucugucuuuaaaaaaaaaaaaauacuggaaugaaguuuucgucugaagagagaauauuacgauuacagggcacaggcaaagcauagagccagucuggcauaagugguuuuugguuuugauuuuuuuuccucacgcuagaaguucuuaaaauuaaugugugaagugguucuugggcuacugaauuaccuauuuucuugaguuaacucauuggcaguuaacuuuauaaaagcaagauuuuuaaauucacauggggaaaaaacugccaucucuuaaucugagcauuaaguaaugaccuucacuaacuacuuuauagugauuauuaacuuuguaaauugcugauuuugguuagaacuuauauuuaaauuucuuuauauuugguaaaaguauuuuaguguuauaaaucauuaugaaugaauguacuaaaauaauguaauaaaagaucuuacucccuuucucuugauugccucaugguuuuuuauuauauauuuugaucaacuacaugcuuauugauccuggcuguauuaucagcuauuagauaacacaauuuuaaagugccuguugcccucuggacaccgaagacucaacauuuauugcuugagcauugccuuuguuuugaauauggcuuuguaaagacaaaaauccaggcugggugcuguggcuuaugccuguaaucccagcacuuugggaggcuggagugggcggaucacuugaggucaggaguuugagacuagccuggccaaauggugagacccccuucucuauuaaaaauacaaaaaauuagccagguguaguggcacacuccuguagucccagcuacucaggaggcugagucagcagaauugcuugaacccaggaggcagaggcugcagugagccgaggucgugccauuacacuccagccuaggcagcaagagcaaaacuccaucucaaaaaaaaaaaagacaaaaaucugagcucuucuuuuagaacagaggagaguaauacucuaaguuaugaucauuuauauggaggaaacauaucaguguuuuguuuuucucuaguagugcuaaacuuuaagaauuuuaaaagaagcuaaaucaguaauuauguaucuaguuuccuucccuaagaauuacuucuggaauuauuuuguuaucuuauuuuuagguguugcaaagucaaguacaggggccauacuagaaaggcaaaagagaaaaccagguuauugugagaugagggggugaugaggucugggguaaaauagaauguauaugacucacuuaaauguauuuaaauaucuuuaaaacauugugccaucuaaacagaaauccuuugccacugugacuuugcaaucccugguuuauauucaucuggcaauaacaaaaacuauguuuauaugaaaauuauuuuuauauauaaauauaugauauaaugaacaugugucauuauugugcucaucugccaguauauuugugugggccacauaguauuuaaaugggcuuuaaaaaaaauauaucaggugaggugaaaacguaacacucccauuuuauuccugaauguuuuccucuuggcuaaucuuaguccuuacagugauacugaaaaguagaguuagagugguaaauggagugaaggguagacauuguauaucuucauaaauaugacuuaaaaucugucauuguaggauauugagaaaauucagauuuuucagcuuuauuaaaauuugaugacuuuacauuggguucacaaaaauaaaagaagacauguaucuuuuccaguucacugugccauacauuuauauauuuuaucuuuacagccugaggaagaacuugauccugaagagagggacaacuuccuccagcagcuuuauaaguuuauggaagacagagguauuuucaugcucauuauuuuaaaguagucauuucuuuuucauguuuacauucuagguauaugcauuguuuuuguuaguauugcagauaaacaguuuuggauuuuauuuauuuauuuauuuugaggcagguucuugcuuugaugcccaggcuggagugcagugauuugcuccuggcuuacugcagccuugaccuccugggcucaagugauccuccugccucagccucucgaguagcugggacuacaggcacgugccaccauacccagcuaauuuuuuauuuuucuauuuuuuguagagacggguuuugccauauugccgaggcuggucucaaacuccuggccucaagugauccucuuaccucugccucccaaagugcugagauuacagcugugaaccaucaugacugucuaguuuuggauuuuaaauaaauccuagaaucaguuacaccugacaguaguaaaauauuuggaauuaaacuguucauaccuauuuuacauagaaacaagugagaaaauauuuugauacaauuuaguuuucccugucacuuacaaagcuaaagaauauucugauauuucagaaauagaaagugaccaguuauguuaaucugcauacccacuaauuacuaaugcuauauuuguggcaaauaaacuagauaaacuagccugauccuuguucucagcaaauuaaacauaauaggagaccaaucguuaucugaaaaagaugagauuucuaauauagguagaauaauagaacaauuauaaaccaucauacuccuugccauuuguuaguccuagaaaaucuuaagauaaauugguccuaaacauucuguguggccuucagaaaucauccuucagauuacugcuaacagucuuaacauuugugucaaaguagugaaaguggaaccaggguauaaaucuuaucuuuucuguuguguuuguuuaugccuaaacuuuuuuuuuuuuuuuuuuuuuuuuuuuuugugacagagucuuacucugucacucaagcuggagugcgguggcgugaacauggcucccuccagccuccacuuccugggcuuaagcaguccucccaccucaggcucccaaguaccugggaccacaggugcacaccaccacacucagcuaauguuuuccuuuuaauuuuuguagagacaggauaucaccauguugcccaggcuggucucaaacuccugagcccaagugaucuuccugccuuagccucccaaagugcugggguuacaggugugagccacugcacccagcccuaugcccaagcgucuugaaccagcaacauuguuggccacaccaugcaguguuuacuuuaguuuuacucaauucauuggcaguuaaagagguagcuuuauuaguauaacaccuaaaaucugaagauccccacaaagcuauauaaauaagagagaauuauuauauauauuauuauauauaaaacauauaaaaaagaauuauuauauauaaaacaacacaagagaauuaucuuguguuguuuuacauuguuuaaggcucuuuaaauaugugccucuaauuaaugaaauuggggaaauuagaaauugaccgcuuuguuuucaaauuaguauuucucauuugaauaaacauuuuauuucuaccuacuuacauugaaaagguacuccaaucaacaaaccaccuguuuugggcuauaaagaucucaaucucuucaaacucuucagacugguuuaucaucaggguggaugugacaauguaaguauaacauugcuuuuugaaacauguauugaugugguaaaaaguuaaguuaucuuauauugcauuauuauaugcacauuggauaauaaauacauuuucuuaaugaacauagaauauuaggauaaagaucuuuuccuggccaggcacgguggcucacgccuguaaucccagcauuuugggagauugaggcggguggauugcuuaagcucaggaauucaagacuagccugggcaacauggcgaaaccccaucucuacagaaaauacaaaaauuagccaggcauggugucgcaugccuguggucccaacuacucgggaagcugaggugggaggaucacuugagcccaggaggucgaggcugcagugagcccugauugcaccacugcucuccagccugggcgacagagugagacccugucucaaaaaaaaaaaaaaaaaaaaaaaaaaaaaaaaaaaaaaaaaaaaaagauuaauucccuuugcaaauguuaacauaaaaacuuaauuuuccagauugauaguggugcuguauggaagcaaauuuauauggaccuuggcauuccuauuuugaauucagcugcuuccuacaauguaaaaacugcuuauagaaaguaaguaguauaguuuauucaucaaagaauauauauuuauaggaaauauuuuccauuuacuuuguuaacaagaauacaucaaucuagaaacauuaaaguuagagaaaguauauaaaaagguuuagguugacagauacuugugauugaaaguuauuucagcgcaucuaaucugcuuuacuccauuucuuauguuguccugauuuccuuuccaaaaucaggaugcagguagugucugcgauuaugauacauauuacagagcuacaucuuuuggggugaacagccuucauaucaaaacuuaugauaguuauguuuagcuaucacaagcucagacgucucaggacggcauuuuaugaucaguuuuucuguuuaugauucuaucuaaaacaccaagaaaauaguaacacagaaaagaguaacaaaaauuuuuuuaaauuacugggcuuuacuuuuuaaaaauguguuuaauaacaugaauucaaguuagaugcaaagacuguaagauuucuuaaaugaaauauuguuuguuuagguaucucuaugguuuugaggaguacugccguucggcaaauauucaguucagaacuguucaucaccaugaaccaaaaguaaaagaggaaaaaaaagacuuagaagaaucaauggaagaggcucucaaauuagaucaagaaaugccuuuaacagaagugaagagugaaccugaggaaaauaucgauucaaacagugaaagugaaagagaagagauagaauuaaaaucuccgagggugaguucuuaauacuaguuuuaucugguuuaaguauuauuuaaaauuuuuuauuauagccauuuucauauauacacaaaaguacuacagugaaccuaguuuauuuuccaguauuuaaugcugcuuagcuagcuacuuuuuucgaaauauauuguauauuauuuccucuaccugaaaacccuuccuucuguuuucuguuuauauucgaucaagucauucuugucugggaugaaucccagauauuccuuuuccagucuucugcuaaaguaucaccucauugaaggcugucuuggucaccuuaucugaaauuguaaccugccuccucucuuuggaacucucagucccucugauguuguucuuucuguaauuuacuuauuuauucuguuuauugugauuaucuauuuugccccacucuacacuagaaucacacuccacgaggucagggauuaguguuuauuucguuuauugacagaugccacgcauuuagaauagugccuggcacauaauaaaggcuuauuaaauagauguugaauaaaugaaucaccucuuuauagugccugugcccuaaacuagaugauaucuugucuuuguaacuuuauagcacacuguguagcucuagugaugcguacauguaugcugguuguaucuuccaacuuugcuccuucuuuccuuuaauauauaaggucuauuuaggaauugucaucuagcauuuggaucaguguccagugauguuacauaguaggauuuaucaaauuuuagaaagagaaaggaauuuaccacacuaucaaagaaguuuaauuacuaugucuuauuuuuugguggaaucauauuuaaugaaagagaaugugaaauugcuuugucuuauaguucagaaaccaguuuucaaaacuuccuucauguaguaaauggaaucuucuagugaaugucaugaaauuuccaaauuguuuuuuuuuaauuuuuuuuaaaauugugguaaguacauauaacauaaaauuugccaccuuaacucuuuuuaaguguacacuucauuggcauuaaguacauucucaccguugcauaagugucaccaccguccaguuccagaauauuuuuaccuugcaaaccugaaauucuguacccauuaaacaguaacuccucauuccuccccaacccuuagcaaucaaaguuuuacuuucuguaccuaugaauuugauauucuagguacuuuuauauaagugaaaucauacaguguuuguccuuuuuuacuggcuuauucacucaccauaaugucuguaagacauuauguuguagcacauaucagaauuuccuuccuuuuuaaaggugaauaauauuuuauuguauguauuguggacauacuuucuuuucauuaccuaaaaaccuuccucauccuacauaaaauaucugcagugugcugucuaguauggaugaaccauaaaucuaccuucuccaagauuuucucccaguuuuuuacuauuuuaaaaagugcugccgggcgcgguggcucaugccuguaaucccagcacuuugggaggccaaggcagguggaucucgagaucaggagaucgagaccagccucgccaauauggugaaaccccaucucuacuaaaaauacaaaaaaaaaaaaaagugcuauaauacauuugcuuguaaaaauauccucaucacuuauccacauauauaagccaggcuucuaaaaauggcauuucucaccuguagucccagcuacucaggacgcugaggcaggagaagugcuugaacccaggaggcagagguugcagcaagcugagaucgcaccacugcacucuagccuggucgauagagcgagacuccaucucaaaaaaaugaauaaauaaauaaaaacaguauuucugggacaaagguauacagacccaaauuuuauagcaguuguuuucauucauuuaccuauagauauuuuaaaagcaccugcuaggccgggcacgguggcucacgccuguaaucucagcacuuugguaggccgaggcgggcggaucacgaggucaagagaucaagaccauccuggccaacguggugaaacccugucucuacuaaaaauacaaaaauuagcugggcaugguggugcgcgccuguagucccagcuacucaggaggcugagaaucgcuugaaccugggagguagagguugcagugagcugagaucacaccacugcucuccagccuggcaacagagcgagacucugucuuaaaaaaaaaaaaaaaaaaaaaaaaagcaccugccaccugcuaugugccagccacuguguagaucugaggagauggaagugccaucuuggaacuuguguguuagugcuuuaagauagaaagaaauuaauuucuucuuuuucugccuuugaaguguaaauagcacauagccagcaacuagggaaaacauuuguuuacugagauauuaauuguauccuaaugcuuccuaaguugcuggcucuuuaucugcuuuauuccaagaagaggagacuucugccaguguauagaaguugacuugaaggagaaccuaggagauagugaaauugcucaccagucauggucauuucagcauucagugggcuagauagaagcuaguggugguaaaacauauugcuguuggcccagcgagcucuccagauacucauucaaagaagucugcucacuuuuuugccauugaugcaauucaguccuuuaaaaauguaaucauccacaaauacagugacaauguaaauuuugucuuacuaacgguagaauuagagaccacagagccuuuaaagaagcaaaauucaggggauugguuuuauuauuguuacguuuuaucauuaacauuagauaauuuauuuuaaauuuuuauuauagucgagaaauaauaaaagugagauaaaaugauguaguaaacaaaggagaaaauuuuuauuucuuuuuuguuguuguuguuuacuuuuuucauucaaacagauucugacagauauuucuuagguaguauauagccaaaguagaccuggacauaauuaaguaauucuaucaguuauucuuuuacuuucaaaaggaagagaaagguaccuuugaguugguuuucagggccacguuucaagccagagacauugcuaugaagguuaaaggaaaagauauuuuuuccugcuuuuuuccccuuuauagugauagcuauuuuaaagcuuuuauccccucuacuagggacgaaggagaauugcucgagauguaaauucuauuaaaaaggaaauugaagaagagaaaacagaagacaaauuaaaagauaaugauacagaaaauaaggauguagaugaugacuaugaaacugcagagaaaaaagaaaaugagcuacuacuggggagaaaaaauacaccaaagcaaaaagagaagaaaauuaaaaaacaggaggauucugacaaagacucagaugaagaggaagagaaaagccaagagagguacauuaucuuauguuuguucuccagaagcaccugucugggguacaacagcgcuuuguuccugcuuagagauucagguuugagggaauguuuucuuauugggacuuccguuccucuugucuaaugaaggugagacacauugugaagaugauguguauugccuuucggaauuggagaauauacuggucgcaccauuuuaauagcacuugugcccuaaacaguggccucaaagaaggcugcgccacccagucaaaagaaagguccugcaguugacagcagggaagggagcuggagaaaaauggaggaaguggacaagaggaaacagcgacagcaaaaauuccauuuuaaaaaagguacaaugugggaaagcuaacaaacacaugggugcacaguacuagagauguuucuguguguuagcuuuaagacauuuuucuuuuucaaguuauuguauuagauuauguggcaugcaccccugauucuaguuuggaaaauacauucuugccccacaucacaccaauaaauuucagauuuuuuaauguccauccuguuugcuguugaguaaaacuguauuuuuuuucuguguauuagacaaguauggacugaacugacuuaaaaauagucaaauauuaggcaguccagcaagaucaagguagucucugaccaaguuauuagcugcuucuguaaguguugucaaauggauuuacuaauuuuaggacacgacuaaaaaugaauuuuaaaugagcaacaacauaacauacuuacuuguaauaccagcucucuuccauaguuauuuuucuauuauuaugugauauuaaauuuucuagaaauuugaguuguuaagccaaauuugggaaaacugaccugccauugagagaauaaauauuuggaaaaauaggaugauuggugaaugggagagguaauuugauuaaauacaaauaggcacaggagcuaucacaauuacauaugaccuagguuagugaguaaaaaaaaguucuguaaugaaauauaauuaggauuaggaaaaguaggaggaacuaauuggaguugaguauagugaguauagaauuuuaaauauuuggacaaaaaauuuaagcaaaggugaaaaacaucaaaauauguauauuguaauauguauauaaaacauauaauacaucuauguaaaaugugauuuaaaaagacuguaacucuuuuguaaauggacaaagauuuauuuuagagaaaauuucacagacuugaauguaagaacaauauuaucuuuaaguaguuuuucucauagaguuuugaauuuaccuuaucacucuauuauuggaaggugccuuccaagagaaaacauucucacuacaaaugggcugucaaagcuucaugucaggacccccagggaucaccaaaauaaugcccuauauuuauuacagagcccaguaguacuuguugagcuuuuaaugcuugugacacuagaaugaucuuugaugcaguucuccuauaagucuuuacaggauugauacacaauauuuuauuauaaaaauauuaaaaguauuuuuagcucucccuguguuaaucuuccuuauaccugauuaucaauacaaagaaaagccgauggaagaugaguaaacaaauagaauucaacacaaauguaaagcuuuguucuuguggugguauccuacagugucaacaaaugaccuaauacucaaauuucuuuucuuuguuagggcugggaaaccuuuaaaauauaaauuaguuuaaaagacaugguuacuaagguagauagcccuuguucauuauuuugcccaccaaaaaaacuagucuugccaagaacuauucuaauucugguaguaaagcagauuuaagauaauucaguuacaggaaguuacaaaauauccuuaaaucuuuuuuuacauacaagguggcacuuaaauaugaauucugaagaauuuuuucagagcauauuuuucuuauuuuguuuugucaaaagugauugauuacagaucaucguuagcuggcacuuaaauaugaauucuaaagaauuuuuucagagcauauuuuucuuauuuuguuuugucagaagugacuuauuuuauuacagaucaucguuaacugugacuugauuggcuuuuaaaaaguauggauuuacuuuggguacagugcaccuuuacauaauaaauuccuuaguaaguaggccacagaaaucuucuccuucuccuccuucuucuccuccuccacugauauguuauuaagguaauacuuagguugugaauaaucuaccuguuggauucuuuuagcauauuuuauucuccauuaaguuauuaguagcauuaucaguauuauaacuuacugcagggaagaaacugaaagcaaaugugacucugaaggagaggaagaugaggaagacauggaacccugccuaacaggaaccaaagugaaaguaaaauauggacgagggaagacucagaaaauuuaugaagccaguauuaaaagcacugaaauugaugacggagaaguuuuauauuugguacauuacuauggauggaaugucagguaagcaagaaacuauuuucuuacuauugaaauuuuuucgaugauuaaauagaacaucaacuuaauguuaugaagagugaaagcaaauaaugguacauauuuacaaagcacaccuugguucugaauuuuccaagacuuugacauuccugcuguuauacuagcagugucaaugcuucuagccagagacuaccaggaucacaccuguaguuagaacaaguuacauuuauuacucauuuauagugagggagaacacacagcaaggggaaccauagggcaucuuaguaauaugguguuaaaugaaucaacagaggcucaaggcaccaucuuugggaaaacaauaauucauaauucuguggagacauauuacugacuaugagcagggagccaggccugcaacuuccaaccgugcaaguguuuguuucauuaaucagaaaucaagccuaugucaagcacuguaauaauucuaagucgacuaauuaauaaaaaagaacguuagaacuuacauuugaucuuccguuagaugauuuuggggaggguuuaagaaaggcagggcaugggggcucuugcauguaaucccagcacuuugggagguggaggcggaaggacugcuugaggccaggaguucaagaccagaccuggcaacauaguuagacccccaucucuacaaaaaauuaaaaauuagccuggcaugguggcacgcaccuguagucccaguuacccagaaggcugaggugggaggaucacuggagcccaggaguuggaggcugagaugagcuaugaucauaccacuguacuccagccuggaugauagagcgaaacccugucucauaaauaaaaaaaaaaaaaaagaaaaaagagauuuugcuccauauuggauccugucaggaaguugggguaauuauaguugguuuucguaauaaaucuuaucuagaaggagagacaguuagaccaagguaacauuauaauugguagagaaacagcaaucacccacauuagucaagaaaaagaagauguuugucguuuuuguggauuagacaauguuccuguuuuuucuguguucagacacgauuaggacauggucuuguuucuguuuugauacaucauggucacagaauggacuugucugauguugaugcucuuugaaauuguucauguuucaacagcaggacaguguggccuagcuaugagugccagacuagcucuaagcaacaccaaggcccagcugauagugccaggcaaguuccuaaaugucaggggcugccuuucuuguucucuuuuacaaaaucuggcauauuuaauaucucugguugcccuguauuuauuuggagccagacugcuccuggguuucucuauacacuagaugugugcucuguuauaacucaagucccucaucucuacacugggaaaaauacaguuccuauuuuguagagguguuguauaaugcaguaguucccucucaucugcuggaaauguguuccaggacccccaguggaugccugaaaccucacauaguacugaaucuuauauauccuaugauuuuuccuauacauacauaccuacaauaaaguuuaauguauaaauuaagcacaguaagagauuaacaacaauaauaaaauagagcaauuauaacuguauuguaauaaaaguuauaugaauguggucuuucucucaaaauaucuuaauauuuuuggaccauggguaauugaacuaugcuguggcuaagcagggacuacuguagugauaauauuuguauucagauguaaaugcuuagaaccaugccuggcacuuagugcuccaugaauguuaacuguuuucuuuucuuuacaauguguuauugaauucaggggaaaaggaauauaucauaccaacuuucagucauuacauuuccaguugcaucacaugauagccuucuuucuuccucagauucuuuaguucacaacuauccacuccuauuucacaucuguauaugucuguguucugcuuucuagaauuuccccuaucuuucuuucucauuuuuuuaauguuuuacuuuaugacucuucucagcagucauuuuauuauacgcucagguuuuggauuagucaucucucuaauuaauuaccuaacuaguacucuccugguucaugguuuuucguuguucuucucuacuccuaaaagcugguauaauucuggccuguucaguugagaugaagccaccaugguuccuaacgaauuuagccagacuccugaaagggaguaucugcaaguguaagaagugugagaagaguccuggucucucauugagaaauccugggacuauccuuuguuagcaauauuagugcuagaaguaccuacaugauauauugcuuuguccagugucgccaggaccaaguacacuaaaaaucaggccugugcuucuugguugucugauaccuccuauggaauuggauagaguuaucccuuuguuagcccuggaucagguacauauugcacuuaccagacuauacuugauuuuacuauaugucuaucuuuuauaacagauuauggguugcaugagagcauuggccauguuuauucucuacauacuuccugauacagugcauacuaguaggcccucaguaaauguucaaaugaauaaacauuuccauauaaguuaauaaaguacagauguuuaaaagccuaauaugaugcucauagccagucucguuuuagaaacuagauacuggguuaaugagugagagauaguuuucaaaucauaguacaggcaguuccuaacuuauagugguucaacuucaauuuuuuuuuuaaauuuaaaaugguucaaaagcuauaugcauucagaagccauggaauuuugaauuuugauuuuuuuuuuuuuuuuuuuuuaagacggagucuugcucugucgccaggcuggagugcaguggugcgaucugggcucacugcaaccuccgccuccuggguucaagcgauucuccugccucagccucccaaguagcugggacuacagacgcacgccaccaugcccagcuaauuuuuguauuuuuaguagagacaggguuucaccauguuggccaggauggucucgauuucuugaccuugugaucgcccgccucggccucccaaaguguugggauuacaggcgugagccacugcgcccggccuaaauuuggauuuuuuuuccuggucuagcgauaugcaguaugauacucucucaucagacugugcagccacaacaaacagcuaagaaaucaugagacuaaucaaccaguacuguacaguguauucaauaaauuacaugagauauuuaagacuuuauuauagaauagacuuuguguuaguugauuuugcucaacucuaggcuaauaugaguguucugagcauguuuaagguaggcuaagcuaagcugugauguucaguaggcuagauguauuaaaugcauuuuucgacaggauauuuucaauuugugaugaguuuaucaggacauaauggcaucauaaguaaaggagcaucuguauagguagucaugguaccaugucaacugaaauacaugcauaaaggaaccauguccuuacuuuguacaucuccaugguaacuggcuuauaaagcaagaauaugguuuccagauacaugaguuucuauuaauacgcuacagucuaaaacaaguuuguccaaccuguggcccacaagccauaugcagcccagcauggccuggaauguggcccaacacaaauucauaaacuuucuuaaaacaugaguuuuuuuuauuuuuuugcaugguuuuuuuuuuuuuuuuuagcucaucagcuaucguuaguguuauuuuauguguggcccaagacaauucuucuuccauuguggcccagagaagccaaaagauuggacauuccuggucuaaagcaaggacugccuguuguuucuuuacuuaacuguacauuuuuuagauuuugacuuaauucuguaaauacuuguauauuuagauaauguaaaaacuguuauuuaguucuagaaaccuuaauuucuuauuugccccugauuagucacuuggacuauagacaaucaaaagugauaguaaucauuugagaaggccaggugcaauggcucaugccuguaauccuagcacuuugggaggcugaggugggcagaucacuugagcuccggaauucaagaccagccugggcaacauggcaaaacccgucucuauaaaaaauacaaaaauuagcuuggugcaaugguguacauccguggucucagcuacucaggaggcugaggugggaggaucaucugagcccaggagaucaugccucugcacuccauccugggcaacagagugagacccucucuaaaaaaauugccggguccaguggcucaccccuauaaucccagcacuuugggagacugaggugagcaggucaccugaggucaggaguucgagaccagcauggccaacauggcgaaaccccgucucuacgaaaaauaaaaaauuagcggggugugguggcaggcaccuguaaucccagauauugggaggcugaggcaugagaaucacuugaacccaggaggcagagguuccauugagccgagauggcaccacugcaugucagccugggugacaacauugaaacuagccccccaaaaauaaaaauaaaauuuaaaauaaauuuuaaaauaaauuuuuaaguaaauguuuaggggaaaugaguuuucaacuuaagcuaaacagaauaaacuuagauaaaguaggugaaauacagauaucucuaaaaaauuucagaauccuaaaggcaauguaguucagaagauuuuauuggaaauacuagagagaguguugaggaggaaaaggaaguugaaauggacuugauaaaauaacuugauaaaauaaccugaaacugaucaccuugcaaauuugaauuuaucugacuuagcuuucuauuauucauucaauagcacgaauucuauugcagaucugauuauaagcucaggucuguaaaagcuguggaaaacaaaacaguucagauugucuugaaucuagaguuugcuuuccaagacucucccucuaaaccuguuaacucuuaagaaauccucuugccuuucccuagugaguauacaaaauaccuacuacaguuacuggcacauguuaccagcaaaccagccccugugcccuucauauucuugccaacacuaagaacaaacuauuuaaucugucucacuguuguuuucguuuggugaauacauuucaaaaagguuauaauguauaaaguuuguacaaacucuuuuuuuuuuuuuuuuuuuuuaagguaugaugagugggugaaggcugacaggauaaucuggccuuuggacaaagguggaccaaagaaaaaacagaagaaaaaagcuaaaguauguuuguagauuuauguccuuuauaauauguauaggaauuauccaaauuguauuguguguuuuuuaagacuuuaagaacaguuuuagguuuauaccaagauugagagcaagguauauagaccucccauauacucucugccccaugcaugcauagccuucccagauugucaacaucccccaccagagugggauguuuguuacaacugaugugccuacauugacacauuauugucacucagaguccaucguuuacauuaggguucacuguugguguuguauauucuguagguuuugacaaauauauaaugacauggauccaucacuauaguaucauacagaguagcuuuacugcccuaaaaauccuuuauguucugcuuauucuuacccccaccccagccccugacaacuacagacuuuuucucucuccauaguuuuugccuuuuugagaauaucauauaauuggaaucauacaccauauagccuuuuuagauuggcuucuuuugcuuaguaauaugcauauacgauauuguguuuguuuaauaaaucuuauuguaauaaucaucuuggccgggcaugguggcucaugccuguaaugccagcacuuugggaggcugaggcgggcggaucacgaggucaggagaucaagaccauccuggcuaacacggugaaaccccaucucuacuaaauauagaaaaaauuagccggucgugguggccggcgccuguagucccagcuacucgggaggcugaggcaggagaauggcgugaacccaggaggcggagcuugcagugagccaagaucgcgccacugcgcuccagccugggcgacagagcaagacuccgucucaaaaaaaaaaaaaaaaaucuugauucuugacagauaauugugauuuucucuuuauaacccaggagcuuaaaacuaacacauuaccacauuguuucagcaaaggugaaaaccagcaaccccuagggcaugacuuucaaacucaaauuccuguagaggcuuuauaggagaaggauaaaguaggacgaaccgugacaaacgagaggucacauuccucauuuagacggaauggaacuaaccacucugcugugggaaugcagacccaggguugccagauuuuaggauuuuucaagaccacuaucuuucuuaaaaugugaaauuugacuuuuaaaugcuagaagccaauacuaaaauuuuaaaacacauauauacuggccaauuguacccucacccacauccucaguugucaagcuuugcuguagagauuugcccauuguuuugucuacuggaugauagauaucuuuccuuucugcaggggauaguagggaacagcggggagugcggaauaguuguauagucuucuaaagcucuaacugaccaucacaauauaauugcaguauuacaaauuguacaauauuguauuuacauaaauacaaaauauguuagaaauucagcaguggaggauuauauaccaauuuccgugacacuaauguuaauaaguucugauaaccucucagaccagccagaaaacucuucuugauucuucuguaagcacagacuaggaagugacauauaaaauaucaaaccuuuuuugagauguaguuuucuuuggauaaguagaauguucauuuuucguaaagcauuggcccuucucauacauuuuguuguuguugcccagaauaaagaagauagugaaaaggacgaaaagagagaugaggagaggcagaagucaaaacggggacgaccuccuuuaaaaucaacccucucaucaaacaugccguauggcuuaucuaagacagcaaacagugaaggaaaaucagguaccagaagugcucgcagcaauauaccagacagcucaccucugucaaauggaauggaaggugcucaauuuugaggauggcugacuuuaaaaaaaaucaauaacauaaauaauaaaacuuccauugugugaaauauucacaguacagguugaguaucccuugcccaaaaugcuugggacuagaaguguuuuugguuuuugauuuuuuuuuuuuaauauugcauauacauaaugagauauccuagggauaggacccaagucuaaacaugaaaauuaguguuucuuauacacauagccugaaaguaauuuuauaccauauuuuuaauaguuuuguucaugaaauaaagauuguguuauuugaaccaucagaaaucacagguauaauugucucagccacccaugugaacagucugugauuguuuggcaucacuguuauucuugacucugaauuuauaugccagcuacugauaagcaauuuucuuacacuuauucacacauaauuacauaacaguaaaacauaugacuuacaauuaauacaguggaaaaauuguguggggaaacuaagcagcaagguagcaucacuagaauaccuguaucagcugcuaaacaacagcaaaaacaaacagcaggcuuucagucuccaccuacgaugcuguguuuucauuaaaagguuacccguacacuagcuugggguugcugaagaaacuguugugcaccuguguuuggaugcaaugugucccaugaggucaggucuggaauuuuuuacuuguggugucauguuggugcccaaaaaguuguggaauuugcagcauuuuggauuucagguuuuuggacuagggguguucaaccuguaaaucaccuaggauuuuaaucucauaugauuuaaacuauaaaauuugauuugaagaaaauauuuugcuguaucauuuuuaucuaaaauuuagugauguuuucauuuaggaauacuuuuucucauaaguaucuugaaaauaauauauuuuaauagaaggugaauugacaauccaugcauccuaaugugugcuacacuuucccucaaagccuguaccaguguauccuauaaauucaaugcuguucaucugggaucuuucagcaaagcugagaccaugugguucuaagagaacacagacuacuguggugcaggcauguuuuauaaugaguauaggugaacauauuuuauucugcuuguacucguuucccccacuuuucuaccucuguauacuuuuaaauguaauuaagaaauuuuaggcugagugcagugguucaugccuguaaucccagcaccuugggaggcugaggcaaaaggaucacuugagcccaggaguuccagaccagccagggcaacauagugagaccccaucuuuacaaaaaaauuuaaaaauuagccaggcaugguggugugcaccuguggucccagcuacucaggaggcugaggugggaggauugcuugagucugggaggucaaggcugcagcaaguguaaucacaucacugcacuccagccuggguagcagagcaagaccccaccucacucuguugcccaggcuggaguauaguggcgcaaucucagcucccugcaaccuccaccuccuggguucaagcaguuuucccaccucagucucccaaguagcugggaccacaggugugcaccaccauaccuggcuaauuuuuguauuuuuagcagcaauaggguuuuacuauguuagccacgcuggucucgcacucuugaccucaagugauguacccgccucagcguccugaagugcuggaauuacaggugugagccacugugcccggccaccaaaaaagaaauuuuaaaugguugucuuauauaaaaauuucucuucuuucaagaaaaaagcuauacugaacuacauguuugcuauuaguccauauggugcuugugugcaaauuauaaaaggacauccuuccucuuuacugccaucugcugacaaauguuuaagauguccacaaagugaaagguacccucuuagaaggcauaccugugugcaguguccagucuauacaacuacauaccagccuuauuaaacuaccacugaaagggauuuuuuaaaacaugaaaaugaauucuacauucuguuuaugauaaaaccacaaaauaaaacuguauacaccuuuucacuaaaaaauucauguuugcaguuuugaacuucuugaggauuugagcaccauguggacaauauuuuuauauuuuuuagauccuauacagucuuagaacccuacuuuacuauuuuacaaguucccuuacagggaacaauuuuuguuuccuguacuuucuugucuguuaagaauauuuaaaguuuugaggauuccaauugcccauuuuaaaaacuuuucuugcugggcacgguggcucaugccuauaaucccagcacuuugggaggcugaggugggcggaucacuugaggucaggaguuugagaccagccuggccaacauagcaaaaccccaucucuacuaaaauacaaaaauuagccgggcgugguggccugcgccuaucccagcuccucaggaggcugaggcaggagaaaugcuugaauccaggaggcggagcuugcagugagcugagaucacgccacugcacucuagccugggcaaccaagugagacuaugucucaaaaaaaaaagaaaagaaaagaaaaaaccuuuucuuuccacaguuauuuuaaguagaaugucauauuccuuucuuaggguacaaaaugcccaucaucuguccuuccuagauacuaucucaaaccacuuaacaaauuaacuucaugucuaggaugucuagguacuaaucuuuugaucuuuuuuaaggacuauuguaccuaaauaugauacuggggaauguugcaaaauagcuuuucauauagauuugaguuaguaauaugcaacguaauauauuuuugcuuggagcuuaguuuccccucccccucaaauucuuggcacaaauguuaugauuuguuuuauuucagaaauuucuacagggagguauucagagguacaugauuaaagauuuuuauuguuauuuuugguaagauuuuuauuguaaaauuacauugguaauauaaaaaccuguauaauauaauaauauuuccucuuacagacucuuguucaucugauagugaaacagaagaugcuuuagaaaagaauuuaauaaaugaagaacuuucucuuaaagaugaacuagaaaaaaaugaaaauuugaaugaugauaagcuagaugaagaaaauccaaagauuucugcacauauauuaaaagaaaaugauaggacucaaaugcagccuuuagaaacccugaaguuagaaguuggagagaaugaacaaauaguacagauuuuugggaacaaaauggaaaaaacagaagaaguuaagaaagaagccgaaaaaucuccaaaaggaaagggaagacgaagcaagacaaaagaucuuucuuuagaaauuauaaagauuucaucauuuggccagaaugaagcaggaagugaaccucauauagaagcucauagucuugaauugucuucauuagacaauaaaaacuuuucuucugcuacagaagaugaaauugaccaaugugugaaagaaaagaaguugaaacggaaaauacuaggacaaucaucgccagagaaaaaaauaagaauugagaauggaauggaaaugacaaauacuguaucucaagaaaggaccagugauuguauuggaucugagggaaugaaaaacuuaaauuuugaacagcacuuugaaagagaaaaugaaggaaugccaucauugauagcagagucaaaccaaugcauccaacaacugacuagugaaagauuugauaguccagcugaagaaacuguaaauauuccacuaaaagaagaugaggaugcaaugccucugaucgggccugaaaccuugguuugccaugaaguagauuuggaugauuuggaugaaaaggauaagaccagcauugaggauguagcaguugaaagcucugagucuaacucucuuguuucuauuccaccugcccuaccuccuguaguccaacauaacuuuucaguagcuucaccacuuacucuuagucaagaugagucucgaagcguaaaaagugagagugauauaacgauugaaguugauaguauugcugaagaaucucaagaaggucucugugagagggaaucggcaaauggauuugaaacuaauguugccucugguaccuguaguauaauuguacaagagagagagagcagagagaaggguaaggacuuucuagggaaaaguaaguguuuauaugaaaccaaaaaucaaaacuguugaguuucagguacuguugaucuguaaaguacuuucuuuuucuuuucucucuucuuuucuuauuaaaaagaaagaaaugucaguguagucuguugaauaauauacuugcucuuuuuuuuuuuuuuuuuuuuuucaacauucucucuuuccccuuauuucaggucagaagaggccaagugauggaaauaguggauuaauggcaaaaaagcaaaagcguaccccaaagcgaacaagugcugcagccaaaaaugaaaagaauggaacagguuggugucuuucaaugcuagcuuuuguauaguguuaguauuuuuagcaguuuguuggcuuguuuuaaacauaaauggagcaauacuauauuguuuuauaacugcauuuucauuuaacaguauuauacuagauauuuugccauuuuuauucuuaggaacucuagcucauucuuuuuaacaacuuuaggaaaguauucaauaguuuaucauuuuuaaccauuuccccguuggugagcauuuagguuuuuuuguuuuuuuguuguuuuuauauuguuauaaacuuugugcauuugugcacuuauuucuguaggauaccaagaaauguaauuguuaggucuguugcauuuugauauuuaagaauuuuauuuauaaucugagucaaucuuuuuuauuauuuauaggacaaagcagugauagugaagaucuuccuguccuagacaauucaaguaaauguaccccaguaaagcaucuuaauguaucuaagccacagaaacuugcacgaucuccugcaagaauauccccgcacaucaaagauggagagaaagauaaacacagagaaaaacauccgaauucauccccuaggacauauaaauggagcuuucagcucaguaagaagcuuauagaaaacuugauagaugaauacuguaaaguggaauagaucuuaaaauaucaacuuggauuaauguuaauaaaauaaggaauaaugauuaacuauuuagauauuccaaauauugccuuagcaagaaucaccacauguugucuuaaguauaaaucugugucuuuucauaaaacugacuugauaaauauugacuuacaggaaggucuccauuaagaagccauguaugauuuauauaaaucagugaaauugaagugcccuuuguagcacuaacaauuagaaauagccaguaguuauuucuauuauguaacuaguaguagugaagaaaaugucaauacagggaaacuauucugauaacuauaauuauagauaggucaggguuaguuuguguugauguuuucuuauguuuuucugaucauuuaaguaauaaauguuuaguauagaaaauuugggaucuaaaaauaauucuuaaucaugaauuuaauucacgacuuccuuguuuucagucuuauucagcuuacuguaggagauuuuaauaaacuaaagcuuuuguugauuuaugaguuagacguuugauagaauugucaucauuuuucucacagaauuauuuuaaaauccaaauuaacuucuuuccccccuuuuagaugaauuagauaauaugaacaguacagagagaaucucauuucuccaagaaaaacuacaggaaaucagaaaauauuauaugucuuugaagucugaaguugcaaccauagacaggaggagaaaaagauuaaaaaagaaagacagggaagguaauuuuauuaugauuuuucuccccuuauauuucaaaacuauauccuaucauuuuagaagauuuaaauuugauacucuuugaauauaguacacauucauuaauugcuguuuuuaaauuccuaguguuuucuauuguugaaaugaguaggucagcaacugaguuaaucagaaugacacccuuaaaagggaguaugaacuguuuuccaaaaugggugauuguacuaaaugugauggauucucagguagagcauaguccuucugaaauucacucuuugcucaaacauuuauuggcaucuauuaacaggcacuguauuuguuaugggguucaccaaaaugaaugagacauaaggcuuauucucaaggagauuaucuuguugggauuauaaaucauuuccuaagcaacuaaaauauaagauagugcagcucagcaacuuuaaagagcacaugccaugugccaggcacucugccagguggcggaaguacagaaaugaguuagauacagacuuucuucucaaagaucuuaacaucuaguggaacaguguguacccugagaaugauauuaacgaguacaagaguuaguggaaggagagguuacuuuggaguagucagagagagggaguagugucugagcuagcccuucggggguuguaggauugacuuccaguuaaacaugaacauguccaucuacaguccaucccuaagcccugcuaaaauaacaguaaaggaaauuaaaagcccuaaacucaaaaggacaagagaaugaccacaacagacaagaaaugucaacaguauaucuuuuggaagcugcauaacagauggacuacuguaacugucccagcagaugagauaaugcugaaacuaagcuugcuuguccuuguagugggacaaaacaacaagaagcaagccaauuaauaccauguaaccccagaaaagcuuucagaagggauaugggacgaugcugaaaaaugggauugguugaaaauggaaagagaaauuggaucucuucuucccaucugugaagcaagucuaccucacccccaacucaagcagaaaauagauuaacuuaaaagagaaugaggaaaucaguaggccuguagacuugggggcaccagccacagcugaggguaaugauuaagugcuaaaccaaaauaauggauggagugaaaguuugcauacugaauaguuagauugcugucccucuucuaacucaaggccuaauccucuuggcuuccugaaagcuggcagccaagcuuaugcuuauuccugggaggagauuggaagauucuucuaaagaaaaugaccagcccaagaaaaauuaccuacuauuuggauguuccugaaacaaaaaucaagauccuugccaaucacuacaugugcauuuucuguauuuaaaagcccugaugcucauauacagcuuucagucagcuuuuuaauguuaaauauggaagccacaugaccagacauuugaggaaagccccuacauaaaggcagaagccaaaguagaaaaaggagaauaaaaaggaacuggaagaaaaaaaacagauaauguaccauauuaaaaaaaaaauaggacaaaacuauucuuaauaguuaauccaaguugaguauccuuuauuugaaaugcuugggucuagaaguguuuggguuuuuuauuuuuuucagauuuuggaauauuuguacauaaugaaauaucuuggugaugggacccaagucuaaacacaaaauucauuuauguuucauagacacuuuauacacauagccugaagguaauuuuauauaaauaauuuugugcaugaaacaaaguuugugguaagugcuuauguguggaauuuuccacuuguggcaccacguuggugcucaaaaguuucagauuuuggauuuuuggauuagggauguucaauuuguauccagagauaaagggaaagagauugccaccuugaaacaaaagcauaauaacuauuuuaaaaauucagagaacaagaaggauaucuuuaaaauaugauagcaggaauuuaaaaaaaauaauaaggcagugaagcugaagaaauuccacuagagggucaaaaagacaauaggagagaagaaauaagagaaauauggaaucuggcgaggagauccaacuucugaaucauaggauuucuagaaggagaguugaauaaacaagaggaaguugucaucaaagauauuuuuaaaauucuagaacugaaggauaugaguuagaaaaggacucacugugcccucuauaaauaaugggggugaaaaucaccaaagcauaugaaauuucagaauccuguggauaaagaguagauucuaggccuggcacagcggcucacgccuguaaucccagcauuuugggaggcagaggcaggcagaucacuggaggccaggaguuuaagaccaaccuggccaacaugacaaaacccugucucuacuaaaacuacaaaagucagcugcgcaugguggcagaugccuguaaucccagccacucaggaggcugaggcuugaggaucacuugaacccggaagugagcaccgagaucgcgccagugcacuccagccugggugacagagugagagucugucucaaaaaaaaaaaaaaaaaaguagauucuaaaaauuuaccauauaaagauacauauauaaaaagaaauggaucucagaacagcaucaagagucuuacauccgauuucucaaugguaguacuagaaacuagaagccaagcuaagaagacaugggacuggcaaacaaggaauccuacauaggaaaauagugaaggaauaucugaaggugauggugaauggaagcucuaggaugaccacugcauagcagaccuagaaagcaacuauuccaggaguaggauggaacaggaggggaaagcuccagaagggaugucucuuaaaaaccaaauaaaagguaaauuaccugauaggguugaucauguugagagaaguuuucugccucuaguagagauuuaguggaugacuuugugguagagugacgugucauguguggccuugaccauugugcuccaaguccagcaguuuuuaauuccuagaaauaggaacaggauggagcaaauggaaagagaucagacuucucauguucauccuuuucuuuuaaaaacuguaaauagcaagaagucuuuacagaacuuuugaauaucaaaagaagaaaagaacaaauuagcaaauuaaaauuucuucaaagaacccaccacuugcucuggggucaguuuccuaaaggugacauacauuucagacaauuaaaaagauuuucuuuuuguugagacagaguuucacucuuguugcccaggcuggagugcaauggcacagucuuggcucacugcagccuccgccucccggguucaagccauuuuccugccucagccucccggguagcugggauuacaggugcccgccaccaugccuggcuaauuuuuguauuuuuaguagagauaggguuucaccauguugaccaggcuggucuccaacuccugaucccaaguaaucugcccaccucguccucccaaagugcuggaauuacaggcaugagccacagcgcccagccaaaaagauuuuuuuauuaccgucuuuuuuguuguugggggguacaggcucuggcacccagacuggagugcaguggcaugaucacggcuuacugcagccucagacucuugggcucaagcgacucccaccucagccucccgaguagcugguaccacagugccugccaccacacccagcuaauuuuuuaguuuuuuuuguagaggcauauucucacuauguggcucaggcuggucuggaaccccuguucuaaagcaauccuuuugcuuuggccucccaaagugcugagauuauaggcaugagccaacaugcccagcuuauuauagucuuuuccccauuuuuauuugcuuauguuuuuauaaugaguuauuaaauugagauuugagugauuuguagcauacauguaagaauuuguugccugggcauggggcucacgcuuauaauuccagcacuuugggaggcuggagcaggaagaucacuugaguccagguguuugagaccagccugggcaacguagugaaaucccaucucuacaaaaaauuuaaaaauuagcuggguacaguggcaugucuuagcuacuuggaaggcugaggcaggagggucgcuugagccccagagguugucaugauacuugaauaaacaaaaauuaaaauuuuaaauaaaauaggaacaaucaggcaaagaaaggcagaagacaagaguauugcaaggaaagagaagauaaaagcaaagaacuuaaaaaguggcaaaacaccuaaugcucagaguaccgaucccuaaucuguguuauguccuccuggagaaaauuauguuaaaaccauuugaggacuuuuugcuuaucacacaucauuacuuugauccugaucuccaugauucugauaccugucagaggaaauccucugaguuaaauuaauucucuuacgguccuaugacccauagauaaagcagaaauuccauaugguuccauguuuaucucagguugaccuuguuucugauugagccaaguuccuucaugggaucucccaacuagagguuuaagaguuuuugucucuuuaaucuuuacauuuuaugauguauuuuuaaguguugaguagugcuuaacugaccaaagacuaacuccacuuaauugagccaaacaaaauuuuugcugacaauuuguuacuccuucaugugacauauaagaggccugugauuaaggugaauaauguuaagaauuuuauuucuaauuugcuguuagcuggguaucuuuguguaacaguuuuuggaucuaacauaguuguuuugauuccacagugucucaugcgggagccuccaugucaucugcuucaucagacacuggaaugagucccucaucaucaucucccccacaaaauguacuugcuguagaaugcaggugauaaacauuuucucuaccuucccagcaguuugcugccauggacauaaauccccaaacccugaauuacaaccacagaaagcacucaacugguuugacauugcuaaguauauccuguauacuuuuccaggcuggauuguaucuauuccccucucucuucuuuuuucuuguugcaaaaaauaagcugauuaauaagugaagguuaagcagccugccauauuugucauaauuuuuccucuuuacuuuuguuuuucguuuguugugauauagaacaaagggcacuuagcaaauuugaauuuguauaauaaagcuuucagguguuacagaaaucguagacaagcaagugcacaugauaaacaucaaaauauuacccagcugaauaguuacugcugcacuuucacuaagauguauuugaacacuuggugaguaggggguuuauguuguguuuuuuuucauuaucguuuuuuuuauuuuuguggaagcacuugcuauuuagaacugccaaaguauauguucagcagugugcccaggauugaagguguaaaugggacaaaauaaauugugaaaggaaguguaguugacugaaaacuacaguuguaauaagucuuccacuuuuuauaggauuuuugagcacaaaauuaugcaaauauuuuaauguuuauuaauguuuacaguggaauugugaauaaguuuucaguggacuaucuuaucccuugacaaaaauauuuugucuuuuuucuauguaauuucagaguuuuuauuuuguuacaaaaagacaaaaaugaaauauauaacaacaaugaaguuauuuaacaagauuucuaaagcugaaauuuuuguguaaaauaagguauuaucuugcaacuuguuaaauauauuuauucagacauuggauguuguauuuuuauguauuuuuuaaaauauuaauaaaauuuaaaaaaagaaaauucuagguuaauucacucuuuggaugacaauagcucucagcuguccuuuuuacaggagguugcauccugcagccuugccuguguuaaagggagucugucucaguccaucaaacaguauagaacuauaaaugggcaucuggaucauuaaaguauguccuuguuuagaaacuuuggcaguccuaguauuuaaacuguuuugaggaucaaauuuuugguugcccuuaagauacuuugucacaguuuuuauguuugcuauacugccgaaugaauuuauaucucccaaaguugagaugcaacaacuaaguaaagcaacuauguaugcuuugucugugaauuguuccacagacugauagauuuuguaaauaauucuuccaaaaucauguauuuaaagcaguuuugcauauacauuauguaaaaaggugauuuuauaaaagcaguuuuuaaauucauguuuguacauugaaagggguuuuuuuuuuaaaccuccuuuucuguguuuaauaugcuguagaauaauaaccuagaugcucuagacuguauaucaggaucugauuuacaagaaaaagucagagcuaaacacuagugauggcauagcauuacugaaaucauuguuucuuaauuucauuuuacuacauugugaacuugugauucagauuccauuuucucagagaauuaaaaacaaaaaaaguacucuuguaaaaugcacuuuucugucuuuucuuugcaaagcagaaguaucucaauguaaaauaaaaauggagcucagugggcaguauuaauaaaggccauguuuuaaacaua

SEQ ID NO: 192362 - RNA, 71967 nt, Homo sapiens
aauuacggccggauuccggaguccuuuccagcucccucuucggccggguuucccgccgaauacaaaggcgcacugugaacuggcucuuucuuuccgccaaucauuuccgccagccauucaucaccgauuuucuucaucuuccccucccucuuccgucccgcaguccccgaccuguuagcucucgguuaguuaagggacucggguccuuccgaacugcgcaugcgccaccgcgucugcagggggagaagcgggcaggggcgcaggcgcaguagugugauccccuggccagucccuaagcacguggguuggguuguccugcuuggcugcggagggaguggaaccucgauauuggugguguccaucgugggcagcggacuaauaaaggccauggcgccagcagaaauccugaacgggaaggagaucuccgcguaagcaccugacauuguuguugaguguggggcuguggacgagggcucugagggugugcaggucccccggacccauuuuuugcgggagggacacuuguagcggaagaguuaggcccauaacaccugaagaccugcagccaaagaaagagaacccgggcacaaccugcguuugcaaguggacugccuaguggcuguagccgcuggcuccugugcuucggggaaaaguccugugccgacuaugcucccaaacgcgcagcugcuggugacuuucugccgggagaguggguaguugcggcuuccuggagccccccuagucagaacucagaaauccaaucuacuuaauucccguuaauuuggaggugaguagauggagacuagugaggugacaaggcuugacaagacuacaaggcugauaaugacagaggguccuuccagcucauagcuuuucccacuauaccauagucuuaucauacgcuaagugaaaucuaauacauuuuuccuuucucuucaaucucgugcuucucucuaacagccaucucucugcccugguccuagaguuacuugaaacguaauuuggcuccugaguccugagaauauucugcauuccacuugaccucugccuguucuacccuugcgggacaucugaaugcuuaauuaguggguaucguugccagcuuuacucccaggaaguaacacuggcugcuuuuugucugggaggugacuggugaggaaaaaugagaguagaaggaagagggaaaaauauauucccucuaguagaugaaggagggaaagauauauucugugugaccuuacugaguuugcucuugggaccuuucacaucacccguuauguaaguaacuguugccagccacagcaguuacuaaauuguaauuguccuguaacuccuaacuuuguaauagguuuuugagugaauuacaaagucaucgguggugaaaaguccgggcccaguggcucaugccuguaaucccagcacuuugggaggccgagguggguggaucaccugaggucuggaguucaagaccagccuauccaaaauggugaaaccccaucucuacuaaaaauacaaaaaauuagccgagugugguggcaggcaucuguaaucccagcuacuugggaggcugaggcaggagaaucacuugaaccuggggggcagagguugcagugagcugagaugcgccauugcacuccagccugggcaacaagagcgaaacuccgucuaagaaaaaaaaaaaaagaaaucacaauacuuacugcuuagugcuuuucaacauguggcuugcuaaacuguauuucugcuuuacuuucuguuuuuguuugcuuguauucaaacuuacuuccuuuuccaguggcuuuuuguuuuaauauaaaaaucuuccuuuuagaaagacugauugugaagagauaauuuagugcauaauaauagugcagauaauuuaguacaauaauaaugcaucugggccaguacugagaauaggugcucacugaauauacuuucguuaauuggagagcaaauuaaauauguuuaucaacuccauaagggcaaauacauguauugucuuauuuuugucuauauccuaaacaccuggaaacccuguuuccugccuuacuacuugugugguuuuaagcaaauuaauuaaccuuucugugccaaaguuuccucaaauguuaaguaaaaguaaugucuaggucauugggauguuaguagaauuaaauggguuccuaacagaugaucauuuauaauucuuccuggcacauaauaaguauucgauauauguuguauuaauaaucaguaauuaguuaauguauauaugaaugauucauuaucuuuuuuuuuuuuuacaugguagcugcugccuugagaucuauuuuuuuuuuugagaugaagucuugcuguguccaaucuuggcucacugcaaccucugccuccugcauacaagcaauucucucauaucagccuccugaguaccugggauuacaggugcccgccaucacgccuagcuaauuuuuuuuuuugagauggaguuucacucgucgcccagacuggaguacaauggcgugaucucggcucacugcaaccucugccuccuggguucaagcgauucuccugccucagccucccaaguagcugggauuacaggcguccgccaccauguccagcuaguuuguuuguuuguuugagacagaguuucacucuuguugcccaggcuggagugcaauggcaugaucuuggcucacugcaaccuccaccucccagguucaagcgauucuccugccucagccucccgaguagcugagacuacaggugugugccaccccguccggcuaauuuuuguauuuuuaguagagacgggcuuucaccauguuggucaggcuggucuguaacuccugaccccaugugauccacccaccucggccucccaaagugcugggauuacaggcaugagccacugcaccgguccuagaauuucuuaaaaauccagcccacuucccacauuccauccugcggauuaggaaaucauuugaggccagaaaagugaugugauuuguccaagggugaauggcaauggcucaacuaaaacuaaggucuucacccaguauaugauguuuuucauucuaaccagcacuuacuacuugcuaaaaggaauuucguaagcuuuucuuuuucuuuucuuucuuucuuucuuuuuauuuuucagacaaggucuugcucuguugcucaggcuggagugcaauggcacgauguugucucacuguaaccuccacuuccuggguucaaacgauucuccugccucagccucccagguagcugggacuacgggcaugcacuacuaugcccggcuaauuuuugaauuuuuaguagagaugggguuucgccauguuggucaagcuggucuugaacuccugaccucaagugaucuguccaccuccaccuccuaaagugcuaggauuacaggugugagccacugcgcccccgcuggcgcuuugcuuuuucuuuacagucuuccucucauuagcauguuucccacccugcugagaaugcuaucccugacucguccucuucuauuauuauucuccuuuuaugccuuccugggagcucggacaucaacaaaguucagcauuccagauuccuucucuaccugcucuacucugugggaaacuggguacuuacaugauggauuuaguugccaaauuaucuuucuuuggaaguaacagccccuuuucucccucacggggaauucuaaguuugcagccugaauuugacaaccgggggaaggucugagaguuagagacaaguaucuguucuuuguggguauuuauucacuuacucaacaaguagcuguauguguccccuaagccaggcaaucuucaaagcucugagagucuaauagugaacaaaacagcccaaaucccuacccucaugaaacuugcauacugauggguagagacagacauuuaaauaggugaaacacauugugagcuggugggaagcacaaagagaacaccagagcagaaaagagggacaggaguuucugugguaugguggcugcaauuuuaaauaugggagucauagucuuuguaaaagugacuuacgggcaaagacuugaaggagguggagccuuaagccugccaauguugugagggaaauagcuccugaccaaaaacacagccugugccauagaccuuuguccucaccaguuacuaacuuacugcuuuggggggucaauggcaauggcccugugagaagcugaccgaguggaggcuccugaguagaggaaccugacccugcccugggcagaaggguggugucuuuuaaaagauuaugcaaagugggagaaggaugugcauuaguguuggaagacccaccuugcuuuguaggcaagaaagcauaguuguucuauaagugggccuuucaaaggggggcuuacuacauuuauaugauuuguuugguuuuuccuucccuuaguuugcuauaauuaagccugcucucuccauugguggcauuuuucuugauuaagucuccuuucuaaagagacugguugugaagaggcagaugguuugaguaggugcugcgaguguuugcuggccaagugcagggcaaguuggguauauuuguaagcucgcuguggaugguagcuccagagccuaagcacggugcugccuccucugugcaucacugggucaugcaauuuaccucugugccuuagcuucuguauauugggguaguaaugucaccuaacucauaagguuguuagaauuaaaugaguuuaauaccuauaaagcauuuagagaaguuguugguacaugguaaguuuuaauaaauagguacuuagaaaguacucauugaauaaaaaagugauguuuguguuuauccaggcuguaccuuugggagcuggcuuauaaucuugagacuuaaaauuagaauuuauccuagugaucaaagauaaaaguuuggaaccuuggcuguacauuuagcuacagggcuagaagaacuguuuuugugaaaauaauuugcuuaccauagugaagggcaggucuucuugguuacuaaguuaacauggauaagacuuuuacuuuguccuguagauuaaauacauguaggcccuuuugugcuuaaaaagauuugucugggcagggcgugguggcucaugccuguaauccuaggacuuugggaggcccaggcaggaggaucaccugagaucaggaguuggagaccagccugacuaacauggugaaaccccaucucuacuaaaaauacaaaauuagcugggcaugguggcccaugccuguaaucccagcuacuccagaggcugagacaggagaauggcuugaaccugggaggaggagguugcagugagccagugagccaagauggcgccauugcacuccagccugggcaacaagagcaaaacuucaucucagaaagaaaaaaaaaaaaaauuugccuguaaugaacuccaaagugcagguugcucaaaaguuacauggaaacuugacugucauagcuggauugauucuggaagccugugcaggagaggucggaguuccagagaggcugggaccuucagcuaggaccccagccaggcuguugggcagguugcagcgauagugcagcagagcccagagcuggcagccaacuacuauggucauggcaccugauuggggaugugguuugcaaauaagugucuguccuuguccaucaggggaguugggaucaggcaguuugggauuuggguagugggguuuugagcagaggucugugguucccuguuacauccccuauuugcaugaagaaucuucuagaaggaaagcuggccuaguacagaggaggguccuuggaguggaagcaaauggcucccuucuccucuaauugacucaguagagguugguagaauagagguuaaggggcagggaugcuuguguggccuuggaaaaguuagcuucacuuuccuuucugugcaguagggaugaugagaacugucuacuuccugacguugccccaaggauuaaaagaauguaagacucucaaaacaagcuucuuugacgucccauccacagugcagaaggcccccauuaccccugcacugugcgguuggcucuccuuugcaccccuuaauugaccaaaaagcagcuucugucacccuguaaauccuugaccuugaagaaguggguggcuaaaggugccacagucaagauuccucagccacucggcuacuacccuuacccucaauuuugcaguuuaugacacuuuagccagaagcuaagugacuugcccagguguuccaagguagguggcagaggcucgauggugcauuucuuucccuaccaugggcuugucauuggcuugcuagaaggaauugcaaacuucuacccuccagcaggagacacccuggguuugguucucccugaggccuuuccauugugaggaaaucauuccacccaucagucugguugggaagcacccaaacagauucucuucaaaaagucauuuuugaaguuauaguccaauuuugacugguuagagacaggucagaccuacuuacuuugcuggcuaagcuuuuuuuuuuucuuugccccucaccacaagccuggacgggagacguacugcuugguaucuggugcuugagaggucccaggagauaagggagcauuucugugaaagguuuugccagagccugucaggaacuuaaucuugacugcaaugaaugacuuaacauuauaagugaucuuuggguuuaggugcccaaauaccagucccuccuuaguaagcagccuuuuagaccuaaccuuuucuaccuaagguuuuguucagucuuuuugaaaagcaggaaggccagguccuugugaggcuuuucucauuacaagcucuuggcagguucuucccuccaaguggagaacccuuaccuuccccauucuuucuaccuuccccucugaugauccagagggcugcaagggaccuagagcuguucauuggagcccuagucagcucuagcggccagaucuaugguuagguaauccuccaauagugagacuaauucucaguguuagaauuaggggucugccuguucucaccagcagacccacuggcaucaacucuccuuuguugacauauaguuaagcaccgcuucuuacagauccucauacucagagccaaccuugucuugucucauaacucuugcuacuggcagaaggugauaaaauuguggccuagaggccaaauguuuuuuguuuggcuuacagaauuagauuacuucucaacacauuuauuacuuuacaacauuagauuacuucuuaacacacuuaugccuguaguuacacauaaaaaucuggaugcuugacuuuuugaaagaugugaacaguuuagcaauacuguacugucuaucuucaugccaucaauuuguuggaucugaguagaugcugccuacccccucauccuugagugggugggggugggggaggugggaccucauuguucaggaauccuaccacacuugguugccuguaccaggacuccgaagguucuuuccucuuugagaccuuuuucugaaugaacuuaugguccacuuuuaaaauccuaaauuuuauaaagccuuaaccaguccaaccuaguccguuuauugcauuagaucagagguugucaaauggggcaguuuuuuccucccucuaccucagggcauugggcaugccuggagucuuuuggguugucauauggggaagggguaugcuauuggcaucuagcaguagaggccaggacuggugccgagcauccugcagugcacaggauaguccccauaacaaaggaugaucugguccaaaugucaguggugcugagaucgaaaaacccugaucaagaagcuuaaugugaguuauugugucauuguguguguggauuaaugauggacuuuacccucacuaagaauuauaggauucauuaaaauuuuacacuauucugacuuauuuucaugucauaaauaucaagcaguuuaccuuugcuuucuuagggcuuugaguuagagacaauuggauggaagaacuuuacauuauaaacuuucaaugaagcauaaaauagcuuccucacauuaagcuuucaaauacguauuugagguaacugucaaauuugguaaaugucuggguuaaauuauaauaauuuuuuuaguaaauauucuuauguaauaauaguacuauugucaguugacugucuuguauacugauauagcuuuugcuauauuagugauaggugaaaaucaguuuucuuucaacaagaagguaauuuaguguuuuaauuugacuuaaaugacuagcaauuugaaauauauguauuucuuggaacacuagguggccuuacaaucacaauuauuuuuacaaggaacuacauauuaaguuuuuaaaaauuuuuugaagguuuuuuuuuuuuuuuuuuugagauggaguuucacucuuguugccuaggcuggagugcaauggcgcgaucucggcucaccgcaaccucugccucccggguucaagcgauucccgugccucagccucccgaguagcugggauuacaggcaugcgccaccgcucccaguuaauuuuuuuuuuuuuuuuuuguauuuuuaguagagacgggguuucaccgcucaggcugugucaaaccccccagcucaggugauccacccaccucagccucccaaagugcugggauuauaggcgugagccaccgugcccagccgaaguauuuuuuaguaguauaaaaauuguuaaugaacaaaugaaauaaaucaacaaaugaacaaaaugggaauaaaacauauuaaauaaaacauuuguguucugcauuuuaaaaaucuuauaauagcugggcgccguggcucacuccuguaaucccagcacuuugggaggccgaggagggcagaucacgaggucaggagaucgagaccaucuuggcuaacacggugaaaccccgucucuacuaaaaaauacaaaaaauuagcugggcgugguggcgggcgccuguagucccagcuacuugggaggcugaggcaggagaauggcuugaacccgggaggcggagcuugcagugagccgagaucgcgccacugcacuccagccugggagacggagggagacugcgucucaaaaaaaaaaaaaaaaaaaaaaaaaaaaaaaaaaauauauauauauauauauauauauauauauauauauauauauauauauauauaaaaaacaguaaucuauuggggcaggggauaaauuguguccuuguuuagaagaagacuuuuuuuuuuuuagaagaagcccuguuguuuuuguuguuguuauuuguuuguuuguuuguuuugagacggagucucagugggucgcccaggcuggagugcaguggcgcgaucucugcucacugcaaccucugccucccggguucaagcgauucuccugccucagccuccugaguagcugagacuacaggcgcgugccaccacgccuggcugauuuuucguauuuuuuaguggagacgggguuucaccauauuggccaggcuggucucgaacuccugaccucgugaucugccugccuuggccucccaaagugcugggauugcaggcgugagccaucaugcccggcccgaagcccuguauuuugaaggugaauguuuuugcuucuucucugaucaguuacuaaaaguguuuucccugugccauuugagaauuauuugagaacuacucuaagcuuauggcacauuucagcauuuuuguugucuaaaggcagcuguauuuuaaucauguaaauuucaugcugccuccuuugccuaccauauagcuucuguugaaauguccauguuauauuuuauuuuauuuacucauuuuucuauauccauaauaagaguuaaagguuauauuuuagcaauguguuuuuuucucugucauaacauguuaaauauuuuaaauucagccaugauguuaaacagagugaauuggaauuucuaacggauuucggcaggaaugauuauauaagacuuagggccaaagagagccugggugacuguguagggguauuaggcuaugcccagcaccacaucugguugucauucaggggagcagcuagggcuggaacugcuggggagugcaaacugcaguauucccuguucccuugucucagagcagaauuguggccucuauccagguccaaucccaguuaaaaaaaaaaauuccaauggucuauucuucuuuugagcuauauuauuguagagaauacugacuugaaaaaacaaagucacuaacuagaaauaaaauuugaacugggugcaguggcuuauaacuguaaucccagcacuuuugggaggccaaggugggaggaucacuugagcucaggaguucaagaucagccugggcaacauggcaaaaucccaucucuacaaaaaauacaaaaauuagcugaagugugguggugugcaccuguaguuccagcuacuugggaggcugaagugggaggauggcuugagcccaggagguggagguugcagugagcugugauugcaucacugcacuccagccugggugauagagccagacccugucucaaaaaauaaaauaaauaaauaaaaaucaaaauaaauaaaauuugaaaaucuuggguaugacuucuuucuuguaccauucaacauucuugauguuuacuaggccaguccaaauaaucuauuucuugugugccuguuuaugucaguuuuuugugacguguggagaaguggaacugggaguaaccaaaucagaaugaaggaagagcuguuugugaauguccauaugacaaaugacaaaacugguuuuccaagagggacagagcauguucaaguugaacauuguaucauauaucauaacugggcaagguugagcuauucagauauguauuuauggauguaauuucauuuacuugacauccuaguguauuguugagaaguuguauguugguaaauugaucaucuuaguuuugcaagagguuauacuuucuuucacucuaauaaggagacugcaggagguuauacuuuuagccuuguguuaaauucuuuguaaagaaaauucuuuugugaauuagaauauaauuuguaaguuuauacugaauuuggagugggauucauugauuuaucauucaaccuuauguggauacgcuguggucaucuuacuagugcagguugagcaaaaggugugugcuugaguuuguuccuguaaaauuuuucaugacagcaccuggagaguggaaaugugaaaaaagaugagcaucagcacuuucuagaaguguuggucuaaguuuucauuuauuuacuauaugauuuugaaugccaucaacuaauacauuuucaauuaucccugaacccuguggcucaguuagugucagugggaguaagaaaagauccacguguccgggaacaguggcucacgccuguaaucccagcacuuugggagguugagauggguggaucacgaagucaggaguucgagaccagccugaccaacauggugaaaccccaucucuacuaaaaauacaaaaauuagccgggcgugguggcacgugccuguaaucucagcuacucaggagacugaggcagcagaaucgcuugaacccaggagguggagguugcagugagcagauaucgcaccauugcacuccagccugggcaaaagcgaguccccaucucaaaaaaaaaaaaaaaaaaaagaaaaaagaaaaagauucacaucuacuugaggccuggaaaauuguugggaaguuccuguacauauuaaaccagauaauguccauucagugguguuuuuauuuuauuuuauuuuauuuuggagacagucuugcucuaucguccaggcuggagugcaauggcaccaucauagcucacugcagccucaaccuccugggcuccagccauccuccugccgcagccuccugaguagcugggacuacaggggccugccaccacucccaacuaauuuuuuauucuuuguagagauggggucucacuauguugcccaggauagucuuaaacuccuguucuaaagcaauccucuugccuuagguucccaaaguacugagauuacaggcaugaaccauugccugcuccuggccaguguuuuugauuuaaaagagaaauacaggccgggugcaguggcucacgccuguaaucccagcacuuugggaagcugagguggggggaucaccugaggucgggaguucgagaccagccugaccaacauagagaaucuccacguuuacuagaaauacaaaauuagccaggcuugguggcgcaugccuguaauccuagcuacucgggaggcugaggcaggagaaucgauugaaccugggagguggagguugugguaagcugagaucgcaccauugcacuccagccugggcaaugagagcaaaacuuggucucaaaaaaaaagagaaauacaggccgggugcaguggcucacgccuguaaucccagcacuuugggaggccgagguccuagaucgcuugagcccaggaauucaagaccagcuugggcaauggugaaacccaucucuaccaaaaguacaaaaauuagccaggugugguggcacagaccuguaaagucccagcuacucaggaggcuggggcgaaaggaucgcuugagcccaggaggucgaggcugcagugagcuuugauugugccacuguacucccagccugggugacagagcgagacccuguguuaauaaacaaacaaacaaauaaaagagaaauacaucuaauaaucugcaucacuuauuugugcuugaaacauucaguguuaaccccacccuuuccuuuuucucuaggcaaauaagggcgagacugaaaaaucaagucacucaguugaaggagcaaguaccugguuucacaccacgccuggcaauauuacagguauuaugauaguguauuuucauuaauguugucuuugcuugauuucucaguaucauuucagaccucucccucuacuuuccuccuuuuuuuuuggcuguuguguaaucucaugccuuuucagucucucuuggcaggcuccccccuuuggcucagcuucuaaauguuggcauauccuggcccucugcucuucucuguggauacccuuucucuaggccagugucucuuaaccuuuggucuuaguagggccccuuuacaaucuuuuuuuucuuuaauuuaauguauuuauuuauuuauuuacuuuugagagacaaggucuuacucuguugccaggcuggaauguaguagugcaaucauagcucacuguagcguugaacuccuggcuucaagcaguccuccugccucugccugccaaagcauggguauuacaggcgugagccacuguaccuggccccguuuacacucuuaaagauguaagaccucaagaagcuauuguuuauacagauuuauccauuaauguuuacuauauuagaaauuaggaaguuuuggccggacacgguggcuccugccuguaauccagcacuuugggaggccgaggugggcagaucaccugaggucaggaguuugagaccagccuggccaacauggugaaaccccaucuuuauuaaaaacacaaaaauuagcugggcgugguggugggcgccuguaaucccagcuacucuggaggcugaggcaggagaaucacuugaacccgggagguggagguugcagugagccaagauugugccacugcacuccagccugggcgacagagagauuccgucucaaaaaaaaaaaaaagagaaauuaggaaguuuuaaaaauguuuauucauuuaaaaaugccaauagugagcucauuuauuauauguuaacauaaauaacauuuuauggaacaaaaacuuuuuuaaaaagaaaauuuagugaaaagaggggcauuauuuuauauuugugcacaccucuuuccuguauggcuuaguagaagagagcuggaguccuaucugccucugcauucagucuuuugcugugugcugguuugauugaaauauauggagaaaauuuggcuucauacagauguguagcuauaaaagggaagaauuuuuuuaacaguccuuccagguaauuguggguauuuuucuuugauguuguaccaggacucaguaaguaaauuuuaaaagauuaguugcaauguagaaucugaaacucuaucagugaacuuugauacuuuguuacaucuucucagacuugcacacuuuguuacaucaaaauguuacauuuggaaugaauauuuaccccaugcaugguuuuguaacauccuuuguuccucauuuggaaaauaauaguucccggaauuaugcagaucuuccaaauguuaacauuucauuaugcaauaugaaagaauuggaaucauuaacaucaccaacaagcucaucagagaaguuuucaaguauugagaagcugucaagcucacagggguggauaaaaaauuuuaauuuucacccaaaaacucacauuuuaucauuggcaacaaauacaauuaauuguuucccuugaaauaccaguuucacuuuauucauuuuugagaaaauauuugucaaauacucaagccugaauaaucauugcuugucaguuguuauuucaaguagguguuucauauaaaaaugcaucuguuucagcuaacaaggcaaaaaagcacaagugcagccuggacaacaaagugagaucccaucuccacaaaaaaauuaaaaaaugagccaggaguggucguauagagguguggucccaacuacaugagagggagacaggagaucacuugagcccaggaagucgaggcugcagggaguuguguucaugccacuguacuccagcuuaggugacagugagauccugucucaaaaaaaaauaaaaauaaaaauaaaaaagcacuaaugcuuuaguaacaaccacaaccacuguacuucuguauauagcagaagugcauuaugagugcuucccaauuccuuacauagacuauuaaaaacacaugcacucaagaguugagguuuauuuauauauauauauuuuuuacuuuuuugggacagaguuuuacuguuacucagugcaguggcacaaucuugguucacugcaaccuucaucucccaggcucaagugauccucccacucagccuccagaguagcugggauuacaggcaugcgccaccaugccuaauuuuuuuuuuugagacggagucuugcucugucgcccaggcuggagugcaguggugcaaucuuggcuuacugcagccuccgcucccagauucaugcaauucuccugccuuggccuccugaguagcugggauuacaggcaccugccauugcacccugcuaauuuuuuuuuuuugaaacagaaucucgcucuaucccccaggcuggaauguaaugacauaaucucagcucacugcaaccuuugccuccuggguucaagugauucucaugccucagccucuggaguagcugggauuacaggugccacgcccagcuaauuuuuguaauuuuaguagagauaggguuucaccauuuuggccaggcuggucucgaacucuugaccucaggugauccaccugccucagcuucccaaagugcugagauuacagguguaagccacugcgcccagccuuaauuuuuuguauuuuuuuguagaguuuuuuuuugccuuguugcccuagcuggucuugaacucugggacccaaagugauccucccauuuuagccucccaaagugcugggauuacaggcaugagcuacugcgcuuggccuuaauuuuuuguauuuuuuuguagagacgguuuuuugccuuguugcccaggcuagucuccaacuccugggcucaaagugauccucccgccuuggccucccaaaguccugagauuacaggcaugagccacugugcucggccaaguugaaguuuaagaaaauuaauaauguauauuucuucaucaagggugguccuagugaaacuggcauuuaguuuuacugggagugugugguagugaaggauaccuugacuacuaguccaaagccauugucuugauuugugcugguucacuaguagucuuacacaccauugcuuuugcaccaucgguacagacguuaacacaaugaaaaaggcaaacaacauuguagugguauuauuaugaagcuagucuggcccucauaaaucuuugaaaaggucuuggggucccucaagagugugugggccacauuaucagaaccauuauuuuaggcaguuucaucuaucaggccagugacuucuaaaucuagauuucuucugagcuccaggcucuuggucugggacaccacugguuuccuucccaccuucaagucuccuuugcuuguuguugcucaucacccuaauaccuaaaccauuugaaugccuugggcucacccuugagaucucuuccccaucuuauucuuucccuaaguaaccucacccagucccauagcuucaugagggaaugcuuccaaauuuaggucucuauccaguauuucuucccugagcuccagauucacccaguagggagauauucaauacauauuuuuacggacaaauguaugaaggaauguuugcaaucuugauuuggaugacaggaaacucacggcuuucauuugaaacucccaucagaguuucacccaaguuggacauagucuccuucucaaucucuuuauuuguaugucuccaauagaucauuuaaucccuugcuaaauuucuaucccuuguucaucaagaaugucaaggugggcauggugcgguggcucaugccuauaaucccagcacuuugggaggcuaaggcggguagaucacuuaaggucaggaguuugagacuagccuggccaacauggugagaacucaucucuacucaaaauacaaaaauuagccaggugugguggugcacaccugugaucacagcuacucaggaggcugaggcaggagaaucgcuugaaccugggggacagagguugcagugagcugagauugugccacugcacuccagccuaagacuccgucucaauuuaaaaaaaaaaaagucaaagugaauaguacuuaaauauuccccucuccuccucugcuguuugucuaagagggcuuagcugagaagaaaagcacagaaggccugucacucucugccuggcauguucucugcugugguggauuuucccuuuuuugcaaauuacuaagaaucaaaaguauauauuguggguguauacugguacauuugguggcugguuauuucuuggcuuauuuuugcaaauuguuuguuguagaaagaguaaaugucauaggcaagaaguauacccuuuuuaaagcaacauuggggguguuuuuuuuccuccauuuuaaaaacugacuuccaaccuuguuuuuuaaauuuauugauuacaaauguuuuuauuacauaaacacuguucuacagcucgucuccuacguccuugcugauaaaacagugguagaaucuuuuaauuuuguacuuuagcaccagagucaacagcuuucugugauacaagguuuauauaauauguuguaaucacaucucccugccucagaccucuagucuuuuucgcuguggugcuggcaccaccaucuucccacauucccugagcuagaagccugaggccgucuccuuaggagcucucuuccucacucccugcauccaguuaggggcuauuguccuauugauugugccucucaucaacucuuggaaucuguugccuccccuugauuccuauuucucccaacccuggggccacuauaguuaccugcuuaaugauuugggguucuaucuauauaccuccugucuguccuccugacugcaauugcaauccuuguuaaaaugcaagucugaucacaaucuauccagccacacucacucuccauccuuuaccagaaugauaguacaaguugaguaucccuuauccgaaaugcuugggacaagaguguuuuagauguuggaaucuguauauacauagggaugagauccaauucuaaagcaaaauuuauuuguguuucauuauauaccuuauacuuguagacugaagguaauuuuauauauauguguguguguguauauauauauauaauaauaauuauuauuauuauuauuuuuuuugagacugaguuuugcucuugucacccaggcuggagugcaauggcacgaucucggcgcacugcaaccuccaccuccuggguucaagugauucuccugccucagccuccugaguagcugggauuacagguguguuccaccacgccuggcuaauuuuuguauuuuuaguugagaugagauuucaccauguuggucaggcuggucuugaacuccugaccucaggugauccgccugccucggccucucaaagugcuaggauuacggacaugagccacugcucccggccaauuuuauauauuuuuaauaauauuuugcaugaaaugcacuuuuaacuguguuuugacuguaagccaucacaugaggccagguguggaauuuucuacuuuuggcguugucagugcucaaaguuucugauuuuggagcauuuuuuauuugugguuuuuuuuuuuuuuuuuuuugagacagggucucacucuguuguccaggcuggagugcaggggugugaucacaguucauugcagccuggaucucccaggcucaagcuauccucccaucucagccuccugaguagcugggacuacaggcauccagcuaauuuuaguauuugagacagaauuucuccauauugcccaggcuagucucagacugagcucaagugauccaccugccuuggccucccaaagugccgagucaccgcaccugacugauuuuggauuuuugaguuagggaucuucaaccuguacuacuuauauagagugucuacaauaauucaaauuguuuguuuauauuucuaaucguucuauguuuuauacuacccuacgauguaggagauguccccuuauagccauaguaacucaugcucaaagaucuuggguagcuugcccaaagccagucaggaagggacugagucugggaaaugaacccagaucugucucuaaaacccauuuguucuuccccuuuguuuuccuaauuccuuagcaaugcauucaagaacauucaugaucuggcccaaguauauauuuaaaaguugaguuuucauuuuuuuuuaauaaaguggaugaguaacuucccaaauaacugaauauuuauaggaaauuaagacuugacuuuucauuauaagagauacuaaugggcuaggcaugguggcucacgccuguaaucccaccacuuuaggaggccaaggcgaguggauugcuugagcccaggaguucaagaccagccugggaaauauagagagacuuugucuccaaaaaaauacaaaaauuagcugguugugguggugcuugccuguaguccccacuacugaggaggcugagcugggaggauugcucacgccugggagguugaggcugcagugagcuguaaucgugucauugcacuccagccugggugacagagcaagacuuugucucaaaaaaaaaaaaaaguuucugguaaggugauagaaauacagccucagccccauagccucauuaguaucucucacucucucucuuuuuuuuuuuuuuuugagucagaaucuuguucugucaugcaggcuggagugcagugaugugaucucugcucacugaaaccucugcccuccccugucccccaggggauccucccaccuuagccucccaaaugagcugggacuacaggcacaccaccaugcccagauaauuuuuguauuuuuuguagagaugggguuucgauauguugcccaggcuggucuuuaacuccugggcucaagcaauccacacaccuugaccucccaaagugcugggaguauaggcaugagccacugcaccuggccaaaaaacugauuuuuaacaguauucgggaacuauucagagugcuuuauguauaguaacucauucaguccucacaaaauacauggacagaauacaguuaauaaacucaacuagccuguaucuucauaagguuuucugaaacagaaagaaaaaugaaccaguagaccaauacccaagauaucuuacgguguagaacacagauuaguaaacuguggcccguauccaaaugcugcccaguuuauaaagaguuaaaaaagcaauagcagcagcugcugugacacgguaugugucccacaaagccuaaaauauacaccgucugccccucuacagaaaguuugcagacuccugguauaaaaaaaaagugucccuaaccuguucuggaauaggaucuuuuuuggaugauguaguacucagccaccuucaaggagaaaucagcauucuuuuuuuuuuuuuuuuuuuugagauggaguuucacucuugucgcccaggcuggagugcaauggcacgaucuuggcucacugcaacuucugcccccgggguucaagggauucuccugccucagcuucccaaguagcugggauuacaggugcacaccaucaugacuggcuaauauuuguauuuuuaguauagaugggguuucaccaucuuggccaggcuagucucgaacuccugaccuuaggugaucugcccgccuuagccucccaaagugcugggauuacaggcgugagccaccaugcccggccagaauacacguucuuuaaacauucuuuuugcaucuagucuaucaaugguucuauaaccacuuuccccuauaaaaugccuauacuggccaagugugguggcucacaccuaccuagcacuuuggcaggcugaggcaggaggauugcuuaagcccagguguuugagaccagccugggcaauagagaaacuccauuucuacaaaaaauacaaaaauuggcuguuuguggcagcguguacugguaguccuagcuucuugggaagcugaggugggaggauugcuugagccuaggaguugcaggcugcagugagccaugaucaugcuacuguacucuaggcuggguggcagaguaagacccugucucaaaaauaauaaauaaauaaauaaaaccuauacuaagagugacucuuugaauuggcuuuuagaugucuuuuccaauaaaacuuugacauacgcucauaacuauaacuauuaaguuuucuuucuggaacugguuguaguuuuaguguuuuagacaaacuccuucagaaauauucaggccgaaaauaguuacauguaaaggaacaacaacagcgagagacuucagacuucuccugugugacauuagaugccaaagacaacaucuccgaaggaaaaugcugucacuccaaaucaggcaaggccagucaagugcaagggacagcagaaaaauauuuucaguuauacagacuuagaaacauguccaccuaccuuuccuggaaaacugacuuauaaguuacauuucacuuacuugaaacaugaaugaagauaaauucuagaacagagaaguuguggcuuccuuacuggcagcaagugauaaaacaauuuaaucucagaguuaagacuaaauaacuagugguagguauaaauaugaaugaaauuguaaaaaaauaauacuuuuguauuuagaaccaccuccuuuccuacuuugaucuaaaaauuccggaauguaucaaaucugguaacugaaccagugaggguugggugguggggcaaagaacauacauagaaagugaccaaagaggaaacaugagaggcacgaaaagucuagggaagccccuacgagaagcaucuaauguacuuagauacaaauaacccauuaaaaaaaaagguagaauuccccucaaaggacucuucuggcucuugcaauucaaauuagcaccacaaaacugagaacugucuguauaagggacaacugaagcuaagauucaggccauguccugagaucugaggagagcguccaguaauagcaccaauaugacaagcucagaaaauccuguguuacaaaagccggcuucuuucucugccaugguccuguuaaaaggagcugugcuucaguugucuuugauaugaagggaccaccaccuuucccucugugauacccucugcaauucugggagaaacacaacuuaugguagcauguaucaaccuugagaaggagaaauaccaaccacuggagcaugaaacaauauuaguacaauaaaauuuuacaaauaaaugguuauaaugauaaacuauaaauauguucauggucaaagaaacagagggaacauagugagacacugcauggugguucaaaggauuuagccucugcacuacaaguuucucccugucucucucuuuuuuuuuuaagagacaaggucucucucuguugcccaggcugcccaggcauaguaccaugacucacugugcacuggugcaaucauggaaaaacucuugaccucaaguaauccucccaccuuggccuccugagugcugggacuacaggcaggcaccacuaugccuggcuaauuuuuuguaaagaugggggggggggucucacuauguugcccaggcuggucucgaacuccugggcucaaacgauccuccucccuuggccucccaaagugcagggauuauagaccugaguugcugcacccggccuccucucuguguuggggccagcagauugcccuuugucuugccuggcuguuuauucuguguaaacuagagggagguccuuccacccuccuuucuauugucuguguggcggggccagggagcuuuccauugccccugcgggugggggagaggguguggaaugugcccucugggugcuccugccucucaggcauuuuucuugccugaugacaguuucucagcccuccauacucuguuuuucugguauggcagcagaaaucccacauguuucuaguaggccugcagcauccuugcuuaguuuccagugcagaugcagauauccucuacuuucuguuugggguuuggcagugggaaccaggugggccuuguuuaggggaggggcuguaacaccaucuguguucacauaaucccuccugcccccacagccucccuauacuccuguaaaaguucucugcaacaagagucgcaugauuaaacauuucuuuuauuaaaacuaaaauuguagaagcuuuucugugcacuuugccuuucccuaaucaucugauuugcaugcauuuauuauucuagguuggcaacagagaugauuccaaucuuuauauaaaugugaagcugaaggcugcugaagagguaacgccagaagagcugugccaucacccuccccaaccuccaccuggguccuaucgauuaccccuugcccuuuuugguccucccugugaaaacuuuuaucacccacaggagacauuaguuuaucuauuuuguaagucagaaauggguggguuagaucuguggccucugguuugcccgugaguuuuuguuuucucauuaaugauuuucuucccaaagagcaggaugucaauugaggaaagugacaagucucgaucauuuuaggagauuuauuugccaaaauuaaggacacaccugggagacaggucuauaccuuucuccgaagaugauuucgaguucuccaaauuuaaagaggaaaggguggguuauugaaaaguacacguuuucauguaagagguggguagggaaaaauagucauucaugaccuucucuggcucagugaaucugcauuuuuuacauaagaugacagauggccggacgcgguggcucacgccaguaaucccagcacuuugggaggccgaggcgggcggaucaccugaggucgggaguuuuagaccagccuaagaaacauggagaaaccccaucucuacuaaaaauacaaaaaauuagcugggugugguggcgcaugccuguaaucccagcuacucgggaggcugaggcaggagaaucgcuugaaccugggaggcggagguuguggugagccaagauagugccauugcacuccagccugggcaauaagagugaagcuccaaccagaaaaaaaaaagacgauauagacaaguggggcagaggaaaaaugcaggcaaucugcauuuuacauaagauaacauagacagaauugggcaggggaaaaaucagauauacauuugugucuggugggcuggggggauuuacauugccauggugaaauuuuaacagaaacaucauaaagauguugcagcucacuacgaauuucuuugugggcaaaauaugggggaggcauguagcuuuucaucuuguaacaucuuauuuaggaaccaaaaagggggaggcagauuugcaugacccaguucccagcuuggcuuuucccuuugacuuaaugaauuuggggucccaagauuuaauuuccuuucucaagaaauagcaagcaugacauugcugaagugcagugguggcaauuaacaagugaaugaugaauggguugaagugagggacucauucuucagaacauauaagggugaaaugaugaccaacaccuccuugcuuguuagucaugucuguaaaagaaaugguucaauaucucaaguugucuugccauuuaccugcuuuuaaugucuguuuugcagauugggaucaaagccacucacauuaaguuaccaagaacaaccacagaaucugaggugagcuuuuaugaguugauugugaagagggaaggugaagugguuuccucucugguuuugguuuacgggggcuuuggggacugacacauuuagccaagaccuccagguauuuuuuuuuuuuuuuuuuuugagacacaguuuugcucaugucacccaggcuggagagcaaugaugcgaucucgacucucugcaaccuccgccucccagguucaagcaauucuccugccucagccucccgaguagcugggauuacaggcgcccaccgccucaccuggcuaauuuuuauauuuuuaauagagacgcgguuucaccacguuggccaggcuggucuugaacuccugaccugaggugauuuacccgccuuggccucccaaagugcugggauuacaggcgugagccaccacgccuggcaccuccagguauucuuucuucacagacucccacagaggagauggugcagggaugaacauuugguacucaaagugugacugcaguacuguuugcuuccaaaucaucuguuguguuuguuaaaacugauccuuggagccaggcacgguggcucaugccuguaaucccagcauuuugggaggccgaggugggcagaucaccugaggucgggaguucgagaccagccuggccaacauggagaaacccugucucuacuaaaaaauacaaaauuugccaggcgugguggcgcaugccuguaaucccagcuacuuggaagguugaggcaggagaaucacuugaacccgggaggcggagguugcagugagccaagaucguaccauugcacuccaaccugggaaaaaagagcaaaacuccgucucaaaaaaauagguaaaaccgauccuuggccuguaauuaucugcauucuaaaaaccaaauauguauuccuuuuauaugagguucaggacuaggcagaacaaaucagcggugauuaaagucagaacugugguugccuguaggugggagauuaaugcuaaacuguaggaggauaaagcaacuuucuugagguuauggcaauguuccauauaugcgcuguccaguaugggagccacuagccccaugaggcuauuugaauuuaguuaaaaugaaauaaaauuaaaaauucacuuccuugguuguacuagccacuuugcaaggauuaaguagcugcuauuguauuguaaggugcaaauuauagaaaauuucugccaucgcagaaaagaugauuggacauugcugcucuacaucuugauuuggaugauuguaacauggguauuauugcuguaauaaguuauuagaguucuuagcucuuuuuauuuuauuguauuguauuuuuagagacagggucucacucuuuugccucagcugcagcacaguggugugaucauagcucauuguagccucaaccuccuaagcucaagugauccucccaccuuagccucuugagcagcugggacuauaggcaugagccaccaugcccagcuaauuuuauuuuauuuuugaggcagaguuuuacucuugucgcccaggcuagagugcaguggugcaauauuggcucacugcaaccuccaccucccagguucaagcgauucucaugccucagccuccugaguagcugugacuacaggcaugcgccaccacgcccagcuaauuuuuguauuuuuaauugcccauauugcccaggcuggucucaaacuacugaccucaagugaucugcccacucaagccucccaaagugcugggauuacaggcgugagccaccgcaccuguccccgcuuuuuuuuuuuuuuuuuuuuuuuugagacagagucuugcucuguugcccaggcuggaugcaguggcaugaucucagcucacugcagccuccgcuuccuggguucaagcgauucucaugccucagccuccugagaggcugagauuacaggcaugcgccacuaugcccggcuuauuuuuuauauuuuuguagagacaggguuucaccauguuggccaggcugguuucaaacuccuggcuucaagugauccaguagcugcuauuguauuguaaggugcaaauuauagaaaauaauuuucuauauuuugggaggccugccuuggcuucccaaagugcugggaugacaggugugagccaccacacccagcccuaauuuuuuuuuuuuuuuuuugagguggaguuucacuauuguugcccaggcuggagugcaauggcacaaucucaacucacugcuggagugcaguggcacuaucucagcggacugcaaccuccaccucccagguucaagcaauucuccugccucagccucccgaguagcuaggauuacaggcaugugccaccacaccuggcuaauuuuguauuuuuaguagagacaggguuucacuauguuggcccagcuggucucaaacucccaaccucaggugauccacccaccucagccucccaaagugcuggaauuacagucgugaaccaccgcacccagccccuggcccuaauuuuuaaaaaguuuuuguagauaucacauuucacuguguuguccaggcuggucuugaacuccuggguucaaguaauccuccugacuuggccucccaaagugcugggauuacaggcaugagacaccucgcccagccucuuagcucuuuuauuugauggacuucuuaccagacaccuaggggaugcauucuauguuaaaguacaggugcucucaggauucaaggggaagguacauucugaaaggacuauaauuaaaguguuggggggaaauagggcaaccuaauuuuugccuuagaaaguguuucuuccuaccuuuugauuucugugugauauacaaauuauauaugguauuacuuuuaggugaugaaguacauuacaucuuugaaugaagacucuacuguacauggguucuuagugcagcuaccuuuagauucagagaauuccauuaacacugaagaagugaucaaugcuauugcacccgagaaggauguggauggguaaguguggcuuggcuuccuaugucucauugcaugcuuucauuuauaauauguuucuauuuggggaauacagcauaaauguuucuaaagaguaaagacaucuaauugccuuuauuuccuucuuauuuccaucacuuuuuuaagauugacuagcaucaaugcugggaaacuugcuagaggugaccucaaugacuguuucauuccuuguacgccuaagggaugcuuggaacucaucaaagagacagguaaaaacaacaaaccaaacaacaagaaagcaccauuuccugaauccuggucuugacaugugguggcauagaggagguacauugugggccauaaauaaauggacuugauuggcagaagggccugucuacuaaggauguuaccuaaauuuucucucaauuuucucagcaacucugugaaguagguacuguuauuguucaacugcuaagaaaauaggcucaggccaggcacagcggcucaugccuguuaucccagcacuuugggaggcugaagcgggcugagaucaccugaggucaggaauucgagaccagccuggucaacauggugaaacccugucucuacuaaaaauacaaaaaaauuauccaggcaggguggcaugcaccuguauucccagcuauucgggaggcagaggugggaggauugauugaaccugggaggcggagguugcagugagccgagaucaccugacugcacuccagccugggcaacagagcgagacucugucucuaaaauaaacaaacaaacaaacaaacaaacaaaaccagcucagagagagcaaguaacuugucugggagacaacggaaccaagauuugaauucagaguuaucugaguucaaagcaauuuauuuuaaccuauacaguaauaaaaauuuggauaguuuaaaaggauaugaagugaaaagccccaccuccccccacccccaaaaugggcacugaaucuccacaguaguuccaggacucgacagauggcuggaaaugggucuccugcacaguuggccauauugucccguuacuaguuagcaccuugcuauuuuaauuucauuaugaauacuuuuagcagagguuauuuuuuacaaggaaauggguccugguaaaaagaaguaggucagaaguuucaaguggaaaguuuuggccagcauaaaugaaaauuuucugugguuggcaagaaaaggucaaaggucaagcuuugacaguucauuucuacaguuaaauguauauucuucagcauauuuagcaaacauuguagugccuugcuuaaaagaaaaaaaucccacgaggacagcaccugaaggccucccacugccucuuauugagugaugcuaccauuugcccugaugcagcuuuaacucuucugcugaauccuaaaaaguauagaaaguuaccuuuuaaaacuuugaggucuuuacuucuagauguucaugauguucacauuauuauaagaguuuaucuuuuucugaaaaaaaaugauuuuaugcgagaagcacaauuuaaacccuugcugcuuugagcaaggguccacugcccucagccuugacugcccugaggacucugaugaagucgucaacuucucucugcuuucuucuuuguggacagcucauuuucgggcuccacuuuguggccacaaacaccuacagccugguuccauccucaugccuaacagucaugggauuggaucuuaucagcugagggaagaaauaugguccccuguccacuacuggguacucacucaggcugucuuuaguagaguaugagucagcccugaaaaggacauugguauauugccagaaaaauggaugcugugauagcaaaaagaaagcuuugcugccacaguucaauuuccccuuuaucacuucccugcaaguaacccuauggcucaggcccuaagccaaaagagaaauuugggugaggaacuguauaaacaaacuuaccaaaguuagaaggaauuaccgauacuaaucuaauuucuuacacaucucuccagccuguuacauacacccuauuuguuuuaacuuuuuuuccccauguaauuuaaucugaugucuucuuccguauggcugauuagcuguaugucaggguuucuuuuuucuuugaguguagguuuucuucccacuccccuaugacucaaugaaugaucuuggcuuaagcugcucccaaaaacccacggccagaaggacacaaguacaagucccaauuuauagcugaaacccuagaguugagaauauuauugccaaagaaggaaugcuuuuaggaagguuucuguuugauguuaagaaccuguuuuugugcacuuauucuaauuucuccacguggcaugcgaaggagggcagcuucuauccuccaacucugaugcaggcuggcuuuucuuucaggggugccgauugccggaaggcaugcuguggugguugggcgcaguaaaauaguuggggccccgaugcaugacuugcuucuguggaacaaugccacagugaccaccugccacuccaagacugcccaucuggaugaggagguaggguguccagaggagagguaaagguguuacgguggggagggugggugugccagaggcugccauguccuuuacacucaugaccucauuuaaccccaucaucucauuuuuacaagaugaaaaaacaaauucaaauuaaaggcugagugggguggcugacaccuguagucccaacacuuugggagucugaggcaggaggauuguuugagcccaagaguuuuugagaccagccugggcaacauagugagacgcuuucucugcaaaaaaaauuaaaaauuagccagauggggugggcacaugccuguagucccagcuacucgggagguugaggcaagaggauugcuugagcccaggaggucgaggcugcaguaagcuacgaucacaccacugcacuccagccugggcuacagagcaagacccugucucaaaaaaaaaaaaaaauuaauuaauuaaaaaaaacauaaaauuaaaagcaugcugaaguuuauacagaguuuguucuguguacuuucucucuuccuuuuucuuuuuucuuuauuuauuuuuuuugagauggaguuucacucuuguugcccaggcuggagugcaauggcgcaaucucagcucaccacaaccucugccuccuggguucaagugauucuccugccucagccuccugaguagcugggauuacaggcaugugccaccacgccuggcuaauuuuguauuuuuaguagagacaagguuucuccauguuggucaggccggucuugaacuccugaccucaggugauccaccugccuuggccucccaaaguacugggauuacaggcaugagccaccaugcccgaccuuugucuuuuuucuuuugagacagggucuugcucuguuauuuaggcuagagugcaguggcaguccaugagagcccacugcagcuuugaacuccugggcucgagugauccuccugcaucaaccuucugaguagcugggacuacaggcaugugccaccaugccuggcuaauuuuuaagcuuuuuguagcgacaggggucucacuguguugcccaggcuggacucaaacuccuggacucaagcgauccuccugguucaccuuccuaaagugcugagauuacaggcgugacccaacaugccuggccucucaccaaguacuuucuacccuaaucugccucgugguggacagggauuagcaguacaggcacucagauugaccucuggcagccagaucccauguguguaaaagugguggccucagagugaaggugcuccagaggcagucgugggcaguagucugcuaauagcuauggcagcuuguucuagaucccugcaucagauuccugagcccaagaaugcgcacacacacacacgugccuguugacagugcagucucuuaaauguggggagagagcaggagagaggccuaguacuuucucuuuuaauccucccaaaguagugcucuacauucuguaggagaaggagcagugucuggacauaacacgcagggccccaagccuguuugccccucugccuugcagguugacacugauuucccuauuggguaaaauggcuggugaaagggagcucuuuggcauguguagaaaugagcacggcaugugaagggcugucagaaacaguguguggcuuacauuugaggccuuaacccaauaucuuaugaaauagcuuaugacacuuaagaauuuaauacaaagcucagggauauccuuuucauuucuggguuuuuuuuugguguguauuucauuauuucauuucugauguccaaauccccuaccccuagguaaauaaaggugacauccuggugguugcaacuggucagccugaaaugguuaaaggggaguggaucaaaccuggggcaauagucaucgacuguggaaucaauuaugucccaggugaguguuguuggaggaguaagguggcugcugguauugaggaugguaucuaggucaucaaaagaagccugagagagaagcuugucucauuuuaugcuuguaguacuaagguuuaggagacugacuagcccaagggugcacagaguuaguagauagaagaguugccacuugcaggcaggucugccuggugccagagccuuugauuuucaucaugugcuguacagcuuccaagaugacuuuguccagggagaaagugagagggagggcaggagggauauaucacuuuaucuucauguagagaucacccuuuauuuuagcaaaguugauggauggauuuaaaauacaguauaauuauugcaaagugcuaugagaguccagaagagggacucauucugccaagaggagggcuuuacaaagaagauauuugaccuggguuuuuuucuaggcugagaggauaaaucuagccuuuuaaucauguccaaaacuguacucggcauccucauccccaaguuaccccuuacucccgucuuuugguuaguaucaccauucuuccuucccgcaagucugaagccuuuuaguuucccucccaagcauucccuauauuggaccagucucuaaauauuaggaauuguuuucucucuccucuguucugagugucaccacugaguguuaccuucucagcugaugggcugugauaacuuccuugcaggugucccucccuccagcugcuucccacucagaucuauccccgugcucucgccuugccacguucaccuucuggcauggaacucugagccucuuccuucuuacuugccagacuccuuagccucacacuaauuucagugaccucugcagccugugaucucacuugcgcauggugaauaccugucuucaacuuguaaaguggaccacuuucccuucccugcgcaugccucguuugcccuuuguaguucccucaccugcauucuuaguggagugggcuacucuuucaaacagaaaacuucacagaacaauagggcaaaacuugcguacguccucauagauccaagaaaggaacaaucuuuaacggagcaacuacuguguauccagcacaaugccaggccuugggcuacacaacugaauaagguucaacuucaccuucaccuucagcugcuuccuccccaucuccucucugucaugucuguuauuccuuccaaaccuuguuugauuuccccuuaucaagggaugaucuuuccuucucucccucccuccucucccauagaacauguguauuguaucuuuuguugcaugugucucauguacggcguccugugcucuccugccuagauagcuccucaagggcaguggucacuguggcgccacauccagcuuccugccaucugaccacuggcacucauaucuauugaauugucgaagggaguuauagcuggaagucuuuuuucucccuucccaucucaaguuucagauguagacgcugagcugccaggaacauuagucacugucaagccuucaccguuuuuaaccucccucccacucucccuaccgugcuuuuaagacaguagcucauaauugaucacucauuuucuuguaguguaauuaucuaacaggcgauaaagaaauugcucuccuacaacuccucacuuugaauacuugcgauaugacauucaagcucagucuuuuuauuuauuuauuuuuuuaauuuuuuuuuuuuuucuugagacggagucucgcucuguugcccaggcuggagugcuguggcgcgaucucggcucacugcaagcuccgccuugcggguucaugccauucucccgccuccgccucccgaguagcugggacuacaggcgcccgccaccacgcccggcuaauuuuuuuuguauuuuuaguagagacgggguuucaccauguuagccaggauggucucgaucuccugaccucgugauccgcccaccuuugccucccaaagugcugggauuacaggcgugagccaccgcacccagcaagcucagucuuuuuaaaaccucgcaucuucuguaucauauuucugcuuuuggcauuuuuuuuuuggauuacaugugagaaauggagaagaaaaaccugaguggggaucuugaguguugcagauagguaggaaauguugacuuaaacaugaaacuugccauccuuuucacauugauuccuuauguagacaauaaaauaugaauaaaaucaaagcaguaucuucccuucuggucaacaguguuuuuacugaucuugggcauauaggcaaauuaaugcugauacagcuggauguuauuguguuccccaaaggauggcagaaucacucaguuacagaccagcaaaugggcugcaggaccuaaagacugauauuugcaaauguucacuuuagaagcaaacuuuucuaccaccgagcuacuucuugguucauauuuugauuauuuaaauaguuugcaugguccacucagggauaacauuguaagucacuugccaaauuaagaaugaaucaagguguguauaccuuuuacaaagaaguaauauuuuuaaagauucaagugcagggcagaaaguauuggccagagaaacacauaaaagugcucuuccugcuuggcuuacuaaagauaaauugagaagggccagaucaauaguguuuuauuuggaaggguuaaaaagugggaacagauuccccacccuaaugcaauccagucucaaccuauccaguguagcugcuucuggacuggccucuauuauuaggguccccaaauuaaauguagaagagucagggcucagcuggaucuuuaguugauuuuuguacaugugauuucccaaagaaagagaaauucuagggcuggggguagauaaccaaaagguuugcucauuacugaggucauaugcuuaggcugaguaguggucacuuuuuccacugaccacaucauccuauccacgaagcacugcauguuuagcagugucucgucaacccugacaguauuugguuuaggagcaaaacugaacucaccagugcugcguuuagucauguagucaaagauaugugucucuuaccugugggaaaacgaaaaugacuaacauuaacacguagaaauagaugcagcggguauuucaagcuaacuacagugugaagacgauugaaacuuguacagagggcaaaccucuaucuauauuuccuuggcauuuugaaaugacucuaggggcuguaagaggaaauguucugccaguuugcugcuuuauaaucuucuagaaacuugaaaccaucccaaugaguuguguugaccagcuccuuuuacuccauauaaaaaauaucuuacguaucugugguggaaagagaaacucuugcguuuggaggcugcuuuuucaauuucaguaauguacacauuuucucauuuugcccucagcaaauuugugauagguaguguuaagccuucuuugcauuuuggacuucagauuaauauggagcccacaggagcugcagaacuaacuuuuuuuuuugagacggaguuucgcucuuguugcccaggcuggaguggaaugcucacugcagccuccgccucccggguucaagugagucuccugccucagccucugagcagcugggauuacaggugcccgcuaccaagcccagcugauuuuuuaauauuuuuaguagagacgggguuucaccaugcuggccaggcuggucucggacuccugaccucaggugauccacccgccuuggccucccaaagugcuggcauuacaggugugagccaccacaccuggcccuaauuuuuaauaaaagagcugaugcuacagcuaaucucuuuuuuuucugagacagagucucgcucuguugcccaggcuggagugcagugacgcaaucuccgcucacugcaagcuccgccccccggguucaugccauucuccugccucagccucccaaguagcugggacuacaggugcccgccaccaugcccagcuaauuuuuuuguauuuuuagcagagacgggguuucacuguguuagccaggauggucuugaucuccugaucuggugauccgcccgccucggccucccaaagugccugcuaaucucuuaauucuggcuucuugccuccaccuuggagcuucuucucaguuguggcgaucugaucagagagaaguggugaugucgcuaaaacuaccagaugcagcgcgggagccuuauugcuucgaggucuaggcccgcccccagccccuccuggaagugcacugaagccaaguguaggauguucuuugugugagugagcaaugaugcaucauuggguuuuguucucuugaauagcuauucuuugcugguaagauuuguaguuguucuuguguccuuuuaagggaaguguaauuauauucuuugccuuuagcauacauuuaaguagcugugucuuuggaauuggauguugaauuguuccuccagcucacacauggagcucacaaaaugcugacaguugcuguagaaacgauaucuggcagcugugacagaguuggaucuuugugcacccaaaaaauuuccuuuguaggcuuuagcaaauuaacauuuuaaaaugggugcucauuauauacuggguaguugguuuuaagaauaaaaaacaguugguauuuuauuugccaccugagagacuacaaaaggauucuccagguucuguaaaaccacuuaugcaucuugugaauuuuugcagguaaaauaauuuucucccuaagaaauagcaaacaucugucauuccauagcuuuuaaguuaaguaggcacuggagccugaugggacuaacacacccuacaauucugcugaguuuuugucguaacugaucaccaggacugugauucugagacuuaguuuugauuucucccccacuugaccagaugauaaaaaaccaaaugggagaaaaguugugggugauguggcauacgacgaggccaaagagagggcgagcuucaucacuccuguuccuggcggcguagggcccaugacaguugcaaugcucaugcagguaauugugaauaaaaguuucuauaagaguucugaaaagcugaucgaguuuuggcugcuuuucuccccaaguagaaaugucaaaaaccuacucagaaguaaagaugugaauuuauugagaaaaagggaagggaagaauagagaaauaagaucaggcacauuaauagaggaaaguagggauggcauaauuccagucuguuuuggaauauaauaacuuugaaagaagaaaagugcgaucacacuggcuuggccaggucuguuuugguuugccuucccuuucuuuuuuuuuuuuuuuuuuugagacggaguuuugcucuugcugcccaggcuggagugcaauggugugaucuuggcuuaccgcaaccuccaucucccugauucaagugauucuccugccucagccuccugaguagcugggauuacaggugugcaccaccacgcccggcgaauuuuguauuuuuaguagagacagguuucuccacguugguuaggcuggucuggaacucccgaccucaggugauccgcccaccuuggccuuccaaagugcugggauuagaggugugagccaccgugcccggccuguuuucccuuucuaacaugcaccagcugacaggggccaggcgagcagccccaaagcauguuaggugccucuugacucuuagcuaggauugaagcaugguaauaagugggucugaagcaguucauuuugugauugaacuggagugaccuggagcuugaaacugaggugaggauuaaaauaaccaccucuucuaaguuucauuuauuucauuuugcuuagagcacaguagagagugccaagcguuuccuggagaaauuuaagccaggaaaguggaugauucaguauaacaaccuuaaccucaagacaccuguuccaagguaaaaauaaaguuuuacugauuuaaaacuuugugaauuguugguuuuuaguugacagauacuguggguucacauaugcucccucugaaggugccuucagugguugggguuggguugggggcuuguuacuacugugggauuaauuaaacucaguggauaaacauuaauaccuauuuucuauguuuccaaagugacauugauauaucacgaucuuguaaaccgaagcccauugguaagcuggcucgagaaauuggucugcugucugaagagguagaauuauauggugaaacaaaggccaaaguucugcugucagcacuagaacgccugaagcaccggccugaugggaaauacgugguggugacuggguaugcuuuuuauucauguugccauccaaaucuuaguaucaguccugauacuaaggcguugcauuugcacuuggcacauguauguagaggugccuuuaauuugauuuuagcauuuucacccguauuugaucucauuugauccuuacagcaauccugagagguagguaagaauagauuauaaucauagaugagaaaauuggucaagguuauccaucuaguaaguggaagaguuuggucuuaaaacccggucuuaagauagaaucaccuuuugcuguuguuguuguuguuguuguuuugagacagagucucgcucuguugcccaggcuggagugcaguggcacgaucucggcucaccacaaccucugucucccaaguucaagcgguucuccugccucagccucccgaguagcugggacuacaggugcaaggcaccacacccagcuaauuuuuguauuuuuaguagagaguguguuucacuauguuggccaggcuggucucgaacuccugaccuugugauccacccaccucagccucccaaagugcugggauuacaggcgugagccaccacacccggccagaaucaccuuuuugaacccaaaauucauuaauucgauggauuuacuaagcauucauuuuuauugcugggcugagguuauauuaaaaagcuaguuuuugagaauauaaaaugagaaauuaaaauuauagccgugucucuacaagauaaaguauauuugcuucuuacagcaagaagagcuaaaauacaggaaucauuuuuuuucuuaaaguuuuuuggaaauuacaacuaagacuuuugaaaaagauaucuuucagggcuuuugucuuucuuuuucuuugucuuuucuuucuuuuuuuuucuuuaagagauggggguuugcucuguugcccaggcuggaguacaguggugcagucauagcuuacuguagccuggaacuccugggcucaagugauccucuugccucagccuccuauauagcugggacuacaggcauacacugcuaugccugacuuugucuuucuuaaucuuuagauuacgagucauucucuaggaucugcuagguaugacuuagugauucagauacacuuaauucuuuaaaccuuuuucucuuuugcuuucgucuugaagaauaacuccaacaccccugggagaagggaaaagcacaacuacaaucgggcuagugcaagcccuuggugcccaucucuaccagaaugucuuugcgugugugcgacagccuucucagggccccaccuuuggaauaaaagguacuagugagacuggaccauggguggugacaggggaccugcuucuccuucaguccucccaggcccacgcaaccuaugauacuuauggggucuucaacucauuucaacaccaggaaugucauucucacaaaccucuguagucaugcuuuugaugaaggcugucauuggaucuccccagcuccugcugucacuguuggccacugcacagggauucucugggaugggugauauguagcuggaggugcuuuuauuugacccucauaguccacugcuacaguaaccauaaagguaaucauagcuacugaucaucuuacagacacucuagagacaaugacaaaccccacagauguuucaccuuguugggaauaagaaaagccuaccuuuauugaauauaugcuuugugccagauauugugcugagcaguuuuugcauauuauucuaucauccaguacgagauaguauugucaccauuuuaaaauagcagcaacugggacuucagagguggcuuggucaaaggcaccuguauuaaguaccagagugauucuuccaugucuauuucaagcucuaaauuacuaccauacucgcacuuuaccuucagauuuuuauugcugcgguacuaagaacauguguuuuuuuuuuuuuuuuuuuuuuuuugagacagggucucacucacucugucgcccaggcuggaaugcaguggugugaucucggcucauugcaaccucuccaccuucuggguucaagagacucuccugccacagccucccgaguagcugggauuacaggcacgcaugaccaugccuggcuaauuuuuguauuuuugguagagacgggguuucaccauuuuggccaggcuggucuugaacuucugaccucaagugaucugccugucucagccuuccaaacugguaggacuauaggcaugagccaccgugccaagcugcugucuuaauuaaaauaauguuuauuaauuaugauagguucuuagaguuagcuuucucugcuuggugaggguaucacauuuugcuuguucuagcaauuacuacaaauguugacaccgggaacaccuucacccuuccaccuuuuuuuuuuuuuuuggagacacagucucgcucuguugccugggcuggaguacaguggcacgaucuuggcucacugcaaccuccgccuccugguuucaagcaauucuccugccucagccucccaaguagcugggacuacaggugcgugccaccaugccuggcuaauuuuuguguuuuuaguagagaugggguuucacuauauuggccaggcuggucuugaacuccugaccuugugaucugcccaccuuggccucccaaugugcugggauaauaggcaugagccaccgugcccagcccacccuuccaccuauuuuauaaauguaaucacuuuguucugcucuugagcuugucuuaacccccuuucaacuucagcacgagcuauuccuuguucugcuuauugaacccauuauuuuccuuuuacucuuacugcaaauugccucacugcacggucucugccucacaaaaacaaaauacauauuaauauaucucugggcugggugcaguggcucaugccuaaaaucccagcacuuugggagggugaggugguagauuacuugaggccaggaguucgagaccagccaggccaacauggcaaaccccgucucuauuaaaaacacaaaaauuagcugggcauggugguaugugccuguaaucccagaccauuacccuccagccugugagacaguaugagacucugucuaaaaaaauauauaucugauuuacauuuauugcacugauaaugugguaaccuggacuuuuuuuguuuguuuguuuguuuuuuuugagacagagucuugcucugucuggagucccagcucaggcuggagugcaguggcaugaucauaacucacugcagccuugaucucccaggcuaggacuauaggcaugagcagccaugcuugguguccugaacauuuucaacuggcuuuuggcuaauacagauugagcaucagaaaucuagaaaccugaaaucugaaaggcuccaaaauucuaaacuuuuugagugcugacacgaugcucaaaggacaugcucauuggaucauuucagauuuuaaauccuggauuugggaugcuggaucaguaugaugaaaauauuccaaaaucuggaaaacaaaaacccaaauccaaaacccaaauccaagcauuuuaaauaagggauacucaaccuguaauccaaguagcccaaaaaaaucuagcaauuaggcugcuuucuaacagccuaaucuauuuaucucuauuuaggaaaaauuauagucuuuuuguuagguguauguauuuuaaauauuucuguuuuaaaagccaaaguagcuuuaugagaguaggaaauugaacagguugccuuuauguaacugucagcuggguguuuuaacaaaugccaguaauuacaaggaacauauuucuaaagauaaugaguagguauauauuuguucaugguuuugucauuuaaacucagauuucaauugagagacuaguauuagaaaacacuugaucaaaacuguccaaaugauucuaaaaaauaaauaaauaaaugugcuuaguaguuacaauaaugcauuugcauuuauuugauuucuaagucauuggagaagcaugcuuaacugagcuuccacccuugaccuguccccuagguggcgcugcaggaggcggcuacucccaggucauuccuauggaagagguaaaguauucugggauuuggcugaauuagaucccccuuuuuuugucgggggggagggugcugaauuagcucccuuuuuuuccccaugacggagucuugcucuguugcccagagcuggagugcaauggcgcaaucucggcucacugcaaccucugccucccagguucaagcaacucuccugcgucagccucccgaguagcugggauuacaggcaugcaccaccacgcucagcuaauuuuguauuuuuaguagagacgggguuucaccguguuggccaagcuggucuugaacuccugaccucgugauccgcccaccucggccucccaaagugcugguauuauaggcgugagccaccgcacccagccuagauucuuuauuauagcuuuuucucucuggagauuagccuuuuuuguagagcucuuagcggacaaaugacuuguuucucagcaaaagcaacaccuagggggaaaacaacuuaauuugcagacuugugauacagcuugguuucaaacuuuggcuuucagugggaaugauuauuauaagcaaaugaccaaaugaagcaugguaucgggaagcaccaacacacagcgauuucagaauucauuuauguaacugcagaaauuggaacauuacauagacauagagucggugcugcucccgugcacuccuccucgcuguuuugagguguguccucaguaacccaguguggcuguugaucccaguggugugguauuuguggucucuggacaucucauuuuggaaaaacugcaaguucuguauuugggaggagauucuucuguggacagauaauuagucuuuuauguuuucuuuuucuuuuucuuuuucuuuuuuuuuuuuuuuuaagacagagucucacucugucacccaggcuggaguguaguggugugaucuugggucacugcaaccuccaccucccaaguucuccugccucagccuuccaaguagcugggauuacaggugcgcacuaccacacuuggcuacuuuuuauguuuuuaguagagaugggguuucgccauguugcccaggguggucuugaacuccuggccugaagugauccgcccgccucggccucccaaagugcugguauuauaguugugagcuaccacacccagccagucauuuauguuuucaagaacucccuauauuggguguuuguccacuaacugggcugccuucaguauuccauuggcuuuaaaauagggauugagcuuugcaauagaaugaaaguuggaaagauacagagcagcugggagacuaauguggcuucuguucuuuuguaguuuaaucuccaccucacaggugacauccaugccaucacugcagcuaauaaccucguugcugcggccauugaugcucggauauuucaugaacugacccagacagacaagguaggaugccaaagccccaugaaccccauugaacaguuuugaaaguauugaaccaucugaauuaguguuggugucuugggugcugaggaugcagguagcaaagcaguggggcuccucucauuuuaaagccccuuucuuuucuuuaaggcucucuuuaaucguuuggugccaucaguaaauggagugagaagguucucugacauccaaauccgaagguuaaagguaagcuuuuuuucuuccacauuuuuuauauuguauggaaucuggaaucugaucauugauuaggacauaaaagucuucuuggaguagccuauuuuagaugaaguuacaucaguaaucauagucuuaaagucaugauauacauagcaaagauggaugguagagguuauuucucauuuaucuauagauuagaaguggcuaguguggaauaaauagaacacugacaaccugcccucagcuaagaaagaaacgacacuuccuuuauaacaugaacaagagucaggaugucacuguggcggcauagcagccuuuggaguuugcaucauugggaccuuaagcaaauuuguuaaaugacuuguuucuccgcuuacuugucuguaaaauaauacuugccuugcccugaauagauaagggucuguguuaaacaguuaaaaccauaguuauaucuauauuuuauuugaauuucuguaacaaauacauaguuaguaagcauacaccauaccaccugacccagaaaucucacccaaaauaaaugaaaacucuguucacauaaaaaucuguacauuaauguuuuuagcagcucuauuaauaauuuccaaaaacugggaacuaaucuaaaugucuuucauuggaugaauaaauaaacaaacugguacauccauccaauaaaaauaaaugagcuauugauacaagcaacaacuuggaugaauuucaguggcauuaugcugggugaaagaagccagucucaaaagcuugcauauugcaugccuccauuuauaugauauucucaauaagagaaaacuauagugcuagggaacagaucaauagauguuaaggguauggaugaagggaggguaugaccauaaaggaacagcaaaggagagguguuuuguuuuguuuuuuguuuucuuuuuugagacagcgucucucucuguaacccggcuggagugcagaggcacaaucacagcucacuauagcuuccaccuuccagguucaagcaauccucucaucuuagccuccugagcaccugggacuauagguacacacaccaccacaccuggcuaauuuuuuauuuuauuuuuuuguagagaccgugucucaccauauuguccaggcuggucucaaacuccuggucuaaagcgaugguccugccucagccucccaaaguguugggauuacuggcgugagccaccacgucuggccacaagggauuuuuuguuuuuguuuuucuguuuuuuaauuuuucaaaaauuuauugguugguuguuuguuuguuuguuuaagacagagucucacucuaucucccaggcuggagugcaauggugugaucucagcucacugcaaccuccaccucucagguucaagcaguucuccugccucagccugaauagcugggguuacaggugccugccaccaugcccagcuaauuuugguauuuuuaguagagagaagguuucaucauguuggccaggcuggucucgaacuccugaccucaggugacccacccgccuuggccucucaaagugcugggauuacaggcgugagccacuguacccggccuguuuguuuauguuuuugagaaaagcuuuuacucugucacccaggcuggagugccguggugcaaucacaucuuacuacagccucaaccuccaggacucaagugauucucccaccucacccaacuagguagcugagacuacagccagguaccaccaugcccagauuuuuauauauuguguagagaccggguuuugccguguugcccaggcugaucucaagcuucugggcucaagcaaucugccuaccuuggcauaccaaagugcugggauuacuugcaugaaccacugagcucagcauuuuuuuuuuuuuuuuuuuuuuaagagaugaggaggccaggcgugguggcucauaccuguaaucccagaacguugggaagcugaggcagguggaucaccugagguugggaguuugagaccagccugaccaacauggagaaaccccaucucuacuaaaaauacaaaauuagcugggcaugguggugcacgccuguagccccagcuacucgagaggcugacacaagagaaucgcuugaaccugggaggcggagguugcagugagcugaggaugccccacugcacuccagccugggugacagacagagacugucucaaaaaaaauuggguuuguguuuuacaacacuucuuggucacuaugauacuaugauuauuuaggucuaggcuuagggaaaucuucuggugcucaguuauagggacaaacauguuaauaauaccuuuguacaugugugaguaaugugaauuugcagauaucgggauaaaaucacuuuugucagacccagaaaaaacagggcugggaaaacaugaagaagaggaggcuuacacuuacgugucugugauaagaacuguuugcaaggccuguaaucccagcacuuugggaggccaaggcaggaggaugacuugagcccagcaguucgagaccagccugagcaaugaagcaaaaccucgucucuacaaaaaaauuuaaaaacgagccaggugugguggcaugcaccuguaguuauacccagcuacucgggaggcuaaggcaggagcaucccuugaacccagaaguucaagguugcagugagcuaucauugggccacuauaaucuagccuaagugacagaaugagaccucaucucaaaaaaacaaaagcaaaaauuguuuccaacaacuuuauaaaaccccaaaagaaaucccuucacguccuucacacaucuccugcuuugcacagcuugcacauuucaaauguauacuuauguuuccaugacaagacuuaucacuagacauucuucaggaugggaguaauucagauaagaugcucuugaaaguacacuuauccagcaacggcaacugcaccaaugaauugacaacucuggcuuugagcuucugggagcgaugaauucuguuuuuuuuuuuuuuuugagacagggucuugcucugucacccaggcuguagugcaguggcacaaucauggcucacugcagccuugaccugaacucucuaagcagacuacgugaagcucucccucuuuucuuuuuuuuuuuuuuuuuuuuuuuuuugagauggagucucacccaggcuggagugcaguggcgugaucuuggcuuacugcaaccucuaccuccuggguucaagcaguucugcugucucagccucccaaguagcugggauuauagucacccaccaccaugcccagcuaauuuuuguauuuuuuaguagagacaggguuucaccguguuggccaggcuggucucaaacuccugaccucaggugaucugcccaucucagcuucccauagugcugggauuacaggcucagccacaggcugagcuucacgccuagcugaagcucuccuucuuugcuaguaaaaucuucccuucccucacuaggcauauuuguggcaucccagguuauaauccucguugcucauuccugaauaaacucaaccuacuuggagauaauuuuuuguaaugucuuucuuuaggcugacaguaggaaauaacccccagcuuucaguuuuuccuucugaauuuaagaugguuugcauuuccuagaggggaucccauuuagagguaggggucaaaauuuuugucuuacguuuauugugcuucuguuugucuuauuuuauguuuucauuuuccuacacuuucagagacuaggcauugaaaagacugacccuaccacacugacagaugaagagauaaacagauuugcaagauuggacauugauccagaaaccauaacuuggcaaagagguaccagagcaguauacaagccccguuuguuuuggcuauauugcacacccuacacccuccagaagaguuguuaaaaugugaggcucagaagcuuccauguugguauuuuaccagcuaaggcaugaccaagauggugacauuauuucuuuuucuugccaccucucucaguaucucuccuuauuagcuaucaucaaaucucuuuguuggauuggucgaacauuuugcuggcuauucaguguugacugaaauuaggguaguuaaaccaaaaaucacauuuuacaaauuuaauuuuaugcaaaaaguuuuagugucaugaaguagagaaauuauguuuaaucacuucuugaaucaugugugaccuuuauucuuagaacucuuguguggcauaaaugacuugauuuuuuucuguaguucucuagcuuaccuaaucuuuuuuuuuuugagauggagucucgcucugucgcccaggcuagagugcaguggcacaguaucggcucacugcaagcucugccucccagguucacgccauucuccugccucagccucccgaguaacugggacuacaggcacccgccaucaugcccggcuaauuuuuuguauuuuuaguagagacaggguuucaccauguuagcuaggauggucucaaucuccugaccucaugauccgcccaccucaggcucccaaagugcugggauuacaggcaugagccaccgcacccggccuaccuaaucauuuuuuuaccucauuuuauuaaauucucuuauagcauauuagguagccuucaagguuuaaauacuuaccaguucaguaaguagguuuccuggcuucacugccauaugcuacuuuucucaaugcacaacuaguguagcuuagauuucacuuugcaucaacaaugcaaccuucuauucuguaucacuauugagaaagaaucuucauccacucaugcagaauagagcugaaggccaguuuauugacuguuuuugugauuuuccuugacucaauaaccguugcuagcuaauggccuuauuuagaugacacucucaaugucuaaaaccacauuggaauuucucuuccuuugcuucaauagcuuuagacaaaugguauaauauuuuauaaggaauaagcuaaaaguccauuuugaagauuuaguauccgauuuacuuuucuuuugcuucgugucucauucauguuuucuaagcaacuagaggcagucauaccuauugacuagcuauuuuuuacagaaauauuaguuacaugaaaccugauacuuuuuucuuuugaaaaauaaggguuggcuuuaacaacacauuacagcaagaguggggggugugugugucugauugcuauauaagacacugcuuuugguaugaaauuaugacagucuuuauggaaaauaauuuggcauauuaucaagugccuuaaaaaugcuucuccuccuugacucauuuagaguaugaacuggguuuuuuuguucauuuuguguguguguguguuuuuacuuugaaauuauuuuaauuuugaaauagaaaacaucuugaaaaaaaaacccacaaaauauauaggcaaauuuguacucugugagcuucucacauccuuacacugcuucaccaaucucuaagaugaaaaacucuguucuaaaacauauucagccaucagcaaugauguuauuaguaggaauauggaucaauuuaauuuuguguuucuuugauauuguuuggcauuugauacugaaauggcaacuccuguuuccucucuauacucauaguacucucagcaccucacuucugacaccagauggguaguuuuucucuuccacaacaauucagcuuucacuucuccaguggauauugacugaguauccuaugauuuaacucaauucugacacuaacugucuggagcagauccuacagguaaagggcucaguccuaaaagacugccccacuucagacacgaaucgcaaguccagguugucaccugugcuucugaccaacugguuauaaacuggaggguccccacaacccccugcucagguucauuugcuagaauggcucacagaacucagagaagcauuucacuuguguuuaugguuuauuauaaaggauacagcucagaaacaaccagauggaagagaagcguagggggcaucacucucccagcaccuggauguguucaccagcccagaggcucaucaaaucauguuguucaagaguuuuuuuuuugagacggaguuuuguucuuguugccuaggcuagagugcaauggagugaucucagcucacugcaaccucugcuucccggguucaagcgauucuccugccucagccuccugagaagcugggauuacaggcaugcaccaccacacccggcuaauuuuguauuuuuaguagcgacaggguuuuuccauguuggucaggcuggccucgaacuuuugaccucaggugaucugcccaccuuggccccccaaagugcugggauuuacaggcgugagccacugugcccggccuguucaagaguuuuauacaccccuaacaccuuacccagagguuggugggugggacugaaaguuccagcccucuaaucauuuggucuuuuuggugaccauuccuuuccugaggcugucuaggagaccuaccauaaguaacuuauuaccauaaacucaggugugaucaaaaggaguuuguaaugaauaacaagacacuccuaucacccuuggaauuccaagagcucugugagccuuuugucaggaacccaugacaaaggucaaauauauuuccuauuacacuacacauaccaaaagccagaacugaggguacacuaaaauguuaacaguaguuaguccugggaggucguuaguugguuaguugcuuggucuuugccauguuuuuugugguuauauaauuggauagauauucugucaucagaauaaaaauucucucugcuaagugugcuauguuuccuaaauuuccagaccaggccuggcacccagcguguuucaaaagauauuugcacuugcccugauuugauggcuccugcauuucuuacggugguggaaagucaaugagucaucaucccacagaacaacaacacaaaccucagucuuuugaaaaaauguagacugcucuguuuuucuuauauguggaauaugcuuuaaaauagauuccagauuucuaguuaacuguuugaauucucuagaugggauaaaaccaagccauuccacauuccuuugcuguaaaaauaacuccuguguauuuaugguauaugaacaucauuucuuaacuuuaacacauauucuagcuuugccauccauuuugaaauauugauagacaaucaugaaauuagacuuauugcuuuaaaacucugcugcuuccuuuaacuuugugguccuuuuacucaaaaucguucuauaucuugccugucugcuguaguguuggauaccaaugauagauuccugaggaagaucacgauuggacaggcuccaacggagaagggucacacacggacgguaacaauuugucccuuuccaaggaaauuaguucagaggcacuagaucuugcugcuucucuccuccuccauccucucucauacgacugauacugccagguguuguucugccuucucccuuuuaaaauggaagugaguagguguguggcauugagcacuccugacagcuuuugcaauaaaucccaugugucaccuguguguuuuucccccggcauuuuuuccuggagguggagagccccaagugaauauccuugcauagaaauugauuaaaauugcuucuuuuuuguggccauuucacuguauaucuccuugguuuaagagguaccauauuauucccuuguauaugaaagaaacaauaagcgcaugauuauaagcggccuucauagggauaaaaucauagcuuuuugguccuacuauaacauuuauuuuaaaaaacugacaacucagggcugggcgugguggcucacgccuguaaucccagcacuuugggaggccgaggcgggcggaucacuugaggucaggaguucgagaucagcccggccaaaccccaucucuacuaaaaaaauacaaaaacuagcugggcaugguggcacgcgccuguaaucccagcuacuugggaggcugaggcgcgaaaauugccugaacccaggagguggauguugcauugagccaagauugugccacugcacuccagccugggcaacagaccgagacucugucuccaaaaaaaaaaaaaaaaaaaaaaaaugacaacucagggucuuggaauaauuaauuaauauauuuuuuugcuauuagaggauuauuuucauuaaguauuuuggguaguauucuguuauucuauccuuuuaagcuauuuguuuaagccucagauguaaaagaggaucacuuuugcaauucacacuucugguuuaacacaaaguuuuugcuaguaccucuuuucccugcccacaggcccaguuugauaucucuguggccagugaaauuauggcuguccuggcucucaccacuucucuagaagacaugagagagagacugggcaaaauggugguggcauccaguaagaaaggagagcccgucagugccgaagaucugguggguacccagacacgccaggcuuggcgacauaucugugucuguuguccuagggucuuucagcaguuauuaauaacaaaauguaaugcuguacuuaagacauugcaauuaauucaucaauuuaauccuauuuugcuaauuacaagauaauuaugaaauguuuaaaaaguacaucagagugaauaauagcugguaugcuuuaguaauagaucacaaguuccagaugauuugaguaacaucuucauccugugggcaucucuaaaaguggguguaugacuucaauuugcagagaacaucaagaguaccauugcuuuaucuuuguugcuagguaguucagcuacacuuugauggcuuaauagagugaccugauguuaaaaguugguauugaacucuugcguaauauugcaguuucagcuuuggaagacacauauugaguuugguauuuauagaaauuucugcccagauaccagaguuacaaauaacugaguacucugggaacgagcauugucgugcucuaaaauagucuagaauggauuucucacaucagucagcagcugagcuugauuaagaugcuuguuucuagaguuacauguuuuuccagauauuacaugugaaugucauuuguauucuaucuggcaacuuuggccaggcgugguggcucaugccuguaaucccagcacuuugggaggcugaggcggguggaucacaaggucaggagauugagaccauccuggcuaacacaaugaaacccugucucuacuaaaaauacaaaaaaauuagccgggcauaguggcgggugccuguagucccagcuacucgggaggcugaggcaggagaauggcgugaaccugggagguggagcuugcagugagccgagauugcaccacugcacuccagccugggcaacacagccagacuccgucucaaaaaauaaauaauuuaauaauuggcaacuucauagcauauccagaaaaaaaccaugaaugguccaauucaggugaaaguaucaauugguccaagauggcuaacauggguaagccuagaaugucaaauauugguuucagaagguuggguuuuuuugcuggugggaguugaugcugcacacauuuguuuuguagggggugaguggugcacugacagugcuuaugaaggacgcaaucaagcccaaucucaugcagacacuggaggugagcagagugacuccugccuucuugaauugguuuuggacagucagagcagagugguuauaaagcacacuugcaaggcgcgguggcucacaccuguaaucccagcacuuugggaggccaaggugggcagaucacaaggucaggagaucgagaccauccuggcuaacauggugaaaccccgucucuacuaaaaauacaaaaaauuagccgggcaugguggcgggcgccuguagucccagcugcucggaagguugaggcagaauggcgugaaccugggaggcagagcuugcagugagccgagaucacgccacugcacuccagacugggcgacagagcgagacuccgugucaaaaaaaaaaaaaaaaaauuaagcacacuuaaccuggguagucaagaccuucuccacuugcucaucucuuucuucucauucuuccucacaccugugacugggacguuacugaaauaaaagagaugacuuuauauuuucccucugggaaguauucuuccuuccgauuccaaaucaauuccauaccguugaaugugugaucccacuuugaagcaggauuggcagcucagcucacgguguccugguuuccacagggcacuccaguguuuguccaugcuggcccguuugccaacaucgcacauggcaauuccuccaucauugcagaccggaucgcacucaagcuuguuggcccagaaggguuuguagguuaguguuuuuugcaaaaccagugaauagacuguauguuucuuuuaacaucaggggaauugggauggcauuuuuacuguugcuuuccucuuuacagugacggaagcaggauuuggagcagacauuggaauggaaaaguuuuuuaacaucaaaugccgguauuccggccucugcccccacgugguggugcuuguugccacugucagggcucucaagaugcacgggggcggccccacggugagugguggguugaaguaucugauuaucggcagugugcugacggccaaaaggaaguuggaugacuucugccuguuucuucauugaguugcucuuauccucgugauuaacaggcagcaaaagcaagggacgggcagacagcccuuguguuggcugccuuaucacucacaggcaccgucagcgcucagcauuuuaagagggccaaaaucggcugccuggccuaccuuucggaggacaucugacaauaucuaaaccccuccaaggacguguacucggcuagccccacaaaaaacuguuuuacguucagacuguucuuuuuaaaucugcaucccucuguauagugacacuggcaaccagccaaccaaaccaguuagcugagacagaggucagccccuucuugaguauacuguucaugcuggacagggccuccacacccuagggagggagugggggagaggagaauggcagaucugcccagggcugcccuggguaacagagaaacagguggagacuggcucauccucaccuccagccugaauuuuguauuucucugaauuccuacugcuuagaaauuccuacuacuuuuuauccuaguauuuuaacaccuuuucuuuagggccuacaugaaaagacauggugcuagguuuucugaaaucauuugaaaaacuauuaaauuccuguccaccaggagcuuguauuauaacuuaggaaauaaggacucccuggccuacaggauaaaaaucaaauuuguuuuggucaggguuuguccuaauguagcaguucucuguuuuggccucagaaccucuuuacacucuugacaguuauugagagccuaaaagaguuuuuguucauauggguuauagcuauugauauuuaccauauuagaaauuaaaacugaguuacauguaaacauaaagaacuuuguaaacaugaaaaugcauuaucuuuucccagcaaaauuuaggcauuguacauuuuucagaucuucucugggucuggcuuaauugaagacagcacuugaucuguugugacaucacaugucucauaaccuuuggaaaaguccauuauaugcucaaugagagaaugauaaugagaguaaaagggccauaagauguuacagaaucuuauggaaauaguuuugacuucauggaccccuucaaaggauuggguccccggagcacacugggaaugcugccauaacaaccccagcaccccuauccagucuuaguuaucccugagugccaaaggcacucccaacccagcacacuccuuucugcuaguagcacaggauagacucccuuuuuuuucccagucacaacuaacauuccucucucuuacaccccucacucacccucacaccaucacaccuccuuuccuugcuuccuccugaccucacagucaggauaaugucccauaaugcugugcauggaggggaacauuugcacauauggcucugucaagagaguaggccuccugcucucauuagcuugcugacgggaagcuaccuguaagguccuugcuucuugcucugccuccacacagccccuucuggaguuggagcacauagucucacugcaauggaagagggcagagcuucuuaaucacuauccacugcccaugguggggcccaugaaauggacaccuucacccauuugcucauuucuguggaugcagcagggcugagccacggcauagaucaagacugggggcuggggggcggggcggggaggcaccagacaccuccauccuuuagauauacucuacaaaagagaaagaaaauccuucuguauuguuuucccucuuguuuguauugacccugcaccacgguucagcuccaccaaugcuagguuggcacuguggaccaguucaugaaaccauggcagggcucaucacgggcucuaucgacagacaucccagggugacuuccgcaggcccgaccgcuuccucuuuccccacacuccccuugacuuccaaccccacugcuauggccuucacucgagucacugcaccugcuugguacaccccuuuccaccucuccugccaucgauccgguccuucucaccuccuuaauucaggucauagaggucuuccacgcugcccaaagcagucgauuuuguucugugcugugugauuggucacauacccuaaguccuuagggcaggaaauaaucuuauacuacuguacagccugcaagcauugcagcgucuugccuuuaacacaugaaaagcaccauuuuaagcuaggagauuuaaauaggaaaugccucugacucuguuucuuuuccuuccaggucacugcuggacugccucuucccaaggcuuacauacaggagguaaccugaguuauuucucaucacguguccuagaaagcaccacaccuugaaucagcauuucuccaccuggcccauguggaaaugaauggguuauugcugugacccagggugcagggugccaaaaggccugcagugugcugaggaguuauauuaaaugaguagauagggaagauguaccucacaaaauagaauugucccacauagggugucaauaagccacugcccuagaccagugguugauucucaacagcugauuuugaccccggggacauuuggcaaugucuagagacuuuuuuuauuauuacaacuggagguggggagugcuacuggaaucuaguggguagaaacuggggaugcuggcuaaacauccuuuaaugcacaggacagccccuacaacauuauccagcucaaaugucggagugugaggcugagaaacccuguccuagacuaauagcaguucccuuccauugucuucccugcauuggcuggguaaguuccaaaugccauucagaucagaagcaaguagagaccuuuuuugaaauggcuucuccucugccgauuuaaauccauauuaacgggccaagauauauggucaggauucugguuguuuuucuagacaaagcuuccuggauauuuauagcaucaaacaggaggcuagagaacaacugugagcucaaaucuuuucauauuuaugucauuuaccaucaaagaaacaucucuaaagccaguuuggggugguuacaggaaagacaggccaucagauaagguggcaaggucaccugcugucacugcuaauucaauuuuucugccuuuuuggaaggcuuuuaaauuaucaagcaauacagggucacuguucaggccccaaaugaaguauuucaaaacuggcuagaaaaaauugcugguaccuucagucugccugucuucugaguuaugguuugccuuuuauggucauuugucugauucacgcguaggaggggaauucacaguucuggcccuccugccaccccacagccuuuccugugucuaauuacagugacugccccuagcuggcccagcuggugucuucauuuaagaaauucuacuuauuuaaaacuguucuugaucagcguuacauauuaauugguuuucaugugacuagagguaaagaauuagcaguguucuuuagaagcucaaauaaaucauaaucucaguuuucaauuauuaaaggaaaaaagcauaaaucacauuuauaaugaaccuaguuguuuuccaccuuuuauccuaccuauuucugcuuuuuugggaucaacaaacauuagugcuggguuuugcucgaugauucaguauauguauuuuuauagaagacucuuuuauuuuuaaaauauuuaauguauuguuaagccuacaauaguaauauacccuuuguaaaaaauaauaauuaaacauuauaagaauguaauauaugugaguugaguccccuuaacaguucggugcauauuucucgacauuuaaaaauuuuucaugaauuauauacauguauuuuuguguuuguccuaaaauggaauaauuaagcucuccaugguuuugcaccuuuaguacaucuuggacagguuccauguuaacacagaugggucucacuuucauaacaucugcaugauaaauauuuauugaguguauaugucauaauucauuggcccagucccccuuggaggagguuuauguuuauaauuuuccaaugcuacaagcagggcugcaguaaacauacuuaaagauacauuuccuuaauugcuucccuuuaguuuguaguacuugguuuuugguggguuuuuuuguuuuguuuuguuuugagauggagucuggcucuauuacccaggcuggagugcaguggugugaucucggcucacugcaagcuccgccuccuggguucacaccauucuccugccucagccucccaagaagcugcgacuacaagcacccaccaucauguccggcuaauuuuuuuguauuuuuaguugagacgggguuucaccguguuagccaggauggucucgaucuccugaccucguguuccacccgccucggccucccaaagugcugggauuacaggcaugagccaccacgcccagccgguuuuugggguuuuuuuuacagacagggucucacucugucaccuaggcuggacugcagaggcgugaucauagcugcagccucuaacucuugggcuuaagcagucuccccgcuucaaccucccaacuagcuggaagaacaggaacacgccaccacaccaggcuaauuuuuuaauuuuuuguagagacggggucucccuauguugcccaggcaggcugcugucgaacuccuaggugcaagugauccuccgaucucagccucgcaaaguacugggauuacaggugugagcuaccacauccagcucaguucuuuuuuuuuuuuuuuuuuuuuuuuugagacagagucuugcucugucaccaggcuggagugcaguggugcaauuucaacucacugcaaccuccgccucugggguucaagugauucuccucccucagccucccaagcagcugggacuacagguuccugccaccacaccuaguuaauuuuuauauuuuuaauagauacgggguuucaccauguuggccaguauagucuuaaucucuugaccuugugauccaccugccucggccccccaaagugcugggaugacaggcauaagccaccagguccggcccuuuuuuuuuuuuuuuuuuuaauuaacuucucaguuguagagauggggucuuguuauguuuccuaggcuugucucaaacuccugggcucaaguggauucuccugccucagccucccaaaguccugggauuacaagugugagccacugggcccagccacuggccugauuccuaaagauaguauuuaucuuauuucuugcccucguucacggucgaguucauuaaaaccuuugaaaacaucacugcuuacuucauauuuccuggcaguauuuacggcagccauauaacgaauaccucuucugugccagccacuauguuguuaggcucugucuucugauggaagggucugugcugugcagaguagaguuaauuuguauuaucauaacccuaugaauacauaaaaucuauaaacacaauugguaaauauaauuuggguaaggguaacuaauuccuuucaaacagcaaauaagcuauaaugauguggcauaaugacaggaaacauaccagcucuuuuuuucuugaaggcugggaaacaagcagagcucuacucuagugucauaggcuggagugaaagcugcaguucuccauagcauccacucaccgcacuggaaaaaaugcaccaagggaccuucucucuucuuucuuggccuccuuguccugauagugaguggcugcuggcucaaggagguuguuugccuuugaagaagaaccugcagugguuuucaacucucugaucucauaggccuuucacuguuguuuuuacagaaccuggagcugguugaaaaaggcuucaguaacuugaagaaacaaauugaaaaugccagaauguuuggaauuccaguaguaguggccgugaaugcauucaaguaaguguagaguguaagcgaaaaggaugaauguggaaaaucuccuggagcugauuguacagcacugcuuuuagcuuuauuuuguuuuucaguuacugcuauugguuauagccugugguuuuagccugcacugugacaggcauugcauacgucacugcgggcucaccaccucacccacugagggucccaaagucagauucagcuccuaugggcccuuuuccuuuccacugggggaaguaacacacaagccugaaguucaauguuccuuuuucaucuuuagaggccuuuuaugcuaacagaaggucauaggccuauaguguuccauuauuuuacuagaucuggugggauguugucuugacaaagaauugggcauauuacucuggaaggggucaugcaagaacuuguguggguuguuuagguauugcauugguggucaggguuuuguuauaauggccucaccguaguagaaugggaagcaaaaaaucuuuuuuuuuuuuugggggacgaagucugucucuguugcccaggcuggagugcaguggcacgaucuccacucgcugcaagcucugccucccggguucaugccauucuccugccucagccucccuaguagcugggacuacaggugccugccaccaugcccagcuaauuuuuuguauuuuuaguagagacgggguuucaccguguuagccaggauggucucgaucuccugaccucgugauucucccaccucggccucccaaaguguugggauuacaagugugagccaccgcgcccagccagcaaaauucuuaaaugcuaguauuuacugauuccuucuggagugcugggaauuuuccaaguauuuuacauggauuuaccaucugagucucauaacgucccaaugaaauaagugcugugauuauucgcguauuaccaggguggaaauugaggcacauaaagauuagguaacuggccaaaagucaccagcuaguaaguuucggagcugagauucaaacccaggccaaauuucuugguuaguguucguuuaucaguggguaauucacaugagguuuaauggcaaaaagaagacaauucugucucuccagccauuuuccaugcuuugauaugaaaugcuuccuuuauaggacggauacagagucugagcuggaccucaucagccgccuuuccagagaacauggggcuuuugaugccgugaagugcacucacugggcagaagggggcaagggugccuuagcccuggcucaggccguccagagagcagcacaagcacccagcagcuuccagcuccuuuaugaccucaaggugggugauuugcugucugcaaaaaaagaaaaaagacgaaaagggcacagugaaguuucuguguggcuacuucuauuagagccccaugcuucgcagcuucagccuugcgguuugauucccacguaggugacuuacacaaccacagccuggacucccagcuguagacagccuucuuuuuauuuuugagacggagucuugcucuuuugcccaggcucgagugcagaggcaugaucucagcucacugcaaccucugccuccuggguucaagugauucuccugccucagcuucccaaguagcugggauuacaggcgucugccaccgugcccagcuaauuuuucuuauuuuuuuaguagagaugggguuucaccaucuuggccaggcuggucucgaacuccugaccucgugauccaccugccuuggccucccaaagugcuggaauuacaggcgugagccacugcguccgcccagacagccuucuuauaaacauaugccacugcuuacuuacagaggggauuuaagcaggaauaccccaggguggagggggaaccguugcucauauccuaacuucgaaaagggucaaaguacagguggcagaagagaagguuacauauagaccaaauauguaauucacuguagccuuuaaaacaaggcaccaaccauguagcagauugguaaggggcugcaucgagcuuacaaaauuuuucugauggcuuuucaguaauaggggaaagaagugugcccccacguucacuuccugguaaggugcugccucaaguugagggcccucacaugcaaaaccaaaguacuccaggaagcuucaucauuuuuuccaucacuaagcaaauuaaauuacaccuggucuaaguagagcccugcuuacucuaugauacaauaaaguuaguucaggaaaagguucuuauuauaggguuguguuuuguuuucauuuaucuguccaguguauuucaggaugugauuugacauuaaguaguauggaaacaacaacuggaaacuuuguuaggaauaugagauauaugcuguaguuaauuuuuccuauucucuaggcuaguuucuggcuugauuuuuuuguuuuguuuuuuguuuuaagacagggucuugcucuguugcucaggcuggagugcagugguacaaucauggcacacugcagccucaaccuccuggacccaagugguccucccaccucagcccccugaguaggugggaccacagacauguacuaccaagccuggcuaauuuguuuuauuggccaggcacaguggcucaccccuguaaccccagcacuuugggaggccgagguggguggaucaccuaaggucaagaguuggagaccagccuggccaacauggugaaaccccaucucuacuaaaaauacaaaaaauuagcugggugugguggcaggcaccuguaaucccagcuacuuggaaggcugaggcaggagaaucgcuugaacccgggaggcggacguugcaaugagcugagaucacugcacucuagccugggcaacaagugcgaaacuucgucucaaaaaaaaaauuuuguuuuauuuuauuuuauuuuucuuguagugacugggucucccuauauugcucaggcuggucucgaacuccuggguucaagugauccuccugccucagccucccaaagugcugggauuauaggcaugagccaaugugccuggccuggcuugguuuuuaauagauaaucauagacuuucaaaaacagccauaaaaaagcagaaggaauaaacuuauuacucuugaguuuuaguguucucuuauuucucuuugccccuugcagauauaauacacuuacaguuaauuaacauugacauugacauucuccuguugagcuuugauuuuauaggcaaguuuuaaaaucuguucagcaaucauccuuuuagaaaaaugccauaaacacaaauuugcacacaaaugcaaagcauuuauaggcacccucuccaggcuccaaugcauagcacccaaggcuggaagcccaguccuugaaaaccagcaggagaccugaaagagcagggacauauggacuuuagaacccauuucuacuugcaacuuuuauccauucuggcaaacaggaggcugccacuuuuugucuuacucagcgucugcuagucuuaaaucacccuucaaccaaagugcuuuugcuucagaaguucuaaaugugccuuggcauuuauagagcuccaguuaugagaugcauaugaaaauaaucuguguuucaucuuuauaaaguccuuauugaauguucacuuuauucaugcccauuauauaaagccccuucauaaauuaucauuguuuaguucaaaagggaauuuuuguuuuuauagauagauuauugcuccuuuuaaaaacaaaacuuggcugggcgcuguggucacaccuguaaucccagcacuuugggaagcugagguggguggaucaccuaaggucaggaguucgagaccagccugaccaagauggugaaacuccgucucuacuaaaaauauaaaauuagccaagcaugguggcccaugccugugaucccagcuacuugggaggcugaggcaggagaaucucuugaacccgggaggcggagguugcagugagcugagaugacgccauugcacuccagccugggcaacaagugcaaaacucugucucaaauaaauaagaaccugccuaauauguucuuuuagcuuuaguugcuauaaagacagauauauugccuaauuuuuguaauuugcucauccaaauuacccaugaguagcuuugcuucugauuuccuuuaggcaaccucuccguaugcuguucucuuugaaucuuaaugcccugaacuagucuacacagcauuuaagaagccagcuccacuucucugaaggcuuugccccggaggaaacagcccaugggacugaggcccucaccaguuagaccacuggucucuguccacugcacuguuugcuucaggugccacagaaaguggacaugcccaaugcguguugaucauguaaaucacuggguuguuuuuucuaauaccugggugauuuugauuuuaugacuauuuccuaauuccuggugcuugcacuuaaucaauuguguuaaggguggcaucugccucucauauacagacugggaguuauguagauggacauugguugucuuauuucauaaacaguguccccaggucugguuugacaggacugaucuccaguauuagaauagaacaucuacuuuuuaauuuuuauuauuauuuuaaaauuuuuauuuuuuaaagagacagaguguugcuauguugcccaggcugguuucaaacuccugggcucaagugauccuccugccuuggccuccucccaaagugcugggauuacagggaugagccaccauacccagccugaacaucuacuuuuuauuuaugaagaaauaauuauucuuggguagucagcaacacuguuuaugauguacuuagcgagagauuuuaaauauguacuuauguaaguauauauuuaaaaccuuaauauauauuaauauguguaucuauaucuauauauauauguauguguguauauguauaucugcauauauagauauaaaaacuuuaccucugugggacauuuucacuuauaaaaucugaggcuugauauuaaaagaaaguguuccuggcugggugcaguggcucacaccuguaaucccagcacuuugggaggccaaggcuggcagaucaccugagguugggaguucaagaccagccugaccaacauggagaaacuccgucucuacuaaaaauacagaauuagccgggcuugguugcgcaugccuauaaucccagcuacucgggaggcugaggcaggagaaucgcuugaaccugggaggcagggguuacagugaacugagaucgcgccauugcacuccagccuggcaacagagcgaaacuccgucucaaaaaaacaaaaagaaaguguucuuaacccaaucaucaaccucaaacuauuugcuuauguauauguauauaaaaaccaucuucugccccuuuuagggacucugaccuagaauguggcuauguccugguuaaauguccucacauguguccagucaugguguccccaucucuuucuugugcauuagcucccaguugaggauaaaaucaggaucauugcacagaagaucuauggagcagaugacauugaauuacuucccgaagcucaacacaaagcugaagucuacacgaagcagguagauguuugguuaguuuguccuuucaacucuuugcaaagcaggacuuggagucacaaucucuggguccucccagcccugccaaguacccguugcuucacuucucuggguggcagccuucucuccucugaaauacugaguuuggauuagguggcacagucccugguucuuuauuuacccauaggcguuauaugaauguguagaaauccaugaggaaauacagaaugucuuaccaaaauauugagaacgucuccaguuuuuguuauuuugagauagggucuggcuccauugcccaggcuagagugcaguggcacaauuucagcucacugcagccucugacuccuaggcucaagcgauccucccaccucagccuccugaguagcugcgccuacaggcacgcaccaccacaccuggcuaauuuuuguguuuuuuguugagaugggguuuugcccuguugcccaggcuggucuugaacuccugggcucaagcaguccacccaucucagucucccaaagugcuggaauuuauaggcaugaaccacugcaccugacccucuccaauuuuauucucauaucuacuccaaacuauuauuuuaaauuaguuuuauguuauuuccauagauggaaauaaaauauucacuuguggacuacaguugugaguaccuaacucccucacccaacaguucuuuuuuuuuuuuuuuggcuuaauaaauaagcuggaggacagcaagauagagauguauauaaagggaguuggauguuucgaauaaauugaagaauccauguaaucacagggcccagauggucauugcuggguugucaucuuuucauuuguccucccucucuucccuucuuuccccagggcuuugggaaucuccccaucugcauggcuaaaacacacuugucuuugucucacaacccagagcaaaaaggugucccuacaggcuucauucugcccauucgcgacauccgcgccagcguuggggcugguuuucuguaccccuuaguaggaacgguaagugcaugcugcaagggaguagugggcgcaucugcacuucucgucugaaguguguugccgaaaccaucaagcaaaugccaagugagcagaguucacugcccagaagaaaauuggaaucgggccuauuaugauugcuguggaucauaagcuauaaagcaggagcuauauagcucuugcuguggaccaucuuggugucaaaucaagaaugaugccaggacuacucauacugaauaaaaaauucuguuucccagggacaguaugcucuucacugaaucuaggaugagcccaguugauaggcugggguagugcuaacauaaucacaguuaauguuuauugggagccuuacauagauuaacucaguccccccacagcccuaggagguagggacagagguuuuacugacaggccuagaacuuacgucugaaauucaggggguucauuauuuuuaaguaaggaauuuccccauuaaaaaaugcaaauggacccuugagauaugaaaggugagguugcuuauuuacgcuucaaggugaacaagguguccauugcuuucuuaucuuacagauuuuaugcauauucaaagaagaauauugccaguugggaagcagaggggagggaugcuuaaggacauaaucauaguuugggcugacauuguuccaagguuaacuuggauccugaaucuagguuauccccuaaaucugcccuguauccuguaucuacagauuguacugccaugcaauacaggacugaaauauuaaacuaaaucaacacacauggaaaagaaaccaacauacauccuuuuggauuuaugucauucuuucaguauaguaagaaagugguaggagguggcauuauagaguugaaaacguaggacauuagagcugaauucauuuucaccucuucagaucuuggccuugggcaaauuaugaaaggugagagcccugcugcccucagcucacacuguaggcaacaucaucacaucacaguggugcuuagcacaaaugccugcaucucacugccuccuuagcucucuauagagagcagaaggcuuagacuugcuaugauguacaucagucuccaggauuuguagaaaucccuugugguaggaauuuuccaccauuuuuacccagcaccuugaauagugcagaaauauguguuguucuuuuuggagaaguugucagcagcuaccagcugaaagacggguagcuguacucuuucuugucacuuuugaucuucacaugaagaaaaggguaacaguagaggugaaagcaaaucuggaagcagucaggccagugagagucaggcuguaagguggagagagacacagccugccgaacucaagacuuucucauuuagaacaaaguaugugucagaggcuuuuaacuuuaaguuggaccaaggcguuuccacacaugaucaaaugguuuaaucacuauucuaacaccuuccaguugccguuggggccuuaacgagacucagauuauuugaauauuuucuauauuaauucaaagugugauggcuuauuuucagaacuuuauaucuagguucauacaugugcguacacauaauauugucuuuuuuuguauuuuuucugauuaucagugaccaguguuuaggagggaaaauccucuuggggaaugagugaaaauaucaaaaauccuacucaucacuguuuagggaaccaucuuuaggguuuucugcugacaugcacaugcccgucuacaacaaugggcaugugucuuuuaucuuuauaaugucaucuuccgguuuuucugcugugucuaaggacccauccuuuccucucuccuacuugucucacaccuagcaccuccuuaccucuuacacaauauaagaauauaaaccaguugucagaucccuauaauguguuuuggggaauauugauugguacucagaagucagucagaaugagguuuucuaaaguauugaugauguuuuguguuacagaagaugacucuuuuuaaauaaccuuuuuauaguuaaguuuuagaaguaaccuaagcuguuuuccugucuagauuugauuuggaacuuguguguauucauuauauaggacauuguuacagauaaaaauauacggaguuuucacuugcaagccguacauauuugcaucuaaguagaaauuugucaaagccgagucuuuagaaaaguagugaguacaaauauaauuuguaagcauuacaaguuuaguuuuagaaggccauuuugggccaguaagaauggugauuauaaaaccaucuagauuauguacaaaagugucuuggcccaaguuaaaggauacuaacuccuaccaucguguugcugaagcaaaaaucacaugggcagcucagcuagcaagacugaacgaaacaaaauuuaaaagcaggcaagcccuguaccuccuuuuggucuugcaaagcgugagcugaggaggcgagugagcaacuccucuacuccccagcacucauucuuguaaggugaagguggaaacaccuccugcuacugcuugugaccacauggaagaugauagugaaggcuggcauuugguuugcagaaggacaugaggaaucaguuucuuuucuuuuccuuuuuuuuuuuuuugagauggagucuugcucugucacccaggcuggagugcaguggcaagaucucggcucacugcaaccuccgccucccagguucaagcgauucuccugccucagccucccaaguagcugggauuacaggcacacgccaccaugcccagcuaauuuuuguauuuuuaguagagaugggguuucaccauguuggucaggcuggucucaaauuccugaccucaggugauccaucugccuuggccucccagagugcuaggauuauaggcaugagccaccacgcccggcagggaucaguuucugaguuuuuuaacaggaucagugacuugauuuuuaauauguaacaagaguacccacuuuauugacaacuauaaaaugauguucuaucuuuaugccuugggcuuucuuucugaaggaaaagugaaaguaaagaugacuuuacguuuauuuuagacauggccuugcucugucgcccaggcaaucggaugaucauggcucacuguggccucaaccuccuagccucaagcaauccuccugccuuagcaucccaaguagcuggaacuacaggcacaugccaucauauccagcuaauuuuuuauuuccuguagagaugggggucucacuauguugcccagggugguuuagaacuccuggccucaagugauccucuccaccucagccugggauuauaggcgugagccacugugcccagcauuaguuuauuuguaaugcuuuuuuacauccuagaugagcacaaugccuggacuccccacccggcccuguuuuuaugauauugauuuggacccugaaacagaacaggugaauggauuauucuaaacagguaaguuguuacuggguaauaauuuggcuuuuuuccucauguagcuuauuuaugaauuauagggcucaaacugacgcuauaaaaauucacauucuaaugcuuucaaaacauuucuuuucagacuucccugaggggagaggggauaguaaugagaguuggcaauaaccaaugaauugaaauauuuauauuucaacacauuuuuggaagaagcgcagcauggcuugucacagguugacaguguaggggagaaaacugcuguccaauaaacuacagaggaaacuacaggagagguuagacucccucugcugaagccccaggaggcuugggguucagaguugaugacacauugcaggucaggaacagcugacggucuguauacucugaauagguaguuagaaggcaagaauuagcaaaugucuuaggaaguauaauagaaaagagaaggaaacaggaccaaucuggcaguucuuagggccuuaggugaaagggcccugaguaccgacugcaaugagugacauugcauuguuugauauuuuugaaauuucaacaggacgugucucuccuuaggcagacccuuggggcugaagcagcaaguugcagugugcacuuauaucccuagacacauccuguugaaacugcaaaaauaucaaacaugaaaauccuaacaucuuucuccagagacgaaaaaaguggcuugccuaugaaaagaaugagaacuagacuuaacgcccgucuuacuggcaauaagaagcuuuuagacaauggaggaguguccuguaaggucacagggaagaugacuuucaacaugugcucacaccuagccgaaucuaucuggauauuuucagacgugcaaggguuugccaccccacaucucuuccuaagaaguuauuuagcaauguacuuagcaaaaugaggaauuaaccaagaaaaaaggaagacgugaguuuugggaaacugaacccucauuuggacauuagcgaaggggcauucugauaaccaugcaaaugaccugaaguuacaaauccuguguggaacagguugggggagcaccugagaaaaacuagaaaaagcuagaaaagacaaggauaucaaagggucauaguauaaaacaaaagcucuugcauuauuugagaaaguuaagguccaaguagaagcaaacuguaguuugaugcuagaacacuauucuuugagaggguaugugugauacucgaaaugcagucauggcucacggcuuggucuggucuugaacaguauucacacaguacuauggaaauaccaugcaucauuuucaaguccauuuauggacacgcccuagaagagcugguggcaggaaaggauguaaauguuaacagcuuuggcaaugugaguggguaauggugcaguauggaaggaacaggaaacauuucagugcuugcuuagagaaaacauuuauuucuuguuuuuccuuccagaucaccauccaucuucaagaagcuacuuugaaagucuggccagugucuauucaggcccacugggaguuaggaaguauaaguaagccaagagaagucagccccugcccagaagaucugaaacuaauaguaggaguuuccccagaagucauuuucagccuuaauucucaucauguauaaauuaacauaaaucaugcaugucuguuuacuuuagugacguuccacagaauaaaaggaaacaaguuugccauc

SEQ ID NO: 192363 - RNA, 71967 nt, Homo sapiens
gauggcaaacuuguuuccuuuuauucuguggaacgucacuaaaguaaacagacaugcaugauuuauguuaauuuauacaugaugagaauuaaggcugaaaaugacuucuggggaaacuccuacuauuaguuucagaucuucugggcaggggcugacuucucuuggcuuacuuauacuuccuaacucccagugggccugaauagacacuggccagacuuucaaaguagcuucuugaagauggauggugaucuggaaggaaaaacaagaaauaaauguuuucucuaagcaagcacugaaauguuuccuguuccuuccauacugcaccauuacccacucacauugccaaagcuguuaacauuuacauccuuuccugccaccagcucuucuagggcguguccauaaauggacuugaaaaugaugcaugguauuuccauaguacugugugaauacuguucaagaccagaccaagccgugagccaugacugcauuucgaguaucacacauacccucucaaagaauaguguucuagcaucaaacuacaguuugcuucuacuuggaccuuaacuuucucaaauaaugcaagagcuuuuguuuuauacuaugacccuuugauauccuugucuuuucuagcuuuuucuaguuuuucucaggugcucccccaaccuguuccacacaggauuuguaacuucaggucauuugcaugguuaucagaaugccccuucgcuaauguccaaaugaggguucaguuucccaaaacucacgucuuccuuuuuucuugguuaauuccucauuuugcuaaguacauugcuaaauaacuucuuaggaagagaugugggguggcaaacccuugcacgucugaaaauauccagauagauucggcuaggugugagcacauguugaaagucaucuucccugugaccuuacaggacacuccuccauugucuaaaagcuucuuauugccaguaagacgggcguuaagucuaguucucauucuuuucauaggcaagccacuuuuuucgucucuggagaaagauguuaggauuuucauguuugauauuuuugcaguuucaacaggaugugucuagggauauaagugcacacugcaacuugcugcuucagccccaagggucugccuaaggagagacacguccuguugaaauuucaaaaauaucaaacaaugcaaugucacucauugcagucgguacucagggcccuuucaccuaaggcccuaagaacugccagauugguccuguuuccuucucuuuucuauuauacuuccuaagacauuugcuaauucuugccuucuaacuaccuauucagaguauacagaccgucagcuguuccugaccugcaaugugucaucaacucugaaccccaagccuccuggggcuucagcagagggagucuaaccucuccuguaguuuccucuguaguuuauuggacagcaguuuucuccccuacacugucaaccugugacaagccaugcugcgcuucuuccaaaaauguguugaaauauaaauauuucaauucauugguuauugccaacucucauuacuauccccucuccccucagggaagucugaaaagaaauguuuugaaagcauuagaaugugaauuuuuauagcgucaguuugagcccuauaauucauaaauaagcuacaugaggaaaaaagccaaauuauuacccaguaacaacuuaccuguuuagaauaauccauucaccuguucuguuucaggguccaaaucaauaucauaaaaacagggccggguggggaguccaggcauugugcucaucuaggauguaaaaaagcauuacaaauaaacuaaugcugggcacaguggcucacgccuauaaucccaggcugagguggagaggaucacuugaggccaggaguucuaaaccacccugggcaacauagugagacccccaucucuacaggaaauaaaaaauuagcuggauaugauggcaugugccuguaguuccagcuacuugggaugcuaaggcaggaggauugcuugaggcuaggagguugaggccacagugagccaugaucauccgauugccugggcgacagagcaaggccaugucuaaaauaaacguaaagucaucuuuacuuucacuuuuccuucagaaagaaagcccaaggcauaaagauagaacaucauuuuauaguugucaauaaaguggguacucuuguuacauauuaaaaaucaagucacugauccuguuaaaaaacucagaaacugaucccugccgggcgugguggcucaugccuauaauccuagcacucugggaggccaaggcagauggaucaccugaggucaggaauuugagaccagccugaccaacauggugaaaccccaucucuacuaaaaauacaaaaauuagcugggcaugguggcgugugccuguaaucccagcuacuugggaggcugaggcaggagaaucgcuugaaccugggaggcggagguugcagugagccgagaucuugccacugcacuccagccugggugacagagcaagacuccaucucaaaaaaaaaaaaaaggaaaagaaaagaaacugauuccucauguccuucugcaaaccaaaugccagccuucacuaucaucuuccauguggucacaagcaguagcaggagguguuuccaccuucaccuuacaagaaugagugcuggggaguagaggaguugcucacucgccuccucagcucacgcuuugcaagaccaaaaggagguacagggcuugccugcuuuuaaauuuuguuucguucagucuugcuagcugagcugcccaugugauuuuugcuucagcaacacgaugguaggaguuaguauccuuuaacuugggccaagacacuuuuguacauaaucuagaugguuuuauaaucaccauucuuacuggcccaaaauggccuucuaaaacuaaacuuguaaugcuuacaaauuauauuuguacucacuacuuuucuaaagacucggcuuugacaaauuucuacuuagaugcaaauauguacggcuugcaagugaaaacuccguauauuuuuaucuguaacaauguccuauauaaugaauacacacaaguuccaaaucaaaucuagacaggaaaacagcuuagguuacuucuaaaacuuaacuauaaaaagguuauuuaaaaagagucaucuucuguaacacaaaacaucaucaauacuuuagaaaaccucauucugacugacuucugaguaccaaucaauauuccccaaaacacauuauagggaucugacaacugguuuauauucuuauauuguguaagagguaaggaggugcuaggugugagacaaguaggagagaggaaaggauggguccuuagacacagcagaaaaaccggaagaugacauuauaaagauaaaagacacaugcccauuguuguagacgggcaugugcaugucagcagaaaacccuaaagaugguucccuaaacagugaugaguaggauuuuugauauuuucacucauuccccaagaggauuuucccuccuaaacacuggucacugauaaucagaaaaaauacaaaaaaagacaauauuauguguacgcacauguaugaaccuagauauaaaguucugaaaauaagccaucacacuuugaauuaauauagaaaauauucaaauaaucugagucucguuaaggccccaacggcaacuggaagguguuagaauagugauuaaaccauuugaucauguguggaaacgccuugguccaacuuaaaguuaaaagccucugacacauacuuuguucuaaaugagaaagucuugaguucggcaggcugugucucucuccaccuuacagccugacucucacuggccugacugcuuccagauuugcuuucaccucuacuguuacccuuuucuucaugugaagaucaaaagugacaagaaagaguacagcuacccgucuuucagcugguagcugcugacaacuucuccaaaaagaacaacacauauuucugcacuauucaaggugcuggguaaaaaugguggaaaauuccuaccacaagggauuucuacaaauccuggagacugauguacaucauagcaagucuaagccuucugcucucuauagagagcuaaggaggcagugagaugcaggcauuugugcuaagcaccacugugaugugaugauguugccuacagugugagcugagggcagcagggcucucaccuuucauaauuugcccaaggccaagaucugaagaggugaaaaugaauucagcucuaauguccuacguuuucaacucuauaaugccaccuccuaccacuuucuuacuauacugaaagaaugacauaaauccaaaaggauguauguugguuucuuuuccauguguguugauuuaguuuaauauuucaguccuguauugcauggcaguacaaucuguagauacaggauacagggcagauuuaggggauaaccuagauucaggauccaaguuaaccuuggaacaaugucagcccaaacuaugauuauguccuuaagcaucccuccccucugcuucccaacuggcaauauucuucuuugaauaugcauaaaaucuguaagauaagaaagcaauggacaccuuguucaccuugaagcguaaauaagcaaccucaccuuucauaucucaaggguccauuugcauuuuuuaauggggaaauuccuuacuuaaaaauaaugaacccccugaauuucagacguaaguucuaggccugucaguaaaaccucugucccuaccuccuagggcuguggggggacugaguuaaucuauguaaggcucccaauaaacauuaacugugauuauguuagcacuaccccagccuaucaacugggcucauccuagauucagugaagagcauacugucccugggaaacagaauuuuuuauucaguaugaguaguccuggcaucauucuugauuugacaccaagaugguccacagcaagagcuauauagcuccugcuuuauagcuuaugauccacagcaaucauaauaggcccgauuccaauuuucuucugggcagugaacucugcucacuuggcauuugcuugaugguuucggcaacacacuucagacgagaagugcagaugcgcccacuacucccuugcagcaugcacuuaccguuccuacuaagggguacagaaaaccagccccaacgcuggcgcggaugucgcgaaugggcagaaugaagccuguagggacaccuuuuugcucuggguugugagacaaagacaaguguguuuuagccaugcagauggggagauucccaaagcccuggggaaagaagggaagagagggaggacaaaugaaaagaugacaacccagcaaugaccaucugggcccugugauuacauggauucuucaauuuauucgaaacauccaacucccuuuauauacaucucuaucuugcuguccuccagcuuauuuauuaagccaaaaaaaaaaaaaaagaacuguugggugagggaguuagguacucacaacuguaguccacaagugaauauuuuauuuccaucuauggaaauaacauaaaacuaauuuaaaauaauaguuuggaguagauaugagaauaaaauuggagagggucaggugcagugguucaugccuauaaauuccagcacuuugggagacugagauggguggacugcuugagcccaggaguucaagaccagccugggcaacagggcaaaaccccaucucaacaaaaaacacaaaaauuagccaggugugguggugcgugccuguaggcgcagcuacucaggaggcugaggugggaggaucgcuugagccuaggagucagaggcugcagugagcugaaauugugccacugcacucuagccugggcaauggagccagacccuaucucaaaauaacaaaaacuggagacguucucaauauuuugguaagacauucuguauuuccucauggauuucuacacauucauauaacgccuauggguaaauaaagaaccagggacugugccaccuaauccaaacucaguauuucagaggagagaaggcugccacccagagaagugaagcaacggguacuuggcagggcugggaggacccagagauugugacuccaaguccugcuuugcaaagaguugaaaggacaaacuaaccaaacaucuaccugcuucguguagacuucagcuuuguguugagcuucgggaaguaauucaaugucaucugcuccauagaucuucugugcaaugauccugauuuuauccucaacugggagcuaaugcacaagaaagagauggggacaccaugacuggacacaugugaggacauuuaaccaggacauagccacauucuaggucagagucccuaaaaggggcagaagaugguuuuuauauacauauacauaagcaaauaguuugagguugaugauuggguuaagaacacuuucuuuuuguuuuuuugagacggaguuucgcucuguugccaggcuggagugcaauggcgcgaucucaguucacuguaaccccugccucccagguucaagcgauucuccugccucagccucccgaguagcugggauuauaggcaugcgcaaccaagcccggcuaauucuguauuuuuaguagagacggaguuucuccauguuggucaggcuggucuugaacucccaaccucaggugaucugccagccuuggccucccaaagugcugggauuacaggugugagccacugcacccagccaggaacacuuucuuuuaauaucaagccucagauuuuauaagugaaaaugucccacagagguaaaguuuuuauaucuauauaugcagauauacauauacacacauacauauauauauagauauagauacacauauuaauauauauuaagguuuuaaauauauacuuacauaaguacauauuuaaaaucucucgcuaaguacaucauaaacaguguugcugacuacccaagaauaauuauuucuucauaaauaaaaaguagauguucaggcuggguaugguggcucaucccuguaaucccagcacuuugggaggaggccaaggcaggaggaucacuugagcccaggaguuugaaaccagccugggcaacauagcaacacucugucucuuuaaaaaauaaaaauuuuaaaauaauaauaaaaauuaaaaaguagauguucuauucuaauacuggagaucaguccugucaaaccagaccuggggacacuguuuaugaaauaagacaaccaauguccaucuacauaacucccagucuguauaugagaggcagaugccacccuuaacacaauugauuaagugcaagcaccaggaauuaggaaauagucauaaaaucaaaaucacccagguauuagaaaaaacaacccagugauuuacaugaucaacacgcauugggcauguccacuuucuguggcaccugaagcaaacagugcaguggacagagaccaguggucuaacuggugagggccucagucccaugggcuguuuccuccggggcaaagccuucagagaaguggagcuggcuucuuaaaugcuguguagacuaguucagggcauuaagauucaaagagaacagcauacggagagguugccuaaaggaaaucagaagcaaagcuacucauggguaauuuggaugagcaaauuacaaaaauuaggcaauauaucugucuuuauagcaacuaaagcuaaaagaacauauuaggcagguucuuauuuauuugagacagaguuuugcacuuguugcccaggcuggagugcaauggcgucaucucagcucacugcaaccuccgccucccggguucaagagauucuccugccucagccucccaaguagcugggaucacaggcaugggccaccaugcuuggcuaauuuuauauuuuuaguagagacggaguuucaccaucuuggucaggcuggucucgaacuccugaccuuaggugauccacccaccucagcuucccaaagugcugggauuacaggugugaccacagcgcccagccaaguuuuguuuuuaaaaggagcaauaaucuaucuauaaaaacaaaaauucccuuuugaacuaaacaaugauaauuuaugaaggggcuuuauauaaugggcaugaauaaagugaacauucaauaaggacuuuauaaagaugaaacacagauuauuuucauaugcaucucauaacuggagcucuauaaaugccaaggcacauuuagaacuucugaagcaaaagcacuuugguugaagggugauuuaagacuagcagacgcugaguaagacaaaaaguggcagccuccuguuugccagaauggauaaaaguugcaaguagaaauggguucuaaaguccauaugucccugcucuuucaggucuccugcugguuuucaaggacugggcuuccagccuugggugcuaugcauuggagccuggagagggugccuauaaaugcuuugcauuugugugcaaauuuguguuuauggcauuuuucuaaaaggaugauugcugaacagauuuuaaaacuugccuauaaaaucaaagcucaacaggagaaugucaaugucaauguuaauuaacuguaaguguauuauaucugcaaggggcaaagagaaauaagagaacacuaaaacucaagaguaauaaguuuauuccuucugcuuuuuuauggcuguuuuugaaagucuaugauuaucuauuaaaaaccaagccaggccaggcacauuggcucaugccuauaaucccagcacuuugggaggcugaggcaggaggaucacuugaacccaggaguucgagaccagccugagcaauauagggagacccagucacuacaagaaaaauaaaauaaaauaaaacaaaauuuuuuuuuugagacgaaguuucgcacuuguugcccaggcuagagugcagugaucucagcucauugcaacguccgccucccggguucaagcgauucuccugccucagccuuccaaguagcugggauuacaggugccugccaccacacccagcuaauuuuuuguauuuuuaguagagaugggguuucaccauguuggccaggcuggucuccaacucuugaccuuaggugauccacccaccucggccucccaaagugcugggguuacaggggugagccacugugccuggccaauaaaacaaauuagccaggcuugguaguacaugucuguggucccaccuacucagggggcugaggugggaggaccacuuggguccaggagguugaggcugcagugugccaugauuguaccacugcacuccagccugagcaacagagcaagacccugucuuaaaacaaaaaacaaaacaaaaaaaucaagccagaaacuagccuagagaauaggaaaaauuaacuacagcauauaucucauauuccuaacaaaguuuccaguuguuguuuccauacuacuuaaugucaaaucacauccugaaauacacuggacagauaaaugaaaacaaaacacaacccuauaauaagaaccuuuuccugaacuaacuuuauuguaucauagaguaagcagggcucuacuuagaccagguguaauuuaauuugcuuagugauggaaaaaaugaugaagcuuccuggaguacuuugguuuugcaugugagggcccucaacuugaggcagcaccuuaccaggaagugaacgugggggcacacuucuuuccccuauuacugaaaagccaucagaaaaauuuuguaagcucgaugcagccccuuaccaaucugcuacaugguuggugccuuguuuuaaaggcuacagugaauuacauauuuggucuauauguaaccuucucuucugccaccuguacuuugacccuuuucgaaguuaggauaugagcaacgguucccccuccacccugggguauuccugcuuaaauccccucuguaaguaagcaguggcauauguuuauaagaaggcugucugggcggacgcaguggcucacgccuguaauuccagcacuuugggaggccaaggcagguggaucacgaggucaggaguucgagaccagccuggccaagauggugaaaccccaucucuacuaaaaaaauaagaaaaauuagcugggcacgguggcagacgccuguaaucccagcuacuugggaagcugaggcaggagaaucacuugaacccaggaggcagagguugcagugagcugagaucaugccucugcacucgagccugggcaaaagagcaagacuccgucucaaaaauaaaaagaaggcugucuacagcugggaguccaggcugugguuguguaagucaccuacgugggaaucaaaccgcaaggcugaagcugcgaagcauggggcucuaauagaaguagccacacagaaacuucacugugcccuuuucgucuuuuuucuuuuuuugcagacagcaaaucacccaccuugaggucauaaaggagcuggaagcugcugggugcuugugcugcucucuggacggccugagccagggcuaaggcacccuugcccccuucugcccagugagugcacuucacggcaucaaaagccccauguucucuggaaaggcggcugaugagguccagcucagacucuguauccguccuauaaaggaagcauuucauaucaaagcauggaaaauggcuggagagacagaauugucuucuuuuugccauuaaaccucaugugaauuacccacugauaaacgaacacuaaccaagaaauuuggccuggguuugaaucucagcuccgaaacuuacuagcuggugacuuuuggccaguuaccuaaucuuuaugugccucaauuuccacccugguaauacgcgaauaaucacagcacuuauuucauugggacguuaugagacucagaugguaaauccauguaaaauacuuggaaaauucccagcacuccagaaggaaucaguaaauacuagcauuuaagaauuuugcuggcugggcgcgguggcucacacuuguaaucccaacacuuugggaggccgaggugggagaaucacgaggucaggagaucgagaccauccuggcuaacacggugaaaccccgucucuacuaaaaauacaaaaaauuagcugggcaugguggcaggcaccuguagucccagcuacuagggaggcugaggcaggagaauggcaugaacccgggaggcagagcuugcagcgaguggagaucgugccacugcacuccagccugggcaacagagacagacuucgucccccaaaaaaaaaaaaagauuuuuugcuucccauucuacuacggugaggccauuauaacaaaacccugaccaccaaugcaauaccuaaacaacccacacaaguucuugcaugaccccuuccagaguaauaugcccaauucuuugucaagacaacaucccaccagaucuaguaaaauaauggaacacuauaggccuaugaccuucuguuagcauaaaaggccucuaaagaugaaaaaggaacauugaacuucaggcuuguguguuacuucccccaguggaaaggaaaagggcccauaggagcugaaucugacuuugggacccucagugggugagguggugagcccgcagugacguaugcaaugccugucacagugcaggcuaaaaccacaggcuauaaccaauagcaguaacugaaaaacaaaauaaagcuaaaagcagugcuguacaaucagcuccaggagauuuuccacauucauccuuuucgcuuacacucuacacuuacuugaaugcauucacggccacuacuacuggaauuccaaacauucuggcauuuucaauuuguuucuucaaguuacugaagccuuuuucaaccagcuccagguucuguaaaaacaacagugaaaggccuaugagaucagagaguugaaaaccacugcagguucuucuucaaaggcaaacaaccuccuugagccagcagccacucacuaucaggacaaggaggccaagaaagaagagagaaggucccuuggugcauuuuuuccagugcggugaguggaugcuauggagaacugcagcuuucacuccagccuaugacacuagaguagagcucugcuuguuucccagccuucaagaaaaaaagagcugguauguuuccugucauuaugccacaucauuauagcuuauuugcuguuugaaaggaauuaguuacccuuacccaaauuauauuuaccaauuguguuuauagauuuuauguauucauaggguuaugauaauacaaauuaacucuacucugcacagcacagacccuuccaucagaagacagagccuaacaacauaguggcuggcacagaagagguauucguuauauggcugccguaaauacugccaggaaauaugaaguaagcagugauguuuucaaagguuuuaaugaacucgaccgugaacgagggcaagaaauaagauaaauacuaucuuuaggaaucaggccaguggcugggcccaguggcucacacuuguaaucccaggacuuugggaggcugaggcaggagaauccacuugagcccaggaguuugagacaagccuaggaaacauaacaagaccccaucucuacaacugagaaguuaauuaaaaaaaaaaaaaaaaaaagggccggaccugguggcuuaugccugucaucccagcacuuuggggggccgaggcagguggaucacaaggucaagagauuaagacuauacuggccaacauggugaaaccccguaucuauuaaaaauauaaaaauuaacuaggugugguggcaggaaccuguagucccagcugcuugggaggcugagggaggagaaucacuugaaccccagaggcggagguugcagugaguugaaauugcaccacugcacuccagccuggugacagagcaagacucugucucaaaaaaaaaaaaaaaaaaaaaaaaagaacugagcuggaugugguagcucacaccuguaaucccaguacuuugcgaggcugagaucggaggaucacuugcaccuaggaguucgacagcagccugccugggcaacauagggagaccccgucucuacaaaaaauuaaaaaauuagccuggugugguggcguguuccuguucuuccagcuaguugggagguugaagcggggagacugcuuaagcccaagaguuagaggcugcagcuaugaucacgccucugcaguccagccuaggugacagagugagacccugucuguaaaaaaaaccccaaaaaccggcugggcgugguggcucaugccuguaaucccagcacuuugggaggccgaggcggguggaacacgaggucaggagaucgagaccauccuggcuaacacggugaaaccccgucucaacuaaaaauacaaaaaaauuagccggacaugauggugggugcuuguagucgcagcuucuugggaggcugaggcaggagaauggugugaacccaggaggcggagcuugcagugagccgagaucacaccacugcacuccagccuggguaauagagccagacuccaucucaaaacaaaacaaaacaaaaaaacccaccaaaaaccaaguacuacaaacuaaagggaagcaauuaaggaaauguaucuuuaaguauguuuacugcagcccugcuuguagcauuggaaaauuauaaacauaaaccuccuccaagggggacugggccaaugaauuaugacauauacacucaauaaauauuuaucaugcagauguuaugaaagugagacccaucuguguuaacauggaaccuguccaagauguacuaaaggugcaaaaccauggagagcuuaauuauuccauuuuaggacaaacacaaaaauacauguauauaauucaugaaaaauuuuuaaaugucgagaaauaugcaccgaacuguuaaggggacucaacucacauauauuacauucuuauaauguuuaauuauuauuuuuuacaaaggguauauuacuauuguaggcuuaacaauacauuaaauauuuuaaaaauaaaagagucuucuauaaaaauacauauacugaaucaucgagcaaaacccagcacuaauguuuguugaucccaaaaaagcagaaauagguaggauaaaagguggaaaacaacuagguucauuauaaaugugauuuaugcuuuuuuccuuuaauaauugaaaacugagauuaugauuuauuugagcuucuaaagaacacugcuaauucuuuaccucuagucacaugaaaaccaauuaauauguaacgcugaucaagaacaguuuuaaauaaguagaauuucuuaaaugaagacaccagcugggccagcuaggggcagucacuguaauuagacacaggaaaggcugugggguggcaggagggccagaacugugaauuccccuccuacgcgugaaucagacaaaugaccauaaaaggcaaaccauaacucagaagacaggcagacugaagguaccagcaauuuuuucuagccaguuuugaaauacuucauuuggggccugaacagugacccuguauugcuugauaauuuaaaagccuuccaaaaaggcagaaaaauugaauuagcagugacagcaggugaccuugccaccuuaucugauggccugucuuuccuguaaccaccccaaacuggcuuuagagauguuucuuugaugguaaaugacauaaauaugaaaagauuugagcucacaguuguucucuagccuccuguuugaugcuauaaauauccaggaagcuuugucuagaaaaacaaccagaauccugaccauauaucuuggcccguuaauauggauuuaaaucggcagaggagaagccauuucaaaaaaggucucuacuugcuucugaucugaauggcauuuggaacuuacccagccaaugcagggaagacaauggaagggaacugcuauuagucuaggacaggguuucucagccucacacuccgacauuugagcuggauaauguuguaggggcuguccugugcauuaaaggauguuuagccagcauccccaguuucuacccacuagauuccaguagcacuccccaccuccaguuguaauaauaaaaaaagucucuagacauugccaaauguccccggggucaaaaucagcuguugagaaucaaccacuggucuagggcaguggcuuauugacacccuaugugggacaauucuauuuugugagguacaucuucccuaucuacucauuuaauauaacuccucagcacacugcaggccuuuuggcacccugcacccugggucacagcaauaacccauucauuuccacaugggccagguggagaaaugcugauucaagguguggugcuuucuaggacacgugaugagaaauaacucagguuaccuccuguauguaagccuugggaagaggcaguccagcagugaccuggaaggaaaagaaacagagucagaggcauuuccuauuuaaaucuccuagcuuaaaauggugcuuuucauguguuaaaggcaagacgcugcaaugcuugcaggcuguacaguaguauaagauuauuuccugcccuaaggacuuaggguaugugaccaaucacacagcacagaacaaaaucgacugcuuugggcagcguggaagaccucuaugaccugaauuaaggaggugagaaggaccggaucgauggcaggagagguggaaagggguguaccaagcaggugcagugacucgagugaaggccauagcagugggguuggaagucaaggggaguguggggaaagaggaagcggucgggccugcggaagucacccugggaugucugucgauagagcccgugaugagcccugccaugguuucaugaacugguccacagugccaaccuagcauugguggagcugaaccguggugcagggucaauacaaacaagagggaaaacaauacagaaggauuuucuuucucuuuuguagaguauaucuaaaggauggaggugucuggugccuccccgccccgccccccagcccccagucuugaucuaugccguggcucagcccugcugcauccacagaaaugagcaaaugggugaagguguccauuucaugggccccaccaugggcaguggauagugauuaagaagcucugcccucuuccauugcagugagacuaugugcuccaacuccagaaggggcuguguggaggcagagcaagaagcaaggaccuuacagguagcuucccgucagcaagcuaaugagagcaggaggccuacucucuugacagagccauaugugcaaauguuccccuccaugcacagcauuaugggacauuauccugacugugaggucaggaggaagcaaggaaaggaggugugauggugugagggugagugagggguguaagagagaggaauguuaguugugacugggaaaaaaaagggagucuauccugugcuacuagcagaaaggagugugcuggguugggagugccuuuggcacucagggauaacuaagacuggauaggggugcugggguuguuauggcagcauucccagugugcuccggggacccaauccuuugaagggguccaugaagucaaaacuauuuccauaagauucuguaacaucuuauggcccuuuuacucucauuaucauucucucauugagcauauaauggacuuuuccaaagguuaugagacaugugaugucacaacagaucaagugcugucuucaauuaagccagacccagagaagaucugaaaaauguacaaugccuaaauuuugcugggaaaagauaaugcauuuucauguuuacaaaguucuuuauguuuacauguaacucaguuuuaauuucuaauaugguaaauaucaauagcuauaacccauaugaacaaaaacucuuuuaggcucucaauaacugucaagaguguaaagagguucugaggccaaaacagagaacugcuacauuaggacaaacccugaccaaaacaaauuugauuuuuauccuguaggccagggaguccuuauuuccuaaguuauaauacaagcuccugguggacaggaauuuaauaguuuuucaaaugauuucagaaaaccuagcaccaugucuuuucauguaggcccuaaagaaaagguguuaaaauacuaggauaaaaaguaguaggaauuucuaagcaguaggaauucagagaaauacaaaauucaggcuggaggugaggaugagccagucuccaccuguuucucuguuacccagggcagcccugggcagaucugccauucuccucucccccacucccucccuaggguguggaggcccuguccagcaugaacaguauacucaagaaggggcugaccucugucucagcuaacugguuugguuggcugguugccagugucacuauacagagggaugcagauuuaaaaagaacagucugaacguaaaacaguuuuuuguggggcuagccgaguacacguccuuggagggguuuagauauugucagauguccuccgaaagguaggccaggcagccgauuuuggcccucuuaaaaugcugagcgcugacggugccugugagugauaaggcagccaacacaagggcugucugcccgucccuugcuuuugcugccuguuaaucacgaggauaagagcaacucaaugaagaaacaggcagaagucauccaacuuccuuuuggccgucagcacacugccgauaaucagauacuucaacccaccacucaccguggggccgcccccgugcaucuugagagcccugacaguggcaacaagcaccaccacgugggggcagaggccggaauaccggcauuugauguuaaaaaacuuuuccauuccaaugucugcuccaaauccugcuuccgucacuguaaagaggaaagcaacaguaaaaaugccaucccaauuccccugauguuaaaagaaacauacagucuauucacugguuuugcaaaaaacacuaaccuacaaacccuucugggccaacaagcuugagugcgauccggucugcaaugauggaggaauugccaugugcgauguuggcaaacgggccagcauggacaaacacuggagugcccuguggaaaccaggacaccgugagcugagcugccaauccugcuucaaagugggaucacacauucaacgguauggaauugauuuggaaucggaaggaagaauacuucccagagggaaaauauaaagucaucucuuuuauuucaguaacgucccagucacaggugugaggaagaaugagaagaaagagaugagcaaguggagaaggucuugacuacccagguuaagugugcuuaauuuuuuuuuuuuuuuuuugacacggagucucgcucugucgcccagucuggagugcaguggcgugaucucggcucacugcaagcucugccucccagguucacgccauucugccucaaccuuccgagcagcugggacuacaggcgcccgccaccaugcccggcuaauuuuuuguauuuuuaguagagacgggguuucaccauguuagccaggauggucucgaucuccugaccuugugaucugcccaccuuggccucccaaagugcugggauuacaggugugagccaccgcgccuugcaagugugcuuuauaaccacucugcucugacuguccaaaaccaauucaagaaggcaggagucacucugcucaccuccagugucugcaugagauugggcuugauugcguccuucauaagcacugucagugcaccacucacccccuacaaaacaaaugugugcagcaucaacucccaccagcaaaaaaacccaaccuucugaaaccaauauuugacauucuaggcuuacccauguuagccaucuuggaccaauugauacuuucaccugaauuggaccauucaugguuuuuuucuggauaugcuaugaaguugccaauuauuaaauuauuuauuuuuugagacggagucuggcuguguugcccaggcuggagugcaguggugcaaucucggcucacugcaagcuccaccucccagguucacgccauucuccugccucagccucccgaguagcugggacuacaggcacccgccacuaugcccggcuaauuuuuuuguauuuuuaguagagacaggguuucauuguguuagccaggauggucucaaucuccugaccuugugauccacccgccucagccucccaaagugcugggauuacaggcaugagccaccacgccuggccaaaguugccagauagaauacaaaugacauucacauguaauaucuggaaaaacauguaacucuagaaacaagcaucuuaaucaagcucagcugcugacugaugugagaaauccauucuagacuauuuuagagcacgacaaugcucguucccagaguacucaguuauuuguaacucugguaucugggcagaaauuucuauaaauaccaaacucaauaugugucuuccaaagcugaaacugcaauauuacgcaagaguucaauaccaacuuuuaacaucaggucacucuauuaagccaucaaaguguagcugaacuaccuagcaacaaagauaaagcaaugguacucuugauguucucugcaaauugaagucauacacccacuuuuagagaugcccacaggaugaagauguuacucaaaucaucuggaacuugugaucuauuacuaaagcauaccagcuauuauucacucugauguacuuuuuaaacauuucauaauuaucuuguaauuagcaaaauaggauuaaauugaugaauuaauugcaaugucuuaaguacagcauuacauuuuguuauuaauaacugcugaaagacccuaggacaacagacacagauaugucgccaagccuggcgugucuggguacccaccagaucuucggcacugacgggcucuccuuucuuacuggaugccaccaccauuuugcccagucucucucucaugucuucuagagaaguggugagagccaggacagccauaauuucacuggccacagagauaucaaacugggccugugggcagggaaaagagguacuagcaaaaacuuuguguuaaaccagaagugugaauugcaaaagugauccucuuuuacaucugaggcuuaaacaaauagcuuaaaaggauagaauaacagaauacuacccaaaauacuuaaugaaaauaauccucuaauagcaaaaaaauauauuaauuaauuauuccaagacccugaguugucauuuuuuuuuuuuuuuuuuuuuuuuggagacagagucucggucuguugcccaggcuggagugcaguggcacaaucuuggcucaaugcaacauccaccuccuggguucaggcaauuuucgcgccucagccucccaaguagcugggauuacaggcgcgugccaccaugcccagcuaguuuuuguauuuuuuuaguagagaugggguuuggccgggcugaucucgaacuccugaccucaagugauccgcccgccucggccucccaaagugcugggauuacaggcgugagccaccacgcccagcccugaguugucaguuuuuuaaaauaaauguuauaguaggaccaaaaagcuaugauuuuaucccuaugaaggccgcuuauaaucaugcgcuuauuguuucuuucauauacaagggaauaauaugguaccucuuaaaccaaggagauauacagugaaauggccacaaaaaagaagcaauuuuaaucaauuucuaugcaaggauauucacuuggggcucuccaccuccaggaaaaaaugccgggggaaaaacacacaggugacacaugggauuuauugcaaaagcugucaggagugcucaaugccacacaccuacucacuuccauuuuaaaagggagaaggcagaacaacaccuggcaguaucagucguaugagagaggauggaggaggagagaagcagcaagaucuagugccucugaacuaauuuccuuggaaagggacaaauuguuaccguccgugugugacccuucuccguuggagccuguccaaucgugaucuuccucaggaaucuaucauugguauccaacacuacagcagacaggcaagauauagaacgauuuugaguaaaaggaccacaaaguuaaaggaagcagcagaguuuuaaagcaauaagucuaauuucaugauugucuaucaauauuucaaaauggauggcaaagcuagaauauguguuaaaguuaagaaaugauguucauauaccauaaauacacaggaguuauuuuuacagcaaaggaauguggaauggcuugguuuuaucccaucuagagaauucaaacaguuaacuagaaaucuggaaucuauuuuaaagcauauuccacauauaagaaaaacagagcagucuacauuuuuucaaaagacugagguuuguguuguuguucugugggaugaugacucauugacuuuccaccaccguaagaaaugcaggagccaucaaaucagggcaagugcaaauaucuuuugaaacacgcugggugccaggccuggucuggaaauuuaggaaacauagcacacuuagcagagagaauuuuuauucugaugacagaauaucuauccaauuauauaaccacaaaaaacauggcaaagaccaagcaacuaaccaacuaacgaccucccaggacuaacuacuguuaacauuuuaguguacccucaguucuggcuuuugguauguguaguguaauaggaaauauauuugaccuuugucauggguuccugacaaaaggcucacagagcucuuggaauuccaagggugauaggagugucuuguuauucauuacaaacuccuuuugaucacaccugaguuuaugguaauaaguuacuuaugguaggucuccuagacagccucaggaaaggaauggucaccaaaaagaccaaaugauuagagggcuggaacuuucagucccacccaccaaccucuggguaagguguuagggguguauaaaacucuugaacaggccgggcacaguggcucacgccuguaaaucccagcacuuuggggggccaaggugggcagaucaccugaggucaaaaguucgaggccagccugaccaacauggaaaaacccugucgcuacuaaaaauacaaaauuagccgggugugguggugcaugccuguaaucccagcuucucaggaggcugaggcaggagaaucgcuugaacccgggaagcagagguugcagugagcugagaucacuccauugcacucuagccuaggcaacaagaacaaaacuccgucucaaaaaaaaaacucuugaacaacaugauuugaugagccucugggcuggugaacacauccaggugcugggagagugaugcccccuacgcuucucuuccaucugguuguuucugagcuguauccuuuauaauaaaccauaaacacaagugaaaugcuucucugaguucugugagccauucuagcaaaugaaccugagcaggggguuguggggacccuccaguuuauaaccaguuggucagaagcacaggugacaaccuggacuugcgauucgugucugaaguggggcagucuuuuaggacugagcccuuuaccuguaggaucugcuccagacaguuagugucagaauugaguuaaaucauaggauacucagucaauauccacuggagaagugaaagcugaauuguuguggaagagaaaaacuacccaucuggugucagaagugaggugcugagaguacuaugaguauagagaggaaacaggaguugccauuucaguaucaaaugccaaacaauaucaaagaaacacaaaauuaaauugauccauauuccuacuaauaacaucauugcugauggcugaauauguuuuagaacagaguuuuucaucuuagagauuggugaagcaguguaaggaugugagaagcucacagaguacaaauuugccuauauauuuuguggguuuuuuuuucaagauguuuucuauuucaaaauuaaaauaauuucaaaguaaaaacacacacacacacaaaaugaacaaaaaaacccaguucauacucuaaaugagucaaggaggagaagcauuuuuaaggcacuugauaauaugccaaauuauuuuccauaaagacugucauaauuucauaccaaaagcagugucuuauauagcaaucagacacacacaccccccacucuugcuguaauguguuguuaaagccaacccuuauuuuucaaaagaaaaaaguaucagguuucauguaacuaauauuucuguaaaaaauagcuagucaauagguaugacugccucuaguugcuuagaaaacaugaaugagacacgaagcaaaagaaaaguaaaucggauacuaaaucuucaaaauggacuuuuagcuuauuccuuauaaaauauuauaccauuugucuaaagcuauugaagcaaaggaagagaaauuccaaugugguuuuagacauugagagugucaucuaaauaaggccauuagcuagcaacgguuauugagucaaggaaaaucacaaaaacagucaauaaacuggccuucagcucuauucugcaugaguggaugaagauucuuucucaauagugauacagaauagaagguugcauuguugaugcaaagugaaaucuaagcuacacuaguugugcauugagaaaaguagcauauggcagugaagccaggaaaccuacuuacugaacugguaaguauuuaaaccuugaaggcuaccuaauaugcuauaagagaauuuaauaaaaugagguaaaaaaaugauuagguaggccgggugcgguggcucaugccuguaaucccagcacuuugggagccugaggugggcggaucaugaggucaggagauugagaccauccuagcuaacauggugaaacccugucucuacuaaaaauacaaaaaauuagccgggcaugauggcgggugccuguagucccaguuacucgggaggcugaggcaggagaauggcgugaaccugggaggcagagcuugcagugagccgauacugugccacugcacucuagccugggcgacagagcgagacuccaucucaaaaaaaaaaagauuagguaagcuagagaacuacagaaaaaaaucaagucauuuaugccacacaagaguucuaagaauaaaggucacacaugauucaagaagugauuaaacauaauuucucuacuucaugacacuaaaacuuuuugcauaaaauuaaauuuguaaaaugugauuuuugguuuaacuacccuaauuucagucaacacugaauagccagcaaaauguucgaccaauccaacaaagagauuugaugauagcuaauaaggagagauacugagagagguggcaagaaaaagaaauaaugucaccaucuuggucaugccuuagcugguaaaauaccaacauggaagcuucugagccucacauuuuaacaacucuucuggaggguguagggugugcaauauagccaaaacaaacggggcuuguauacugcucugguaccucuuugccaaguuaugguuucuggaucaauguccaaucuugcaaaucuguuuaucucuucaucugucagugugguagggucagucuuuucaaugccuagucucugaaaguguaggaaaaugaaaacauaaaauaagacaaacagaagcacaauaaacguaagacaaaaauuuugaccccuaccucuaaaugggauccccucuaggaaaugcaaaccaucuuaaauucagaaggaaaaacugaaagcuggggguuauuuccuacugucagccuaaagaaagacauuacaaaaaauuaucuccaaguagguugaguuuauucaggaaugagcaacgaggauuauaaccugggaugccacaaauaugccuagugagggaagggaagauuuuacuagcaaagaaggagagcuucagcuaggcgugaagcucagccuguggcugagccuguaaucccagcacuaugggaagcugagaugggcagaucaccugaggucaggaguuugagaccagccuggccaacacggugaaacccugucucuacuaaaaaauacaaaaauuagcugggcaugguggugggugacuauaaucccagcuacuugggaggcugagacagcagaacugcuugaacccaggagguagagguugcaguaagccaagaucacgccacugcacuccagccugggugagacuccaucucaaaaaaaaaaaaaaaaaaaaaaaaaagaaaagagggagagcuucacguagucugcuuagagaguucaggucaaggcugcagugagccaugauugugccacugcacuacagccugggugacagagcaagacccugucucaaaaaaaaaaaaaaaacagaauucaucgcucccagaagcucaaagccagaguugucaauucauuggugcaguugccguugcuggauaaguguacuuucaagagcaucuuaucugaauuacucccauccugaagaaugucuagugauaagucuugucauggaaacauaaguauacauuugaaaugugcaagcugugcaaagcaggagaugugugaaggacgugaagggauuucuuuugggguuuuauaaaguuguuggaaacaauuuuugcuuuuguuuuuuugagaugaggucucauucugucacuuaggcuagauuauaguggcccaaugauagcucacugcaaccuugaacuucuggguucaagggaugcuccugccuuagccucccgaguagcuggguauaacuacaggugcaugccaccacaccuggcucguuuuuaaauuuuuuuguagagacgagguuuugcuucauugcucaggcuggucucgaacugcugggcucaagucauccuccugccuuggccucccaaagugcugggauuacaggccuugcaaacaguucuuaucacagacacguaaguguaagccuccucuucuucauguuuucccagcccuguuuuuucugggucugacaaaagugauuuuaucccgauaucugcaaauucacauuacucacacauguacaaagguauuauuaacauguuugucccuauaacugagcaccagaagauuucccuaagccuagaccuaaauaaucauaguaucauagugaccaagaaguguuguaaaacacaaacccaauuuuuuuugagacagucucugucugucacccaggcuggagugcaguggggcauccucagcucacugcaaccuccgccucccagguucaagcgauucucuugugucagccucucgaguagcuggggcuacaggcgugcaccaccaugcccagcuaauuuuguauuuuuaguagagaugggguuucuccauguuggucaggcuggucucaaacucccaaccucaggugauccaccugccucagcuucccaacguucugggauuacagguaugagccaccacgccuggccuccucaucucuuaaaaaaaaaaaaaaaaaaaaaaugcugagcucagugguucaugcaaguaaucccagcacuuugguaugccaagguaggcagauugcuugagcccagaagcuugagaucagccugggcaacacggcaaaacccggucucuacacaauauauaaaaaucugggcauggugguaccuggcuguagucucagcuaccuaguugggugaggugggagaaucacuugaguccuggagguugaggcuguaguaagaugugauugcaccacggcacuccagccugggugacagaguaaaagcuuuucucaaaaacauaaacaaacaggccggguacaguggcucacgccuguaaucccagcacuuugagaggccaaggcgggugggucaccugaggucaggaguucgagaccagccuggccaacaugaugaaaccuucucucuacuaaaaauaccaaaauuagcugggcaugguggcaggcaccuguaaccccagcuauucaggcugaggcaggagaacugcuugaaccugagagguggagguugcagugagcugagaucacaccauugcacuccagccugggagauagagugagacucugucuuaaacaaacaaacaaacaaccaaccaauaaauuuuugaaaaauuaaaaaacagaaaaacaaaaacaaaaaaucccuuguggccagacgugguggcucacgccaguaaucccaacacuuugggaggcugaggcaggaccaucgcuuuagaccaggaguuugagaccagccuggacaauauggugagacacggucucuacaaaaaaauaaaauaaaaaauuagccagguguggugguguguguaccuauagucccaggugcucaggaggcuaagaugagaggauugcuugaaccuggaagguggaagcuauagugagcugugauugugccucugcacuccagccggguuacagagagagacgcugucucaaaaaagaaaacaaaaaacaaaacaaaacaccucuccuuugcuguuccuuuauggucauacccucccuucauccauacccuuaacaucuauugaucuguucccuagcacuauaguuuucucuuauugagaauaucauauaaauggaggcaugcaauaugcaagcuuuugagacuggcuucuuucacccagcauaaugccacugaaauucauccaaguuguugcuuguaucaauagcucauuuauuuuuauuggauggauguaccaguuuguuuauuuauucauccaaugaaagacauuuagauuaguucccaguuuuuggaaauuauuaauagagcugcuaaaaacauuaauguacagauuuuuaugugaacagaguuuucauuuauuuugggugagauuucugggucaggugguaugguguaugcuuacuaacuauguauuuguuacagaaauucaaauaaaauauagauauaacuaugguuuuaacuguuuaacacagacccuuaucuauucagggcaaggcaaguauuauuuuacagacaaguaagcggagaaacaagucauuuaacaaauuugcuuaaggucccaaugaugcaaacuccaaaggcugcuaugccgccacagugacauccugacucuuguucauguuauaaaggaagugucguuucuuucuuagcugagggcagguugucaguguucuauuuauuccacacuagccacuucuaaucuauagauaaaugagaaauaaccucuaccauccaucuuugcuauguauaucaugacuuuaagacuaugauuacugauguaacuucaucuaaaauaggcuacuccaagaagacuuuuauguccuaaucaaugaucagauuccagauuccauacaauauaaaaaauguggaagaaaaaaagcuuaccuuuaaccuucggauuuggaugucagagaaccuucucacuccauuuacugauggcaccaaacgauuaaagagagccuuaaagaaaagaaaggggcuuuaaaaugagaggagccccacugcuuugcuaccugcauccucagcacccaagacaccaacacuaauucagaugguucaauacuuucaaaacuguucaaugggguucauggggcuuuggcauccuaccuugucugucugggucaguucaugaaauauccgagcaucaauggccgcagcaacgagguuauuagcugcagugauggcauggaugucaccugugagguggagauuaaacuacaaaagaacagaagccacauuagucucccagcugcucuguaucuuuccaacuuucauucuauugcaaagcucaaucccuauuuuaaagccaauggaauacugaaggcagcccaguuaguggacaaacacccaauauagggaguucuugaaaacauaaaugacuggcugggugugguagcucacaacuauaauaccagcacuuugggaggccgaggcgggcggaucacuucaggccaggaguucaagaccacccugggcaacauggcgaaaccccaucucuacuaaaaacauaaaaaguagccaagugugguagugcgcaccuguaaucccagcuacuuggaaggcugaggcaggagaacuugggagguggagguugcagugacccaagaucacaccacuacacuccagccugggugacagagugagacucugucuuaaaaaaaaaaaaaaaagaaaaagaaaaagaaaaagaaaacauaaaagacuaauuaucuguccacagaagaaucuccucccaaauacagaacuugcaguuuuuccaaaaugagauguccagagaccacaaauaccacaccacugggaucaacagccacacuggguuacugaggacacaccucaaaacagcgaggaggagugcacgggagcagcaccgacucuaugucuauguaauguuccaauuucugcaguuacauaaaugaauucugaaaucgcuguguguuggugcuucccgauaccaugcuucauuuggucauuugcuuauaauaaucauucccacugaaagccaaaguuugaaaccaagcuguaucacaagucugcaaauuaaguuguuuucccccuagguguugcuuuugcugagaaacaagucauuuguccgcuaagagcucuacaaaaaaggcuaaucuccagagagaaaaagcuauaauaaagaaucuaggcugggugcgguggcucacgccuauaauaccagcacuuugggaggccgaggugggcggaucacgaggucaggaguucaagaccagcuuggccaacacggugaaaccccgucucuacuaaaaauacaaaauuagcugagcgugguggugcaugccuguaaucccagcuacucgggaggcugacgcaggagaguugcuugaaccugggaggcagagguugcagugagccgagauugcgccauugcacuccagcucugggcaacagagcaagacuccgucauggggaaaaaaagggagcuaauucagcacccucccccccgacaaaaaaagggggaucuaauucagccaaaucccagaauacuuuaccucuuccauaggaaugaccugggaguagccgccuccugcagcgccaccuaggggacaggucaaggguggaagcucaguuaagcaugcuucuccaaugacuuagaaaucaaauaaaugcaaaugcauuauuguaacuacuaagcacauuuauuuauuuauuuuuuagaaucauuuggacaguuuugaucaaguguuuucuaauacuagucucucaauugaaaucugaguuuaaaugacaaaaccaugaacaaauauauaccuacucauuaucuuuagaaauauguuccuuguaauuacuggcauuuguuaaaacacccagcugacaguuacauaaaggcaaccuguucaauuuccuacucucauaaagcuacuuuggcuuuuaaaacagaaauauuuaaaauacauacaccuaacaaaaagacuauaauuuuuccuaaauagagauaaauagauuaggcuguuagaaagcagccuaauugcuagauuuuuuugggcuacuuggauuacagguugaguaucccuuauuuaaaaugcuuggauuuggguuuuggauuuggguuuuuguuuuccagauuuuggaauauuuucaucauacugauccagcaucccaaauccaggauuuaaaaucugaaaugauccaaugagcauguccuuugagcaucgugucagcacucaaaaaguuuagaauuuuggagccuuucagauuucagguuucuagauuucugaugcucaaucuguauuagccaaaagccaguugaaaauguucaggacaccaagcauggcugcucaugccuauaguccuagccugggagaucaaggcugcagugaguuaugaucaugccacugcacuccagccugagcugggacuccagacagagcaagacucugucucaaaaaaaacaaacaaacaaacaaaaaaaguccagguuaccacauuaucagugcaauaaauguaaaucagauauauauuuuuuuagacagagucucauacugucucacaggcuggaggguaauggucugggauuacaggcacauaccaccaugcccagcuaauuuuuguguuuuuaauagagacgggguuugccauguuggccuggcuggucucgaacuccuggccucaaguaaucuaccaccucacccucccaaagugcugggauuuuaggcaugagccacugcacccagcccagagauauauuaauauguauuuuguuuuugugaggcagagaccgugcagugaggcaauuugcaguaagaguaaaaggaaaauaauggguucaauaagcagaacaaggaauagcucgugcugaaguugaaaggggguuaagacaagcucaagagcagaacaaagugauuacauuuauaaaauagguggaagggugggcugggcacgguggcucaugccuauuaucccagcacauugggaggccaaggugggcagaucacaaggucaggaguucaagaccagccuggccaauauagugaaaccccaucucuacuaaaaacacaaaaauuagccaggcaugguggcacgcaccuguagucccagcuacuugggaggcugaggcaggagaauugcuugaaaccaggaggcggagguugcagugagccaagaucgugccacuguacuccagcccaggcaacagagcgagacugugucuccaaaaaaaaaaaaaaagguggaagggugaagguguucccggugucaacauuuguaguaauugcuagaacaagcaaaaugugauacccucaccaagcagagaaagcuaacucuaagaaccuaucauaauuaauaaacauuauuuuaauuaagacagcagcuuggcacgguggcucaugccuauaguccuaccaguuuggaaggcugagacaggcagaucacuugaggucagaaguucaagaccagccuggccaaaauggugaaaccccgucucuaccaaaaauacaaaaauuagccaggcauggucaugcgugccuguaaucccagcuacucgggaggcuguggcaggagagucucuugaacccagaagguggagagguugcaaugagccgagaucacaccacugcauuccagccugggcgacagagugagugagacccugucucaaaaaaaaaaaaaaaaaaaaaaaaacacauguucuuaguaccgcagcaauaaaaaucugaagguaaagugcgaguaugguaguaauuuagagcuugaaauagacauggaagaaucacucugguacuuaauacaggugccuuugaccaagccaccucugaagucccaguugcugcuauuuuaaaauggugacaauacuaucucguacuggaugauagaauaauaugcaaaaacugcucagcacaauaucuggcacaaagcauauauucaauaaagguaggcuuuucuuauucccaacaaggugaaacaucugugggguuugucauugucucuagagugucuguaagaugaucaguagcuaugauuaccuuuaugguuacuguagcaguggacuaugagggucaaauaaaagcaccuccagcuacauaucacccaucccagagaaucccugugcaguggccaacagugacagcaggagcuggggagauccaaugacagccuucaucaaaagcaugacuacagagguuugugagaaugacauuccugguguugaaaugaguugaagaccccauaaguaucauagguugcgugggccugggaggacugaaggagaagcagguccccugucaccacccaugguccagucucacuaguaccuuuuauuccaaagguggggcccugagaaggcugucgcacacacgcaaagacauucugguagagaugggcaccaagggcuugcacuagcccgauuguaguugugcuuuucccuucucccagggguguuggaguuauucuucaagacgaaagcaaaagagaaaaagguuuaaagaauuaaguguaucugaaucacuaagucauaccuagcagauccuagagaaugacucguaaucuaaagauuaagaaagacaaagucaggcauagcaguguaugccuguagucccagcuauauaggaggcugaggcaagaggaucacuugagcccaggaguuccaggcuacaguaagcuaugacugcaccacuguacuccagccugggcaacagagcaaacccccaucucuuaaagaaaaaaaaagaaagaaaagacaaagaaaaagaaagacaaaagcccugaaagauaucuuuuucaaaagucuuaguuguaauuuccaaaaaacuuuaagaaaaaaaaugauuccuguauuuuagcucuucuugcuguaagaagcaaauauacuuuaucuuguagagacacggcuauaauuuuaauuucucauuuuauauucucaaaaacuagcuuuuuaauauaaccucagcccagcaauaaaaaugaaugcuuaguaaauccaucgaauuaaugaauuuuggguucaaaaaggugauucuggccgggugugguggcucacgccuguaaucccagcacuuugggaggcugagguggguggaucacaaggucaggaguucgagaccagccuggccaacauagugaaacacacucucuacuaaaaauacaaaaauuagcuggguguggugccuugcaccuguagucccagcuacucgggaggcugaggcaggagaaccgcuugaacuugggagacagagguuguggugagccgagaucgugccacugcacuccagccugggcaacagagcgagacucugucucaaaacaacaacaacaacaacaacagcaaaaggugauucuaucuuaagaccggguuuuaagaccaaacucuuccacuuacuagauggauaaccuugaccaauuuucucaucuaugauuauaaucuauucuuaccuaccucucaggauugcuguaaggaucaaaugagaucaaauacgggugaaaaugcuaaaaucaaauuaaaggcaccucuacauacaugugccaagugcaaaugcaacgccuuaguaucaggacugauacuaagauuuggauggcaacaugaauaaaaagcauacccagucaccaccacguauuucccaucaggccggugcuucaggcguucuagugcugacagcagaacuuuggccuuuguuucaccauauaauucuaccucuucagacagcagaccaauuucucgagccagcuuaccaaugggcuucgguuuacaagaucgugauauaucaaugucacuuuggaaacauagaaaauagguauuaauguuuauccacugaguuuaauuaaucccacaguaguaacaagcccccaacccaaccccaaccacugaaggcaccuucagagggagcauaugugaacccacaguaucugucaacuaaaaaccaacaauucacaaaguuuuaaaucaguaaaacuuuauuuuuaccuuggaacaggugucuugagguuaagguuguuauacugaaucauccacuuuccuggcuuaaauuucuccaggaaacgcuuggcacucucuacugugcucuaagcaaaaugaaauaaaugaaacuuagaagaggugguuauuuuaauccucaccucaguuucaagcuccaggucacuccaguucaaucacaaaaugaacugcuucagacccacuuauuaccaugcuucaauccuagcuaagagucaagaggcaccuaacaugcuuuggggcugcucgccuggccccugucagcuggugcauguuagaaagggaaaacaggccgggcacgguggcucacaccucuaaucccagcacuuuggaaggccaaggugggcggaucaccugaggucgggaguuccagaccagccuaaccaacguggagaaaccugucucuacuaaaaauacaaaauucgccgggcgugguggugcacaccuguaaucccagcuacucaggaggcugaggcaggagaaucacuugaaucagggagauggagguugcgguaagccaagaucacaccauugcacuccagccugggcagcaagagcaaaacuccgucucaaaaaaaaaaaaaaaaaaagaaagggaaggcaaaccaaaacagaccuggccaagccagugugaucgcacuuuucuucuuucaaaguuauuauauuccaaaacagacuggaauuaugccaucccuacuuuccucuauuaaugugccugaucuuauuucucuauucuucccuucccuuuuucucaauaaauucacaucuuuacuucugaguagguuuuugacauuucuacuuggggagaaaagcagccaaaacucgaucagcuuuucagaacucuuauagaaacuuuuauucacaauuaccugcaugagcauugcaacugucaugggcccuacgccgccaggaacaggagugaugaagcucgcccucucuuuggccucgucguaugccacaucacccacaacuuuucucccauuugguuuuuuaucaucuggucaagugggggagaaaucaaaacuaagucucagaaucacaguccuggugaucaguuacgacaaaaacucagcagaauuguaggguguguuagucccaucaggcuccagugccuacuuaacuuaaaagcuauggaaugacagauguuugcuauuucuuagggagaaaauuauuuuaccugcaaaaauucacaagaugcauaagugguuuuacagaaccuggagaauccuuuuguagucucucagguggcaaauaaaauaccaacuguuuuuuauucuuaaaaccaacuacccaguauauaaugagcacccauuuuaaaauguuaauuugcuaaagccuacaaaggaaauuuuuugggugcacaaagauccaacucugucacagcugccagauaucguuucuacagcaacugucagcauuuugugagcuccaugugugagcuggaggaacaauucaacauccaauuccaaagacacagcuacuuaaauguaugcuaaaggcaaagaauauaauuacacuucccuuaaaaggacacaagaacaacuacaaaucuuaccagcaaagaauagcuauucaagagaacaaaacccaaugaugcaucauugcucacucacacaaagaacauccuacacuuggcuucagugcacuuccaggaggggcugggggcgggccuagaccucgaagcaauaaggcucccgcgcugcaucugguaguuuuagcgacaucaccacuucucucugaucagaucgccacaacugagaagaagcuccaagguggaggcaagaagccagaauuaagagauuagcaggcacuuugggaggccgaggcgggcggaucaccagaucaggagaucaagaccauccuggcuaacacagugaaaccccgucucugcuaaaaauacaaaaaaauuagcugggcaugguggcgggcaccuguagucccagcuacuugggaggcugaggcaggagaauggcaugaacccggggggcggagcuugcagugagcggagauugcgucacugcacuccagccugggcaacagagcgagacucugucucagaaaaaaaagagauuagcuguagcaucagcucuuuuauuaaaaauuagggccaggugugguggcucacaccuguaaugccagcacuuugggaggccaaggcggguggaucaccugaggucaggaguccgagaccagccuggccagcauggugaaaccccgucucuacuaaaaauauuaaaaaaucagcugggcuugguagcgggcaccuguaaucccagcugcucagaggcugaggcaggagacucacuugaacccgggaggcggaggcugcagugagcauuccacuccagccugggcaacaagagcgaaacuccgucucaaaaaaaaaaguuaguucugcagcuccugugggcuccauauuaaucugaaguccaaaaugcaaagaaggcuuaacacuaccuaucacaaauuugcugagggcaaaaugagaaaauguguacauuacugaaauugaaaaagcagccuccaaacgcaagaguuucucuuuccaccacagauacguaagauauuuuuuauauggaguaaaaggagcuggucaacacaacucauugggaugguuucaaguuucuagaagauuauaaagcagcaaacuggcagaacauuuccucuuacagccccuagagucauuucaaaaugccaaggaaauauagauagagguuugcccucuguacaaguuucaaucgucuucacacuguaguuagcuugaaauacccgcugcaucuauuucuacguguuaauguuagucauuuucguuuucccacagguaagagacacauaucuuugacuacaugacuaaacgcagcacuggugaguucaguuuugcuccuaaaccaaauacugucaggguugacgagacacugcuaaacaugcagugcuucguggauaggaugauguggucaguggaaaaagugaccacuacucagccuaagcauaugaccucaguaaugagcaaaccuuuugguuaucuacccccagcccuagaauuucucuuucuuugggaaaucacauguacaaaaaucaacuaaagauccagcugagcccugacucuucuacauuuaauuuggggacccuaauaauagaggccaguccagaagcagcuacacuggauagguugagacuggauugcauuaggguggggaaucuguucccacuuuuuaacccuuccaaauaaaacacuauugaucuggcccuucucaauuuaucuuuaguaagccaagcaggaagagcacuuuuauguguuucucuggccaauacuuucugcccugcacuugaaucuuuaaaaauauuacuucuuuguaaaagguauacacaccuugauucauucuuaauuuggcaagugacuuacaauguuaucccugaguggaccaugcaaacuauuuaaauaaucaaaauaugaaccaagaaguagcucggugguagaaaaguuugcuucuaaagugaacauuugcaaauaucagucuuuagguccugcagcccauuugcuggucuguaacugagugauucugccauccuuuggggaacacaauaacauccagcuguaucagcauuaauuugccuauaugcccaagaucaguaaaaacacuguugaccagaagggaagauacugcuuugauuuuauucauauuuuauugucuacauaaggaaucaaugugaaaaggauggcaaguuucauguuuaagucaacauuuccuaccuaucugcaacacucaagauccccacucagguuuuucuucuccauuucucacauguaauccaaaaaaaaaaugccaaaagcagaaauaugauacagaagaugcgagguuuuaaaaagacugagcuugcugggugcgguggcucacgccuguaaucccagcacuuugggaggcaaaggugggcggaucacgaggucaggagaucgagaccauccuggcuaacauggugaaaccccgucucuacuaaaaauacaaaaaaaauuagccgggcgugguggcgggcgccuguagucccagcuacucgggaggcggaggcgggagaauggcaugaacccgcaaggcggagcuugcagugagccgagaucgcgccacagcacuccagccugggcaacagagcgagacuccgucucaagaaaaaaaaaaaaaauuaaaaaaauaaauaaauaaaaagacugagcuugaaugucauaucgcaaguauucaaagugaggaguuguaggagagcaauuucuuuaucgccuguuagauaauuacacuacaagaaaaugagugaucaauuaugagcuacugucuuaaaagcacgguagggagagugggagggagguuaaaaacggugaaggcuugacagugacuaauguuccuggcagcucagcgucuacaucugaaacuugagaugggaagggagaaaaaagacuuccagcuauaacucccuucgacaauucaauagauaugagugccaguggucagauggcaggaagcuggauguggcgccacagugaccacugcccuugaggagcuaucuaggcaggagagcacaggacgccguacaugagacacaugcaacaaaagauacaauacacauguucuaugggagaggagggagggagagaaggaaagaucaucccuugauaaggggaaaucaaacaagguuuggaaggaauaacagacaugacagagaggagauggggaggaagcagcugaaggugaaggugaaguugaaccuuauucaguuguguagcccaaggccuggcauugugcuggauacacaguaguugcuccguuaaagauuguuccuuucuuggaucuaugaggacguacgcaaguuuugcccuauuguucugugaaguuuucuguuugaaagaguagcccacuccacuaagaaugcaggugagggaacuacaaagggcaaacgaggcaugcgcagggaagggaaagugguccacuuuacaaguugaagacagguauucaccaugcgcaagugagaucacaggcugcagaggucacugaaauuagugugaggcuaaggagucuggcaaguaagaaggaagaggcucagaguuccaugccagaaggugaacguggcaaggcgagagcacggggauagaucugagugggaagcagcuggagggagggacaccugcaaggaaguuaucacagcccaucagcugagaagguaacacucaguggugacacucagaacagaggagagagaaaacaauuccuaauauuuagagacugguccaauauagggaaugcuugggagggaaacuaaaaggcuucagacuugcgggaaggaagaauggugauacuaaccaaaagacgggaguaagggguaacuuggggaugaggaugccgaguacaguuuuggacaugauuaaaaggcuagauuuauccucucagccuagaaaaaaacccaggucaaauaucuucuuuguaaagcccuccucuuggcagaaugagucccucuucuggacucucauagcacuuugcaauaauuauacuguauuuuaaauccauccaucaacuuugcuaaaauaaagggugaucucuacaugaagauaaagugauauaucccuccugcccucccucucacuuucucccuggacaaagucaucuuggaagcuguacagcacaugaugaaaaucaaaggcucuggcaccaggcagaccugccugcaaguggcaacucuucuaucuacuaacucugugcacccuugggcuagucagucuccuaaaccuuaguacuacaagcauaaaaugagacaagcuucucucucaggcuucuuuugaugaccuagauaccauccucaauaccagcagccaccuuacuccuccaacaacacucaccugggacauaauugauuccacagucgaugacuauugccccagguuugauccacuccccuuuaaccauuucaggcugaccaguugcaaccaccaggaugucaccuuuauuuaccuagggguaggggauuuggacaucagaaaugaaauaaugaaauacacaccaaaaaaaaacccagaaaugaaaaggauaucccugagcuuuguauuaaauucuuaagugucauaagcuauuucauaagauauuggguuaaggccucaaauguaagccacacacuguuucugacagcccuucacaugccgugcucauuucuacacaugccaaagagcucccuuucaccagccauuuuacccaauagggaaaucagugucaaccugcaaggcagaggggcaaacaggcuuggggcccugcguguuauguccagacacugcuccuucuccuacagaauguagagcacuacuuugggaggauuaaaagagaaaguacuaggccucucuccugcucucuccccacauuuaagagacugcacugucaacaggcacgugugugugugugcgcauucuugggcucaggaaucugaugcagggaucuagaacaagcugccauagcuauuagcagacuacugcccacgacugccucuggagcaccuucacucugaggccaccacuuuuacacacaugggaucuggcugccagaggucaaucugagugccuguacugcuaaucccuguccaccacgaggcagauuaggguagaaaguacuuggugagaggccaggcauguugggucacgccuguaaucucagcacuuuaggaaggugaaccaggaggaucgcuugaguccaggaguuugaguccagccugggcaacacagugagaccccugucgcuacaaaaagcuuaaaaauuagccaggcaugguggcacaugccuguagucccagcuacucagaagguugaugcaggaggaucacucgagcccaggaguucaaagcugcagugggcucucauggacugccacugcacucuagccuaaauaacagagcaagacccugucucaaaagaaaaaagacaaaggucgggcaugguggcucaugccuguaaucccaguacuuugggaggccaaggcagguggaucaccugaggucaggaguucaagaccggccugaccaacauggagaaaccuugucucuacuaaaaauacaaaauuagccaggcgugguggcacaugccuguaaucccagcuacucaggaggcugaggcaggagaaucacuugaacccaggaggcagagguuguggugagcugagauugcgccauugcacuccagccugggcaacaagagugaaacuccaucucaaaaaaaauaaauaaagaaaaaagaaaaaggaagagagaaaguacacagaacaaacucuguauaaacuucagcaugcuuuuaauuuuauguuuuuuuuaauuaauuaauuuuuuuuuuuuuuugagacagggucuugcucuguagcccaggcuggagugcaguggugugaucguagcuuacugcagccucgaccuccugggcucaagcaauccucuugccucaaccucccgaguagcugggacuacaggcaugugcccaccccaucuggcuaauuuuuaauuuuuuuugcagagaaagcgucucacuauguugcccaggcuggucucaaaaacucuugggcucaaacaauccuccugccucagacucccaaaguguugggacuacaggugucagccaccccacucagccuuuaauuugaauuuguuuuuucaucuuguaaaaaugagaugaugggguuaaaugaggucaugaguguaaaggacauggcagccucuggcacacccacccuccccaccguaacaccuuuaccucuccucuggacacccuaccuccucauccagaugggcagucuuggaguggcagguggucacuguggcauuguuccacagaagcaagucaugcaucggggccccaacuauuuuacugcgcccaaccaccacagcaugccuuccggcaaucggcaccccugaaagaaaagccagccugcaucagaguuggaggauagaagcugcccuccuucgcaugccacguggagaaauuagaauaagugcacaaaaacagguucuuaacaucaaacagaaaccuuccuaaaagcauuccuucuuuggcaauaauauucucaacucuaggguuucagcuauaaauugggacuuguacuuguguccuucuggccguggguuuuugggagcagcuuaagccaagaucauucauugagucauaggggagugggaagaaaaccuacacucaaagaaaaaagaaacccugacauacagcuaaucagccauacggaagaagacaucagauuaaauuacauggggaaaaaaaguuaaaacaaauaggguguauguaacaggcuggagagauguguaagaaauuagauuaguaucgguaauuccuucuaacuuugguaaguuuguuuauacaguuccucacccaaauuucucuuuuggcuuagggccugagccauaggguuacuugcagggaagugauaaaggggaaauugaacuguggcagcaaagcuuucuuuuugcuaucacagcauccauuuuucuggcaauauaccaauguccuuuucagggcugacucauacucuacuaaagacagccugagugaguacccaguaguggacaggggaccauauuucuucccucagcugauaagauccaaucccaugacuguuaggcaugaggauggaaccaggcuguagguguuuguggccacaaaguggagcccgaaaaugagcuguccacaaagaagaaagcagagagaaguugacgacuucaucagaguccucagggcagucaaggcugagggcaguggacccuugcucaaagcagcaaggguuuaaauugugcuucucgcauaaaaucauuuuuuuucagaaaaagauaaacucuuauaauaaugugaacaucaugaacaucuagaaguaaagaccucaaaguuuuaaaagguaacuuucuauacuuuuuaggauucagcagaagaguuaaagcugcaucagggcaaaugguagcaucacucaauaagaggcagugggaggccuucaggugcuguccucgugggauuuuuuucuuuuaagcaaggcacuacaauguuugcuaaauaugcugaagaauauacauuuaacuguagaaaugaacugucaaagcuugaccuuugaccuuuucuugccaaccacagaaaauuuucauuuaugcuggccaaaacuuuccacuugaaacuucugaccuacuucuuuuuaccaggacccauuuccuuguaaaaaauaaccucugcuaaaaguauucauaaugaaauuaaaauagcaaggugcuaacuaguaacgggacaauauggccaacugugcaggagacccauuuccagccaucugucgaguccuggaacuacuguggagauucagugcccauuuuggggguggggggagguggggcuuuucacuucauauccuuuuaaacuauccaaauuuuuauuacuguauagguuaaaauaaauugcuuugaacucagauaacucugaauucaaaucuugguuccguugucucccagacaaguuacuugcucucucugagcugguuuuguuuguuuguuuguuuguuuguuuauuuuagagacagagucucgcucuguugcccaggcuggagugcagucaggugaucucggcucacugcaaccuccgccucccagguucaaucaauccucccaccucugccucccgaauagcugggaauacaggugcaugccacccugccuggauaauuuuuuuguauuuuuaguagagacaggguuucaccauguugaccaggcuggucucgaauuccugaccucaggugaucucagcccgcuucagccucccaaagugcugggauaacaggcaugagccgcugugccuggccugagccuauuuucuuagcaguugaacaauaacaguaccuacuucacagaguugcugagaaaauugagagaaaauuuagguaacauccuuaguagacaggcccuucugccaaucaaguccauuuauuuauggcccacaauguaccuccucuaugccaccacaugucaagaccaggauucaggaaauggugcuuucuuguuguuugguuuguuguuuuuaccugucucuuugaugaguuccaagcaucccuuaggcguacaaggaaugaaacagucauugaggucaccucuagcaaguuucccagcauugaugcuagucaaucuuaaaaaagugauggaaauaagaaggaaauaaaggcaauuagaugucuuuacucuuuagaaacauuuaugcuguauuccccaaauagaaacauauuauaaaugaaagcaugcaaugagacauaggaagccaagccacacuuacccauccacauccuucucgggugcaauagcauugaucacuucuucaguguuaauggaauucucugaaucuaaagguagcugcacuaagaacccauguacaguagagucuucauucaaagauguaauguacuucaucaccuaaaaguaauaccauauauaauuuguauaucacacagaaaucaaaagguaggaagaaacacuuucuaaggcaaaaauuagguugcccuauuuccccccaacacuuuaauuauaguccuuucagaauguaccuuccccuugaauccugagagcaccuguacuuuaacauagaaugcauccccuaggugucugguaagaaguccaucaaauaaaagagcuaagaggcugggcgaggugucucaugccuguaaucccagcacuuugggaggccaagucaggaggauuacuugaacccaggaguucaagaccagccuggacaacacagugaaaugugauaucuacaaaaacuuuuuaaaaauuagggccaggggcugggugcggugguucacgacuguaauuccagcacuuugggaggcugagguggguggaucaccugagguugggaguuugagaccagcugggccaacauagugaaacccugucucuacuaaaaauacaaaauuagccaggugugguggcacaugccuguaauccuagcuacucgggaggcugaggcaggagaauugcuugaaccugggagguggagguugcaguccgcugagauagugccacugcacuccagcagugaguugagauugugccauugcacuccagccugggcaacaauagugaaacuccaccucaaaaaaaaaaaaaaaaaauuagggcugggugugguggcucacaccugucaucccagcacuuugggaagccaaggcaggccucccaaaauauagaaaauuauuuucuauaauuugcaccuuacaauacaauagcagcuacuggaucacuugaagccaggaguuugaaaccagccuggccaacauggugaaacccugucucuacaaaaauauaaaaaauaagccgggcauaguggcgcaugccuguaaucucagccucucaggaggcugaggcaugagaaucgcuugaacccaggaagcggaggcugcagugagcugagaucaugccacugcauccagccugggcaacagagcaagacucugucucaaaaaaaaaaaaaaaaaaaaaaaagcggggacaggugcgguggcucacgccuguaaucccagcacuuugggaggcuugagugggcagaucacuugaggucaguaguuugagaccagccugggcaauaugggcaauuaaaaauacaaaaauuagcugggcgugguggcgcaugccuguagucacagcuacucaggaggcugaggcaugagaaucgcuugaaccugggagguggagguugcagugagccaauauugcaccacugcacucuagccugggcgacaagaguaaaacucugccucaaaaauaaaauaaaauuagcugggcaugguggcucaugccuauagucccagcugcucaagaggcuaaggugggaggaucacuugagcuuaggagguugaggcuacaaugagcuaugaucacaccacugugcugcagcugaggcaaaagagugagacccugucucuaaaaauacaauacaauaaaauaaaaagagcuaagaacucuaauaacuuauuacagcaauaauacccauguuacaaucauccaaaucaagauguagagcagcaauguccaaucaucuuuucugcgauggcagaaauuuucuauaauuugcaccuuacaauacaauagcagcuacuuaauccuugcaaaguggcuaguacaaccaaggaagugaauuuuuaauuuuauuucauuuuaacuaaauucaaauagccucauggggcuaguggcucccauacuggacagcgcauauauggaacauugccauaaccucaagaaaguugcuuuauccuccuacaguuuagcauuaaucucccaccuacaggcaaccacaguucugacuuuaaucaccgcugauuuguucugccuaguccugaaccucauauaaaaggaauacauauuugguuuuuagaaugcagauaauuacaggccaaggaucgguuuuaccuauuuuuuugagacggaguuuugcucuuuuuucccagguuggagugcaaugguacgaucuuggcucacugcaaccuccgccucccggguucaagugauucuccugccucaaccuuccaaguagcugggauuacaggcaugcgccaccacgccuggcaaauuuuguauuuuuuaguagagacaggguuucuccauguuggccaggcuggucucgaacucccgaccucaggugaucugcccaccucggccucccaaaaugcugggauuacaggcaugagccaccgugccuggcuccaaggaucaguuuuaacaaacacaacagaugauuuggaagcaaacaguacugcagucacacuuugaguaccaaauguucaucccugcaccaucuccucugugggagucugugaagaaagaauaccuggaggugccaggcgugguggcucacgccuguaaucccagcacuuugggaggccaaggcggguaaaucaccucaggucaggaguucaagaccagccuggccaacguggugaaaccgcgucucuauuaaaaauauaaaaauuagccaggugaggcggugggcgccuguaaucccagcuacucgggaggcugaggcaggagaauugcuugaaccugggaggcggagguugcagagagucgagaucgcaucauugcucuccagccugggugacaugagcaaaacugugucucaaaaaaaaaaaaaaaaaaaauaccuggaggucuuggcuaaaugugucaguccccaaagcccccguaaaccaaaaccagagaggaaaccacuucaccuucccucuucacaaucaacucauaaaagcucaccucagauucugugguuguucuugguaacuuaaugugaguggcuuugaucccaaucugcaaaacagacauuaaaagcagguaaauggcaagacaacuugagauauugaaccauuucuuuuacagacaugacuaacaagcaaggagguguuggucaucauuucacccuuauauguucugaagaaugagucccucacuucaacccauucaucauucacuuguuaauugccaccacugcacuucagcaaugucaugcuugcuauuucuugagaaaggaaauuaaaucuugggaccccaaauucauuaagucaaagggaaaagccaagcugggaacugggucaugcaaaucugccucccccuuuuugguuccuaaauaagauguuacaagaugaaaagcuacaugccucccccauauuuugcccacaaagaaauucguagugagcugcaacaucuuuaugauguuucuguuaaaauuucaccauggcaauguaaauccccccagcccaccagacacaaauguauaucugauuuuuccccugcccaauucugucuauguuaucuuauguaaaaugcagauugccugcauuuuuccucugccccacuugucuauaucgucuuuuuuuuuucugguuggagcuucacucuuauugcccaggcuggagugcaauggcacuaucuuggcucaccacaaccuccgccucccagguucaagcgauucuccugccucagccucccgaguagcugggauuacaggcaugcgccaccacacccagcuaauuuuuuguauuuuuaguagagaugggguuucuccauguuucuuaggcuggucuaaaacucccgaccucaggugauccgcccgccucggccucccaaagugcugggauuacuggcgugagccaccgcguccggccaucugucaucuuauguaaaaaaugcagauucacugagccagagaaggucaugaaugacuauuuuucccuacccaccucuuacaugaaaacguguacuuuucaauaacccacccuuuccucuuuaaauuuggagaacucgaaaucaucuucggagaaagguauagaccugucucccagguguguccuuaauuuuggcaaauaaaucuccuaaaaugaucgagacuugucacuuuccucaauugacauccugcucuuugggaagaaaaucauuaaugagaaaacaaaaacucacgggcaaaccagaggccacagaucuaacccacccauuucugacuuacaaaauagauaaacuaaugucuccugugggugauaaaaguuuucacagggaggaccaaaaagggcaagggguaaucgauaggacccagguggagguuggggagggugauggcacagcucuucuggcguuaccucuucagcagccuucagcuucacauuuauauaaagauuggaaucaucucuguugccaaccuagaauaauaaaugcaugcaaaucagaugauuagggaaaggcaaagugcacagaaaagcuucuacaauuuuaguuuuaauaaaagaaauguuuaaucaugcgacucuuguugcagagaacuuuuacaggaguauagggaggcugugggggcaggagggauuaugugaacacagaugguguuacagccccuccccuaaacaaggcccaccugguucccacugccaaaccccaaacagaaaguagaggauaucugcaucugcacuggaaacuaagcaaggaugcugcaggccuacuagaaacaugugggauuucugcugccauaccagaaaaacagaguauggagggcugagaaacugucaucaggcaagaaaaaugccugagaggcaggagcacccagagggcacauuccacacccucucccccacccgcaggggcaauggaaagcucccuggccccgccacacagacaauagaaaggaggguggaaggaccucccucuaguuuacacagaauaaacagccaggcaagacaaagggcaaucugcuggccccaacacagagaggaggccgggugcagcaacucaggucuauaaucccugcacuuugggaggccaagggaggaggaucguuugagcccaggaguucgagaccagccugggcaacauagugagacccccccccccaucuuuacaaaaaauuagccaggcauaguggugccugccuguagucccagcacucaggaggccaaggugggaggauuacuugaggucaagaguuuuuccaugauugcaccagugcacagugagucaugguacuaugccugggcagccugggcaacagagagagaccuugucucuuaaaaaaaaaagagagagacagggagaaacuuguagugcagaggcuaaauccuuugaaccaccaugcagugucucacuauguucccucuguuucuuugaccaugaacauauuuauaguuuaucauuauaaccauuuauuuguaaaauuuuauuguacuaauauuguuucaugcuccagugguugguauuucuccuucucaagguugauacaugcuaccauaaguuguguuucucccagaauugcagaggguaucacagagggaaaggugguggucccuucauaucaaagacaacugaagcacagcuccuuuuaacaggaccauggcagagaaagaagccggcuuuuguaacacaggauuuucugagcuugucauauuggugcuauuacuggacgcucuccucagaucucaggacauggccugaaucuuagcuucaguugucccuuauacagacaguucucaguuuuguggugcuaauuugaauugcaagagccagaagaguccuuugaggggaauucuaccuuuuuuuuuaauggguuauuuguaucuaaguacauuagaugcuucucguaggggcuucccuagacuuuucgugccucucauguuuccucuuuggucacuuucuauguauguucuuugccccaccacccaacccucacugguucaguuaccagauuugauacauuccggaauuuuuagaucaaaguaggaaaggaggugguucuaaauacaaaaguauuauuuuuuuacaauuucauucauauuuauaccuaccacuaguuauuuagucuuaacucugagauuaaauuguuuuaucacuugcugccaguaaggaagccacaacuucucuguucuagaauuuaucuucauucauguuucaaguaagugaaauguaacuuauaagucaguuuuccaggaaagguagguggacauguuucuaagucuguauaacugaaaauauuuuucugcugucccuugcacuugacuggccuugccugauuuggagugacagcauuuuccuucggagauguugucuuuggcaucuaaugucacacaggagaagucugaagucucucgcuguuguuguuccuuuacauguaacuauuuucggccugaauauuucugaaggaguuugucuaaaacacuaaaacuacaaccaguuccagaaagaaaacuuaauaguuauaguuaugagcguaugucaaaguuuuauuggaaaagacaucuaaaagccaauucaaagagucacucuuaguauagguuuuauuuauuuauuuauuauuuuugagacagggucuuacucugccacccagccuagaguacaguagcaugaucauggcucacugcagccugcaacuccuaggcucaagcaauccucccaccucagcuucccaagaagcuaggacuaccaguacacgcugccacaaacagccaauuuuuguauuuuuuguagaaauggaguuucucuauugcccaggcuggucucaaacaccugggcuuaagcaauccuccugccucagccugccaaagugcuagguaggugugagccaccacacuuggccaguauaggcauuuuauaggggaaagugguuauagaaccauugauagacuagaugcaaaaagaauguuuaaagaacguguauucuggccgggcaugguggcucacgccuguaaucccagcacuuugggaggcuaaggcgggcagaucaccuaaggucaggaguucgagacuagccuggccaagauggugaaaccccaucuauacuaaaaauacaaauauuagccagucaugauggugugcaccuguaaucccagcuacuugggaagcugaggcaggagaaucccuugaaccccgggggcagaaguugcagugagccaagaucgugccauugcacuccagccugggcgacaagagugaaacuccaucucaaaaaaaaaaaaaaaaaaaagaaugcugauuucuccuugaagguggcugaguacuacaucauccaaaaaagauccuauuccagaacagguuagggacacuuuuuuuuuauaccaggagucugcaaacuuucuguagaggggcagacgguguauauuuuaggcuuugugggacacauaccgugucacagcagcugcugcuauugcuuuuuuaacucuuuauaaacugggcagcauuuggauacgggccacaguuuacuaaucuguguucuacaccguaagauaucuuggguauuggucuacugguucauuuuucuuucuguuucagaaaaccuuaugaagauacaggcuaguugaguuuauuaacuguauucuguccauguauuuugugaggacugaaugaguuacuauacauaaagcacucugaauaguucccgaauacuguuaaaaaucaguuuuuuggccaggugcaguggcucaugccuauacucccagcacuuugggaggucaagguguguggauugcuugagcccaggaguuaaagaccagccugggcaacauaucgaaaccccaucucuacaaaaaauacaaaaauuaucugggcaugguggugugccuguagucccagcucauuugggaggcuaaggugggaggauccccugggggacaggggagggcagagguuucagugagcagagaucacaucacugcacuccagccugcaugacagaacaagauucugacucaaaaaaaaaaaaaaaagagagagagugagagauacuaaugaggcuauggggcugaggcuguauuucuaucaccuuaccagaaacuuuuuuuuuuuuuugagacaaagucuugcucugucacccaggcuggagugcaaugacacgauuacagcucacugcagccucaaccucccaggcgugagcaauccucccagcucagccuccucaguaguggggacuacaggcaagcaccaccacaaccagcuaauuuuuguauuuuuuuggagacaaagucucucuauauuucccaggcuggucuugaacuccugggcucaagcaauccacucgccuuggccuccuaaaguggugggauuacaggcgugagccaccaugccuagcccauuaguaucucuuauaaugaaaagucaagucuuaauuuccuauaaauauucaguuauuugggaaguuacucauccacuuuauuaaaaaaaaaugaaaacucaacuuuuaaauauauacuugggccagaucaugaauguucuugaaugcauugcuaaggaauuaggaaaacaaaggggaagaacaaauggguuuuagagacagaucuggguucauuucccagacucagucccuuccugacuggcuuugggcaagcuacccaagaucuuugagcaugaguuacuauggcuauaaggggacaucuccuacaucguaggguaguauaaaacauagaacgauuagaaauauaaacaaacaauuugaauuauuguagacacucuauauaaguaguacagguugaagaucccuaacucaaaaauccaaaaucagucaggugcggugacucggcacuuugggaggccaaggcagguggaucacuugagcucagucugagacuagccugggcaauauggagaaauucugucucaaauacuaaaauuagcuggaugccuguagucccagcuacucaggaggcugagaugggaggauagcuugagccugggagauccaggcugcaaugaacugugaucacaccccugcacuccagccuggacaacagagugagacccugucucaaaaaaaaaaaaaaaaaaaaccacaaauaaaaaaugcuccaaaaucagaaacuuugagcacugacaacgccaaaaguagaaaauuccacaccuggccucaugugauggcuuacagucaaaacacaguuaaaagugcauuucaugcaaaauauuauuaaaaauauauaaaauuggccgggagcaguggcucauguccguaauccuagcacuuugagaggccgaggcaggcggaucaccugaggucaggaguucaagaccagccugaccaacauggugaaaucucaucucaacuaaaaauacaaaaauuagccaggcgugguggaacacaccuguaaucccagcuacucaggaggcugaggcaggagaaucacuugaacccaggagguggagguugcagugcgccgagaucgugccauugcacuccagccugggugacaagagcaaaacucagucucaaaaaaaauaauaauaauaauaauuauuauuauauauauauauacacacacacacauauauauaaaauuaccuucagucuacaaguauaagguauauaaugaaacacaaauaaauuuugcuuuagaauuggaucucaucccuauguauauacagauuccaacaucuaaaacacucuugucccaagcauuucggauaagggauacucaacuuguacuaucauucugguaaaggauggagagugaguguggcuggauagauugugaucagacuugcauuuuaacaaggauugcaauugcagucaggaggacagacaggagguauauagauagaaccccaaaucauuaagcagguaacuauaguggccccaggguugggagaaauaggaaucaaggggaggcaacagauuccaagaguugaugagaggcacaaucaauaggacaauagccccuaacuggaugcagggagugaggaagagagcuccuaaggagacggccucaggcuucuagcucagggaaugugggaagaugguggugccagcaccacagcgaaaaagacuagaggucugaggcagggagaugugauuacaacauauuauauaaaccuuguaucacagaaagcuguugacucuggugcuaaaguacaaaauuaaaagauucuaccacuguuuuaucagcaaggacguaggagacgagcuguagaacaguguuuauguaauaaaaacauuuguaaucaauaaauuuaaaaaacaagguuggaagucaguuuuuaaaauggaggaaaaaaaacacccccaauguugcuuuaaaaaggguauacuucuugccuaugacauuuacucuuucuacaacaaacaauuugcaaaaauaagccaagaaauaaccagccaccaaauguaccaguauacacccacaauauauacuuuugauucuuaguaauuugcaaaaaagggaaaauccaccacagcagagaacaugccaggcagagagugacaggccuucugugcuuuucuucucagcuaagcccucuuagacaaacagcagaggaggagaggggaauauuuaaguacuauucacuuugacuuuuuuuuuuuuaaauugagacggagucuuaggcuggagugcaguggcacaaucucagcucacugcaaccucugucccccagguucaagcgauucuccugccucagccuccugaguagcugugaucacaggugugcaccaccacaccuggcuaauuuuuguauuuugaguagagaugaguucucaccauguuggccaggcuagucucaaacuccugaccuuaagugaucuacccgccuuagccucccaaagugcugggauuauaggcaugagccaccgcaccaugcccaccuugacauucuugaugaacaagggauagaaauuuagcaagggauuaaaugaucuauuggagacauacaaauaaagagauugagaaggagacuauguccaacuugggugaaacucugaugggaguuucaaaugaaagccgugaguuuccugucauccaaaucaagauugcaaacauuccuucauacauuuguccguaaaaauauguauugaauaucucccuacugggugaaucuggagcucagggaagaaauacuggauagagaccuaaauuuggaagcauucccucaugaagcuaugggacugggugagguuacuuagggaaagaauaagauggggaagagaucucaagggugagcccaaggcauucaaaugguuuagguauuagggugaugagcaacaacaagcaaaggagacuugaaggugggaaggaaaccaguggugucccagaccaagagccuggagcucagaagaaaucuagauuuagaagucacuggccugauagaugaaacugccuaaaauaaugguucugauaauguggcccacacacucuugagggaccccaagaccuuuucaaagauuuaugagggccagacuagcuucauaauaauaccacuacaauguuguuugccuuuuucauuguguuaacgucuguaccgauggugcaaaagcaaugguguguaagacuacuagugaaccagcacaaaucaagacaauggcuuuggacuaguagucaagguauccuucacuaccacacacucccaguaaaacuaaaugccaguuucacuaggaccacccuugaugaagaaauauacauuauuaauuuucuuaaacuucaacuuggccgagcacaguggcucaugccuguaaucucaggacuuugggaggccaaggcgggaggaucacuuugagcccaggaguuggagacuagccugggcaacaaggcaaaaaaccgucucuacaaaaaaauacaaaaaauuaaggccaagcgcaguagcucaugccuguaaucccagcacuuugggaggcuaaaaugggaggaucacuuugggucccagaguucaagaccagcuagggcaacaaggcaaaaaaaaacucuacaaaaaaauacaaaaaauuaaggcugggcgcaguggcuuacaccuguaaucucagcacuuugggaagcugaggcagguggaucaccugaggucaagaguucgagaccagccuggccaaaauggugaaacccuaucucuacuaaaauuacaaaaauuagcugggcguggcaccuguaaucccagcuacuccagaggcugaggcaugagaaucacuugaacccaggaggcaaagguugcagugagcugagauuaugucauuacauuccagccugggggauagagcgagauucuguuucaaaaaaaaaaaauuagcagggugcaauggcaggugccuguaaucccagcuacucaggaggccaaggcaggagaauugcaugaaucugggagcggaggcugcaguaagccaagauugcaccacugcacuccagccugggcgacagagcaagacuccgucucaaaaaaaaaaauuaggcaugguggcgcaugccuguaaucccagcuacucuggaggcugagugggaggaucacuugagccugggagaugaagguugcagugaaccaagauugugccacugcacugaguaacaguaaaacucugucccaaaaaaguaaaaaauauauauauauaaauaaaccucaacucuugagugcauguguuuuuaauagucuauguaaggaauugggaagcacucauaaugcacuucugcuauauacagaaguacagugguugugguuguuacuaaagcauuagugcuuuuuuauuuuuauuuuuauuuuuuuuugagacaggaucucacugucaccuaagcuggaguacaguggcaugaacacaacucccugcagccucgacuuccugggcucaagugaucuccugucucccucucauguaguugggaccacaccucuauacgaccacuccuggcucauuuuuuaauuuuuuuguggagaugggaucucacuuuguuguccaggcugcacuugugcuuuuuugccuuguuagcugaaacagaugcauuuuuauaugaaacaccuacuugaaauaacaacugacaagcaaugauuauucaggcuugaguauuugacaaauauuuucucaaaaaugaauaaagugaaacugguauuucaagggaaacaauuaauuguauuuguugccaaugauaaaaugugaguuuuugggugaaaauuaaaauuuuuuauccaccccugugagcuugacagcuucucaauacuugaaaacuucucugaugagcuuguuggugauguuaaugauuccaauucuuucauauugcauaaugaaauguuaacauuuggaagaucugcauaauuccgggaacuauuauuuuccaaaugaggaacaaaggauguuacaaaaccaugcaugggguaaauauucauuccaaauguaacauuuugauguaacaaagugugcaagucugagaagauguaacaaaguaucaaaguucacugauagaguuucagauucuacauugcaacuaaucuuuuaaaauuuacuuacugaguccugguacaacaucaaagaaaaauacccacaauuaccuggaaggacuguuaaaaaaauucuucccuuuuauagcuacacaucuguaugaagccaaauuuucuccauauauuucaaucaaaccagcacacagcaaaagacugaaugcagaggcagauaggacuccagcucucuucuacuaagccauacaggaaagaggugugcacaaauauaaaauaaugccccucuuuucacuaaauuuucuuuuuaaaaaaguuuuuguuccauaaaauguuauuuauguuaacauauaauaaaugagcucacuauuggcauuuuuaaaugaauaaacauuuuuaaaacuuccuaauuucucuuuuuuuuuuuuuugagacggaaucucucugucgcccaggcuggagugcaguggcacaaucuuggcucacugcaaccuccaccucccggguucaagugauucuccugccucagccuccagaguagcugggauuacaggcgcccaccaccacgcccagcuaauuuuuguguuuuuaauaaagaugggguuucaccauguuggccaggcuggucucaaacuccugaccucaggugaucugcccaccucggccucccaaagugcuggauuacaggcaggagccaccguguccggccaaaacuuccuaauuucuaauauaguaaacauuaauggauaaaucuguauaaacaauagcuucuugaggucuuacaucuuuaagaguguaaacggggccagguacaguggcucacgccuguaauacccaugcuuuggcaggcagaggcaggaggacugcuugaagccaggaguucaacgcuacagugagcuaugauugcacuacuacauuccagccuggcaacagaguaagaccuugucucucaaaaguaaauaaauaaauaaauacauuaaauuaaagaaaaaaaagauuguaaaggggcccuacuaagaccaaagguuaagagacacuggccuagagaaaggguauccacagagaagagcagagggccaggauaugccaacauuuagaagcugagccaaaggggggagccugccaagagagacugaaaaggcaugagauuacacaacagccaaaaaaaaaggaggaaaguagagggagaggucugaaaugauacugagaaaucaagcaaagacaacauuaaugaaaauacacuaucauaauaccuguaauauugccaggcguggugugaaaccagguacuugcuccuucaacugagugacuugauuuuucagucucgcccuuauuugccuagagaaaaaggaaagggugggguuaacacugaauguuucaagcacaaauaagugaugcagauuauuagauguauuucucuuuuauuuguuuguuuguuuauuaacacagggucucgcucugucacccaggcugggaguacaguggcacaaucaaagcucacugcagccucgaccuccugggcucaagcgauccuuucgccccagccuccugaguagcugggacuuuacaggucugugccaccacaccuggcuaauuuuuguacuuuugguagagauggguuucaccauugcccaagcuggucuugaauuccugggcucaagcgaucuaggaccucggccucccaaagugcugggauuacaggcgugagccacugcacccggccuguauuucucuuuuuuuuugagaccaaguuuugcucucauugcccaggcuggagugcaauggugcgaucucagcuuaccacaaccuccaccucccagguucaaucgauucuccugccucagccucccgaguagcuaggauuacaggcaugcgccaccaagccuggcuaauuuuguauuucuaguaaacguggagauucucuauguuggucaggcuggucucgaacucccgaccucaggugauccccccaccucagcuucccaaagugcugggauuacaggcgugagccacugcacccggccuguauuucucuuuuaaaucaaaaacacuggccaggagcaggcaaugguucaugccuguaaucucaguacuuugggaaccuaaggcaagaggauugcuuuagaacaggaguuuaagacuauccugggcaacauagugagaccccaucucuacaaagaauaaaaaauuaguugggagugguggcaggccccuguagucccagcuacucaggaggcugcggcaggaggauggcuggagcccaggagguugaggcugcagugagcuaugauggugccauugcacuccagccuggacgauagagcaagacugucuccaaaauaaaauaaaauaaaauaaaaacaccacugaauggacauuaucugguuuaauauguacaggaacuucccaacaauuuuccaggccucaaguagaugugaaucuuuuucuuuuuucuuuuuuuuuuuuuuuuuuuugagauggggacucgcuuuugcccaggcuggagugcaauggugcgauaucugcucacugcaaccuccaccuccuggguucaagcgauucugcugccucagucuccugaguagcugagauuacaggcacgugccaccacgcccggcuaauuuuuguauuuuuaguagagaugggguuucaccauguuggucaggcuggucucgaacuccugacuucgugauccacccaucucaaccucccaaagugcugggauuacaggcgugagccacuguucccggacacguggaucuuuucuuacucccacugacacuaacugagccacaggguucagggauaauugaaaauguauuaguugauggcauucaaaaucauauaguaaauaaaugaaaacuuagaccaacacuucuagaaagugcugaugcucaucuuuuuucacauuuccacucuccaggugcugucaugaaaaauuuuacaggaacaaacucaagcacacaccuuuugcucaaccugcacuaguaagaugaccacagcguauccacauaagguugaaugauaaaucaaugaaucccacuccaaauucaguauaaacuuacaaauuauauucuaauucacaaaagaauuuucuuuacaaagaauuuaacacaaggcuaaaaguauaaccuccugcagucuccuuauuagagugaaagaaaguauaaccucuugcaaaacuaagaugaucaauuuaccaacauacaacuucucaacaauacacuaggaugucaaguaaaugaaauuacauccauaaauacauaucugaauagcucaaccuugcccaguuaugauauaugauacaauguucaacuugaacaugcucugucccucuuggaaaaccaguuuugucauuugucauauggacauucacaaacagcucuuccuucauucugauuugguuacucccaguuccacuucuccacacgucacaaaaaacugacauaaacaggcacacaagaaauagauuauuuggacuggccuaguaaacaucaagaauguugaaugguacaagaaagaagucauacccaagauuuucaaauuuuauuuauuuugauuuuuauuuauuuauuuuauuuuuugagacagggucuggcucuaucacccaggcuggagugcagugaugcaaucacagcucacugcaaccuccaccuccugggcucaagccauccucccacuucagccucccaaguagcuggaacuacaggugcacaccaccacacuucagcuaauuuuuguauuuuuuguagagaugggauuuugccauguugcccaggcugaucuugaacuccugagcucaagugauccucccaccuuggccucccaaaagugcugggauuacaguuauaagccacugcacccaguucaaauuuuauuucuaguuagugacuuuguuuuuucaagucaguauucucuacaauaauauagcucaaaagaagaauagaccauuggaauuuuuuuuuuuaacugggauuggaccuggauagaggccacaauucugcucugagacaagggaacagggaauacugcaguuugcacuccccagcaguuccagcccuagcugcuccccugaaugacaaccagauguggugcugggcauagccuaauaccccuacacagucacccaggcucucuuuggcccuaagucuuauauaaucauuccugccgaaauccguuagaaauuccaauucacucuguuuaacaucauggcugaauuuaaaauauuuaacauguuaugacagagaaaaaaacacauugcuaaaauauaaccuuuaacucuuauuauggauauagaaaaaugaguaaauaaaauaaaauauaacauggacauuucaacagaagcuauaugguaggcaaaggaggcagcaugaaauuuacaugauuaaaauacagcugccuuuagacaacaaaaaugcugaaaugugccauaagcuuagaguaguucucaaauaauucucaaauggcacagggaaaacacuuuuaguaacugaucagagaagaagcaaaaacauucaccuucaaaauacagggcuucgggccgggcaugauggcucacgccugcaaucccagcacuuugggaggccaaggcaggcagaucacgaggucaggaguucgagaccagccuggccaauauggugaaaccccgucuccacuaaaaaauacgaaaaaucagccaggcgugguggcacgcgccuguagucucagcuacucaggaggcugaggcaggagaaucgcuugaacccgggaggcagagguugcagugagcagagaucgcgccacugcacuccagccugggcgacccacugagacuccgucucaaaacaaacaaacaaacaaauaacaacaacaaaaacaacagggcuucuucuaaaaaaaaaaaagucuucuucuaaacaaggacacaauuuauccccugccccaauagauuacuguuuuuuauauauauauauauauauauauauauauauauauauauauauauauauauauuuuuuuuuuuuuuuuuuuuuuuuuuuuuuuuuuugagacgcagucucccuccgucucccaggcuggagugcaguggcgcgaucucggcucacugcaagcuccgccucccggguucaagccauucuccugccucagccucccaaguagcugggacuacaggcgcccgccaccacgcccagcuaauuuuuuguauuuuuuaguagagacgggguuucaccguguuagccaagauggucucgaucuccugaccucgugaucugcccuccucggccucccaaagugcugggauuacaggagugagccacggcgcccagcuauuauaagauuuuuaaaaugcagaacacaaauguuuuauuuaauauguuuuauucccauuuuguucauuuguugauuuauuucauuuguucauuaacaauuuuuauacuacuaaaaaauacuucggcugggcacgguggcucacgccuauaaucccagcacuuugggaggcugagguggguggaucaccugagcugggggguuugacacagccugagcggugaaaccccgucucuacuaaaaauacaaaaaaaaaaaaaaaaaauuaacugggagcgguggcgcaugccuguaaucccagcuacucgggaggcugaggcacgggaaucgcuugaacccgggaggcagagguugcggugagccgagaucgcgccauugcacuccagccuaggcaacaagagugaaacuccaucucaaaaaaaaaaaaaaaaaaaccuucaaaaaauuuuuaaaaacuuaauauguaguuccuuguaaaaauaauugugauuguaaggccaccuaguguuccaagaaauacauauauuucaaauugcuagucauuuaagucaaauuaaaacacuaaauuaccuucuuguugaaagaaaacugauuuucaccuaucacuaauauagcaaaagcuauaucaguauacaagacagucaacugacaauaguacuauuauuacauaagaauauuuacuaaaaaaauuauuauaauuuaacccagacauuuaccaaauuugacaguuaccucaaauacguauuugaaagcuuaaugugaggaagcuauuuuaugcuucauugaaaguuuauaauguaaaguucuuccauccaauugucucuaacucaaagcccuaagaaagcaaagguaaacugcuugauauuuaugacaugaaaauaagucagaauaguguaaaauuuuaaugaauccuauaauucuuagugaggguaaaguccaucauuaauccacacacacaaugacacaauaacucacauuaagcuucuugaucaggguuuuucgaucucagcaccacugacauuuggaccagaucauccuuuguuauggggacuauccugugcacugcaggaugcucggcaccaguccuggccucuacugcuagaugccaauagcauaccccuuccccauaugacaacccaaaagacuccaggcaugcccaaugcccugagguagagggaggaaaaaacugccccauuugacaaccucugaucuaaugcaauaaacggacuagguuggacugguuaaggcuuuauaaaauuuaggauuuuaaaaguggaccauaaguucauucagaaaaaggucucaaagaggaaagaaccuucggaguccugguacaggcaaccaagugugguaggauuccugaacaaugaggucccaccucccccacccccacccacucaaggaugaggggguaggcagcaucuacucagauccaacaaauugauggcaugaagauagacaguacaguauugcuaaacuguucacaucuuucaaaaagucaagcauccagauuuuuauguguaacuacaggcauaaguguguuaagaaguaaucuaauguuguaaaguaauaaauguguugagaaguaaucuaauucuguaagccaaacaaaaaacauuuggccucuaggccacaauuuuaucaccuucugccaguagcaagaguuaugagacaagacaagguuggcucugaguaugaggaucuguaagaagcggugcuuaacuauaugucaacaaaggagaguugaugccagugggucugcuggugagaacaggcagaccccuaauucuaacacugagaauuagucucacuauuggaggauuaccuaaccauagaucuggccgcuagagcugacuagggcuccaaugaacagcucuaggucccuugcagcccucuggaucaucagaggggaagguagaaagaauggggaagguaaggguucuccacuuggagggaagaaccugccaagagcuuguaaugagaaaagccucacaaggaccuggccuuccugcuuuucaaaaagacugaacaaaaccuuagguagaaaagguuaggucuaaaaggcugcuuacuaaggagggacugguauuugggcaccuaaacccaaagaucacuuauaauguuaagucauucauugcagucaagauuaaguuccugacaggcucuggcaaaaccuuucacagaaaugcucccuuaucuccugggaccucucaagcaccagauaccaagcaguacgucucccguccaggcuuguggugaggggcaaagaaaaaaaaaaagcuuagccagcaaaguaaguaggucugaccugucucuaaccagucaaaauuggacuauaacuucaaaaaugacuuuuugaagagaaucuguuugggugcuucccaaccagacugauggguggaaugauuuccucacaauggaaaggccucagggagaaccaaacccagggugucuccugcuggaggguagaaguuugcaauuccuucuagcaagccaaugacaagcccaugguagggaaagaaaugcaccaucgagccucugccaccuaccuuggaacaccugggcaagucacuuagcuucuggcuaaagugucauaaacugcaaaauugaggguaaggguaguagccgaguggcugaggaaucuugacuguggcaccuuuagccacccacuucuucaaggucaaggauuuacagggugacagaagcugcuuuuuggucaauuaaggggugcaaaggagagccaaccgcacagugcagggguaaugggggccuucugcacuguggaugggacgucaaagaagcuuguuuugagagucuuacauucuuuuaauccuuggggcaacgucaggaaguagacaguucucaucaucccuacugcacagaaaggaaagugaagcuaacuuuuccaaggccacacaagcaucccugccccuuaaccucuauucuaccaaccucuacugagucaauuagaggagaagggagccauuugcuuccacuccaaggacccuccucuguacuaggccagcuuuccuucuagaagauucuucaugcaaauaggggauguaacagggaaccacagaccucugcucaaaaccccacuacccaaaucccaaacugccugaucccaacuccccugauggacaaggacagacacuuauuugcaaaccacauccccaaucaggugccaugaccauaguaguuggcugccagcucugggcucugcugcacuaucgcugcaaccugcccaacagccuggcugggguccuagcugaaggucccagccucucuggaacuccgaccucuccugcacaggcuuccagaaucaauccagcuaugacagucaaguuuccauguaacuuuugagcaaccugcacuuuggaguucauuacaggcaaauuuuuuuuuuuuuucuuucugagaugaaguuuugcucuuguugcccaggcuggagugcaauggcgccaucuuggcucacuggcucacugcaaccuccuccucccagguucaagccauucuccugucucagccucuggaguagcugggauuacaggcaugggccaccaugcccagcuaauuuuguauuuuuaguagagaugggguuucaccauguuagucaggcuggucuccaacuccugaucucaggugauccuccugccugggccucccaaaguccuaggauuacaggcaugagccaccacgcccugcccagacaaaucuuuuuaagcacaaaagggccuacauguauuuaaucuacaggacaaaguaaaagucuuauccauguuaacuuaguaaccaagaagaccugcccuucacuaugguaagcaaauuauuuucacaaaaacaguucuucuagcccuguagcuaaauguacagccaagguuccaaacuuuuaucuuugaucacuaggauaaauucuaauuuuaagucucaagauuauaagccagcucccaaagguacagccuggauaaacacaaacaucacuuuuuuauucaaugaguacuuucuaaguaccuauuuauuaaaacuuaccauguaccaacaacuucucuaaaugcuuuauagguauuaaacucauuuaauucuaacaaccuuaugaguuaggugacauuacuaccccaauauacagaagcuaaggcacagagguaaauugcaugacccagugaugcacagaggaggcagcaccgugcuuaggcucuggagcuaccauccacagcgagcuuacaaauauacccaacuugcccugcacuuggccagcaaacacucgcagcaccuacucaaaccaucugccucuucacaaccagucucuuuagaaaggagacuuaaucaagaaaaaugccaccaauggagagagcaggcuuaauuauagcaaacuaagggaaggaaaaaccaaacaaaucauauaaauguaguaagccccccuuugaaaggcccacuuauagaacaacuaugcuuucuugccuacaaagcaaggugggucuuccaacacuaaugcacauccuucucccacuuugcauaaucuuuuaaaagacaccacccuucugcccagggcagggucagguuccucuacucaggagccuccacucggucagcuucucacagggccauugccauugaccccccaaagcaguaaguuaguaacuggugaggacaaaggucuauggcacaggcuguguuuuuggucaggagcuauuucccucacaacauuggcaggcuuaaggcuccaccuccuucaagucuuugcccguaagucacuuuuacaaagacuaugacucccauauuuaaaauugcagccaccauaccacagaaacuccugucccucuuuucugcucugguguucucuuugugcuucccaccagcucacaauguguuucaccuauuuaaaugucugucucuacccaucaguaugcaaguuucaugaggguagggauuugggcuguuuuguucacuauuagacucucagagcuuugaagauugccuggcuuaggggacacauacagcuacuuguugaguaagugaauaaauacccacaaagaacagauacuugucucuaacucucagaccuucccccgguugucaaauucaggcugcaaacuuagaauuccccgugagggagaaaaggggcuguuacuuccaaagaaagauaauuuggcaacuaaauccaucauguaaguacccaguuucccacagaguagagcagguagagaaggaaucuggaaugcugaacuuuguugauguccgagcucccaggaaggcauaaaaggagaauaauaauagaagaggacgagucagggauagcauucucagcagggugggaaacaugcuaaugagaggaagacuguaaagaaaaagcaaagcgccagcgggggcgcaguggcucacaccuguaauccuagcacuuuaggagguggagguggacagaucacuugaggucaggaguucaagaccagcuugaccaacauggcgaaaccccaucucuacuaaaaauucaaaaauuagccgggcauaguagugcaugcccguagucccagcuaccugggaggcugaggcaggagaaucguuugaacccaggaaguggagguuacagugagacaacaucgugccauugcacuccagccugagcaacagagcaagaccuugucugaaaaauaaaaagaaagaaagaaagaaaagaaaaagaaaagcuuacgaaauuccuuuuagcaaguaguaagugcugguuagaaugaaaaacaucauauacugggugaagaccuuaguuuuaguugagccauugccauucacccuuggacaaaucacaucacuuuucuggccucaaaugauuuccuaauccgcaggauggaaugugggaagugggcuggauuuuuaagaaauucuaggaccggugcaguggcucaugccuguaaucccagcacuuugggaggccgagguggguggaucacauggggucaggaguuacagaccagccugaccaacauggugaaagcccgucucuacuaaaaauacaaaaauuagccggacgggguggcacacaccuguagucucagcuacucgggaggcugaggcaggagaaucgcuugaaccugggagguggagguugcagugagccaagaucaugccauugcacuccagccugggcaacaagagugaaacucugucucaaacaaacaaacaaacuagcuggacaugguggcggacgccuguaaucccagcuacuugggaggcugaggcaggagaaucgcuugaacccaggaggcagagguugcagugagccgagaucacgccauuguacuccagucugggcgacgagugaaacuccaucucaaaaaaaaaaauuagcuaggcgugauggcgggcaccuguaaucccagguacucaggaggcugauaugagagaauugcuuguaugcaggaggcagagguugcagugagccaagauuggacacagcaagacuucaucucaaaaaaaaaaauagaucucaaggcagcagcuaccauguaaaaaaaaaaaaagauaaugaaucauucauauauacauuaacuaauuacugauuauuaauacaacauauaucgaauacuuauuaugugccaggaagaauuauaaaugaucaucuguuaggaacccauuuaauucuacuaacaucccaaugaccuagacauuacuuuuacuuaacauuugaggaaacuuuggcacagaaagguuaauuaauuugcuuaaaaccacacaaguaguaaggcaggaaacaggguuuccagguguuuaggauauagacaaaaauaagacaauacauguauuugcccuuauggaguugauaaacauauuuaauuugcucuccaauuaacgaaaguauauucagugagcaccuauucucaguacuggcccagaugcauuauuauuguacuaaauuaucugcacuauuauuaugcacuaaauuaucucuucacaaucagucuuucuaaaaggaagauuuuuauauuaaaacaaaaagccacuggaaaaggaaguaaguuugaauacaagcaaacaaaaacagaaaguaaagcagaaauacaguuuagcaagccacauguugaaaagcacuaagcaguaaguauugugauuucuuuuuuuuuuuuucuuagacggaguuucgcucuuguugcccaggcuggagugcaauggcgcaucucagcucacugcaaccucugccccccagguucaagugauucuccugccucagccucccaaguagcugggauuacagaugccugccaccacacucggcuaauuuuuuguauuuuuaguagagaugggguuucaccauuuuggauaggcuggucuugaacuccagaccucaggugauccacccaccucggccucccaaagugcugggauuacaggcaugagccacugggcccggacuuuucaccaccgaugacuuuguaauucacucaaaaaccuauuacaaaguuaggaguuacaggacaauuacaauuuaguaacugcuguggcuggcaacaguuacuuacauaacgggugaugugaaaggucccaagagcaaacucaguaaggucacacagaauauaucuuucccuccuucaucuacuagagggaauauauuuuucccucuuccuucuacucucauuuuuccucaccagucaccucccagacaaaaagcagccaguguuacuuccugggaguaaagcuggcaacgauacccacuaauuaagcauucagaugucccgcaaggguagaacaggcagaggucaaguggaaugcagaauauucucaggacucaggagccaaauuacguuucaaguaacucuaggaccagggcagagagauggcuguuagagagaagcacgagauugaagagaaaggaaaaauguauuagauuucacuuagcguaugauaagacuaugguauagugggaaaagcuaugagcuggaaggacccucugucauuaucagccuuguagucuugucaagccuugucaccucacuagucuccaucuacucaccuccaaauuaacgggaauuaaguagauuggauuucugaguucugacuaggggggcuccaggaagccgcaacuacccacucucccggcagaaagucaccagcagcugcgcguuugggagcauagucggcacaggacuuuuccccgaagcacaggagccagcggcuacagccacuaggcaguccacuugcaaacgcagguugugcccggguucucuuucuuuggcugcaggucuucagguguuaugggccuaacucuuccgcuacaagugucccucccgcaaaaaauggguccgggggaccugcacacccucagagcccucguccacagccccacacucaacaacaaugucaggugcuuacgcggagaucuccuucccguucaggauuucugcuggcgccauggccuuuauuaguccgcugcccacgauggacaccaccaauaucgagguuccacucccuccgcagccaagcaggacaacccaacccacgugcuuagggacuggccaggggaucacacuacugcgccugcgccccugcccgcuucucccccugcagacgcgguggcgcaugcgcaguucggaaggacccgagucccuuaacuaaccgagagcuaacaggucggggacugcgggacggaagagggaggggaagaugaagaaaaucggugaugaauggcuggcggaaaugauuggcggaaagaaagagccaguucacagugcgccuuuguauucggcgggaaacccggccgaagagggagcuggaaaggacuccggaauccggccguaauu

SEQ ID NO: 192364 - RNA, 52544 nt, Homo sapiens
uauuuuaaaauuuaaaauuuuauuuuuuuaccuuuuuuuuacauuuuuauuuuaaaauaaacaguguuuccaaaaaacauugacuacaagggggaaaugaggcaauaagguuggaagaagggaaggacucaagaagaaaugcugaaccugcaaacacaaugaucagggagcaugcagagaggcccuugcugugacacuguccucucacugcuacuccuaugaagcccagugacuaugcugggacacuggagcuaaagggucaaagagaagcauuucauuccuaaaaggugaugucaauuuguacuuagccccagcaaugugaaucccccucuucacaguccaauucuaagauuccauucuuaagaaauuaccaaagauagagccaaagagauauauacaagaaacuuuaucacaucaucauugauaauaaaaguaucugaaacaaccaaaauuuucaacaguguggggauggauaagguagaaccacuagaaaucuauuuucaaagauuuaaaaacauaggaaguuacucgugauaccauguuaaucagugagaggguaaaguuaggauaccaaccuguaucuauguaugaccuucaauuuuguguaaauauacaccuuauaugcacuuuuuaauacugaaaggaaauucauaaacauaucagcaaaguuuagcucuguuuuagauggagagaagauggcuaauuuuuauucuuuguuuagauucuucuguaaugagcauuguuacuuuuauaucagaaaaauagacauuugccauaaaauaagucuacccucaaaucucugauuuaagacgacaauugucagucuuaggaaaagccugcuaaaguucaaagcagacucaaagaaaaaagauucaaaucuacacagugacucucuccugaaaaggaugagaaaucuugugugacgcagucuggcuuuuuccucuacuuugcugcuggcucuauuuuacugcgccucacagaaagcuccaugggaaaacccuuucccuagcaccuuaaaugaccuuaaguguuucucaccucuuggcaugaggauuagaaggaaagaaaaugaaacagcccuacucccuuguuucaaaggaaaaauuuuucuugcaaagcuaucaaaaugacuuaaaaucagcuaugcaaaauuugaaacauaagucaugaguuacguucaguaaccaguugcuuuuuucucaagaaugaauauaaaaacaaaucuaugagugcccucuuguggcaagccugacuauuaccacaacccaaguaccagccucucccugucuauuuccacggcucuccuccacuccugggcuccgcauaacacagccaggaggcagagaccccauaauaacccacuacagugaaugcacauuccucaaaguggcugguacuauuuguuuucaaggauuucuaguuuagaucccagaaaugccugccugaagacaagugggaaugaagggucagaagagcaagaugcaggaugugcacguggguucaugggcugcuacugauggccgauggugacugugucugguauauccaugcacacauaccauggcacugccaggaggcagggaccuguaggauaaauagccccuccccuaggaaugccaguuuuauaaagucgcgaaguuuuacauuuacauccagugagccuugugcuuacaaguaguuuuauuauuaauuuuagaguaaacaucaccaacuugggcacaauuccaaaauagagcucuuguuggauucuggucauaaaauucuuuuuuaagcuuguuaagaucuuauaaaauaagaaaguuuucccaauacuuuagaaaaauuacuaaucauuaauaagucgauuuuauacucaaaguaauggccuaacauuuugaaagaugaaacaacgcuccucuuuugaacaucuaauguauuaaguaagcucagugucccaggcuucagaggagacagagaaguccucauauugcaaccugaccagaugacucugggagugaauuaaaugcuuaaaagaggucagucuugcaaauucgaugaagcacagaauacaggggaacugauacugauucugauaaaagauaacauuacucucagaaaggggugaagcuaaaaaucuugcaguucuggggcaggaggagugcaacaagcaggcaacaaacagcaugaaaggaaaagcugagugaauuucaaaguucuauugggagauggaguuugugguucuuucugccccacccaggucaaaggcucauguccagaaaaggauuucucccagugauaggguggaaguguguggcaggaaguugcuguuugguccuggaaguguaaaggaaagccuuuucaaguacgugaaguagacugaagugacccagaugggauggaucccaaccacaugaguuacgggagagcaugaagccaaagaaaugauaauuaugaaguugaauugggaaaauaaauuugacuccuuguucacuucuccagccuuuggaagaacuuuuucuccccuccuaacaggaccgauauacuggacagccccuguuagagauaaaccgaggcacuagacaaggaagaaaugcauuaaaaacauuuuuuuuaagucuugacaagucacuucugggagaauucuucauuuuuccucugcacagggacagcagaagagggagaguaaaaauaaaggcgaaggccucucuuguccacaaaaaugagaggaaaaaagacccugcccguuuaaaauccaaaaccauaaacucuccuucaaacaauaucuuugcuccagcagaagcauccugggauuagucuagguuaguauucugaguugugucacacaggcuuugacaauuaaugauguacuaaaaugggaagaggugacucuucaaccuuggcuccagcuucccacuuguccuaacugggaggaaagcagcuaucaagacagcuggaugggaagaucuuccccgaauuuccggagcagcuucugaugguugugguccacugaccacugcuggggcaggugcuugggcugcauggaguccaggaagugcugacgccagcggcucuccagcugcaugagggagcgcaggccacccuggcugugacacugcaccaccuucagcccgugaggaacauaguuuucauuggagauucugccaaaacaugaaaaacaaagugucugagggaaacaagcgcaggauggccucacagacagcuucaaaugcugcgcgccaaggguaacuggggagguugaaggacuccuaaaggguuaguuacuuugguguuuucgaaacauccucuuucuuaucucugcccuuuuuauagucugaacauacgacucgcaaucccaacagaagguauuugaggguucugagcucuacugacaggaaggccacuucauaauguucagcucccacgagaggggcacuaccauccagcugauaauggaugaagaaugcuggucuuccauuucuuccaggauuacccagugaccaguucaccccucuuuuaaguuguucauucugggacacaguauuuauaugaggcuguuaaaucggcccgcauguuacacuuuuucacaacacaauuuaauaacugaaugucaaaugcaagguagcauauuucuuuagagccuuuuuucucacaaaaagaugccaagccacaguggugagaaguguuucggucacagugaaaugcuuccaugguugcucaguugugcaaauggugccauuaaaugagaagaugaaugccucccuccuuccuaacuaagcagaguccuuaaaaaacugcuccgaugcugugugaauggugcuuucaccuccugugaauaaagaugaccuuccucaaggaagcacccugcccacacacacucuccucucccuacauccauaccccauguucaauccucccucccaagacacccgccaccccagcaguguuggcgucucuggguaucugcagacacuuuauuauuaauauuuagcucaugcgcuucccacuaacuugccugucuccaaacaacuguucuucucagucacaaguccagcauucaucuacccaauucagcaagaugaauuuguuagaaaagucuguggccgaaaggggagguuuagcugcuuuagaaaacauauuggcagcugggcgugguggcucaugccuguaaucccagcacuuugggaggccaaagcaggaggaucacuugaggucaggaguucgagaccagccugaccaacgaggugaaacccugccucuacuaaaaauacaaaaauuagccgugugugguggcacacacuuguaaucccagcuacuuacaaaacaacaucuauucuacaaccucacaaaauaguuauggggauaaaauucuauaauucuuuuaaaacccugaaagauuuuuuaaauuuaagauauaguagcaguuaaccaguaagaaaucuaaauccuacuuugucggguugucaugagaaacaauuaaggcaauuuaugugaaguuuauuagcugguuugcugcaagauauaguauaucuauaaauaacuguucaauaaauauuugcaguaucuguaauggaucaguaguaauggauaagaguaaaaaaauuuuuguuuucuaaaaaaauuaaauauuugcuuauaauuggaguuacuuuuuuauuuuucaguuaacaaaaaccagcaucacgcucaagguuuugugaacuuaucaguucccuuauuucaacuccugguccuguuggaaaaagugacaguugggaggcagaacugcgcaugguagcccagagcucuuaccaucugagccacgugcccauucauuucucauuucagaauacugcauugugucacaagaauucaacuauguacucauggagaaggagggagaaagcaaggaaggaaaaaagagaaaaguaauuuacauaguaacagcaauucugcucaacauuccauucagugagccgauacccuggagugcaggugagauaggaaccaugaauucauuagucacaguucucacagaccuguauaaagucggagacacaaaaccacacauagaauuggcccuccaucuuuguggguucugcaucuguggauucaaaccucagaucaaaaugauuuggggccaggcacagugguucaugccuguaaucccaguucuuccaaggcagguggauugcuugaggucaggaaucugagaccagccugggcagccuggugaaaccccaucucuacaaaaaauacaaagauuagcugggugugguggugcaugcuuguagucccagcuacuugggaggcugaggugagaggaucacuugagccugggagguggaaguuacagugagccaagauagugccacugcacuccagccugggugacagagccauauacuaucucaaaaaaacaaaacaaaaaaaccacaaaacuauuuggaaaaaaaaaaaaaaaaacuaucuguacuaucuguaccaaacauguacaaacuuuuuucucauuacuucauaaacaauaaaauauaaaagcuacuuacauagcauuugcauuguauuagguauuauaaguaauuuacagguuauuuaaaguauacaggaggaugugugcaggauauaugcaaauacuaugccauuguauaucaggcacuuaagcauugguggauuuuaguauccaagggagguccuggaaccaaucccccauggauacugaggggugaauguacuguaucucauggggaacuucagaacuucgaggguguuauuggacuauuauuucaucucaugugcuggcaugaggauuuacgucugcauagaauguguaagaugcagcuccaccacaacugcacucgcacgcuaaucacaaaaaugaccgaaauuaaguguaugaucuuuaaaaaggucaaagauaggcaccucacaaaagcaaguuuccuauggaaaggaacuccucaaguagauuguucuauuccacuuccaagguaucuuaaacuacuagacaccuacuaggugaagcaugaggcuaggcacugugccuaagcagccaaugcccccucccuggcaagcauucucacuaaguaaugaggguuaaugucccugguacauuccacaauuccugugcuuuguaccuggucuccaggcuggcagccucuugaagcaucuccucugugaccacgucuguguuauaaaacucucugagugcuugcagcagcuccuccuuucgcugaguaggcaggcucuccgcguugagcagggcccuggccccagaacgcaccugccggcgcucaggaucuuccagcaggcgcaagcccuccucagagccgaugggggccuggaacuccuuggccagcugcugcuucagaugguugucauaguaguuggaaauggcauggcaggaggugcagagcagcagcacaucgugggaguugugguccuucaucucgauggggaagugcuuccgguacucauguggaaucacguucuuccuggaacaagcccagccggaaagcagcgcucauaaguguaugacagagcacaugggaagacagcagacaggcuacugggguucuaacuggggccuaaccaugacugagaagccuugggcaccaccgcccaacacagaucacagaaaggcaguaucaccuauuccacucucagcccaucugugucuuagcuuccucucuccugcaaguaaguacagaccaccugcugugggcuucaguggugggccagcauagugacagguuaauaacaaccucugagaaggcugugcucccagaagggaaagucucagagaacugaaaagauacucuaauggccuuugacaacuggaaaacaacucucucaagaaggccuaggaaccugaaaaagccaauuuccuucaucugaggaauaccuuaaucuauuucccugguucaccagguucaucauuauuuucuaaggagaacuaagcucucaggaaaaacucuuggcagcaaugacuuugucucacuuugcaggggagaaaggaggaaagugagugacuccacagaagccagggagaaagcccaagugucugggcacucagacguagucggcagccucacccucacagugcaggggcccugaugugaaacaguauuacaacacagagcaggcuucaggacaucuggauacuccaugaauaaaaccauggcucaaaaagcuggucagccagucaagagaggaugagagggacacagcuucugaaggaacuggucuucagucuuucaugagcaaaagggaaccacuguccccaugacagaccauuacugaguaugguguugcacuccagaaacugagaaacggcucaggagggguaagggccacuauagcaagggcggcagaauaccaaagcucuuggggaagcuggauacuaggaacaagccucucagccaaaguggacagacucagccacagcccccaaaggcucugcauauggcuacaaaagcaauuuccaucugccacagacaaccaggguggcccaaugcugcacucaccgaauguaggagucucucuugccacacacuacacacagguucucuuuaaccaucaaguaauagucuccaggagauucgggccuuccugcagguucaaaccguagcuucaccacaaagggcucuucacucaccagcucuuaagagaagagacaucaguguuugacugcucccccugcccccaccaccacacccaagaagcagcacuaccuucacuguucucugcuauggccuggcagagaacaugauuucuggguugugccuacccagucccaugcaucucacggucucucugccuucuucuaucccucccucuuccuuaucucacuccccacuccugccagcauccaaugcaccuaauuagagauaaacaaggacagcugaaucucauaccaccaaugccuuuguccagguaccacugagcuuuucuucuaucacaagugcagaggggcuguccaucaggagcauggagaaagcaguuaucauaaagaggugauuuucugcagggaaaggaaagagaaaucucaaaccggaagcuaacugugggucaaaaugucuguugccuucccaugcucucuucugagugacucaaaacuauucucaacacuaaggucaaacacaccacuauggaaaaaacagagugagaaaccauguuuaauccucaccugcacugggcuaggaaacagaacuaaaaaugaaugaguuuaugccucuaguuuuuacacuuauggacuaggacauuagggagugugucaagugguuuacacacagcucugcugugaaugcaaaaaagaaccaagcaacaagaaaacugccaaaucacuggauuaaacaaaguacauuaaaaauuuuaaaguucaagccaaaguaaugagggccauguggauuuacuucuaacucacaugcaguaacacuuccuucaauuuaaucauccaauuaauuccuaaaggcacuuugcuacagggaccaaauuuaugcuccaaaguacuuauuagucaucuuccuacaauagaggaauaaguuauacaggacauuuuucauuggcuagagaguaacauuuucuuggagcuggaugucauucuaaauaaucaaauaacauaugaacaagaaaucagaugaugcauuucuccugaaaaguaugaggcacuacauguuauuuauuuuccacagcuagccugaaacaaggaaggaaugauaauuauauccccauuuacaguuggagaaguuaaggccuaaggucacaucagggucaaugacagaacuaagcuaagcuuuccucauuuccaccccaacugucaauaaauaaaaagguaaaauaagggaaaaggagaaaaauacacaaauaaagcaaaggagagaccaaaugucucugauggaaagaaaaagcaagauuaaccccgggagagcugcugcuccccuacuacaagccuucuccccagaccccagggaagcaucaaacccuuugcuaaggcugggccacugacucuuuacuagacagggagugauucaguuaccuggcagaauagcccacccccagaggcuuucuuuuauguuuucuggggucucucccuuggugguugccuggcaccaucccauccaucuuagacuucuuauuucuuggcuucugcugagauucuguugcuuccccauuaaccucuucucccaaucugcucauuccuuugcuucgaaaugggaugucgaccacacccuggcauuuuuccaagacuuuucuccagcuacuguggucaucguuuuuuucuccaggugaauuccuagagaaaggguauccaagaagaugaagaaagagagccacugaaaucugggcaucccuggcagcauaaauuaccugaagagaaaagucagagaucaguggaaucuggaaggcaaaccagagagaaaaacuucaaagucaaucacaaagaaauagauaacucuuaggauccuaauucaaaauguacgacaaccugggcaccauacacuuccuuaaaacuucuuauuauaaaaauuuucaaacuacacaaaaguaaauugaauaguaugauuaacucucauguucccuauguuuuuaacuaaaauagcuaaaauaaugacuuacucuaaaugcuggaaaauccucaccuauauaaaucagugaaguuucuaucuacuaccaaauugcuggacagauuucucucaaguuugggggaaggguaguuaacaaaggccugauaacuaguacaugaaauucacuuuggaggcagucauccucuggaauggcugaaaucaugauucauuaagaggccugugugacugucaaucagaaaugaacugccauaucuauuaauaugauauugaaaacaaaaaaaacaaauagguuucaaacaugggccucaaaucaaagucacagggcccauuccuggaauuuacuuauuuaauagugguaagucauucuccuaagcaacuggugauaggcaagcuggucauaaagaaaaguacugugggccagguaugguggcucacaccuguaaucccagcacuuuaggaggccaaggcgaacagaucaccugaggucaggaguucgaaaccagccuggccaacauggugaaacccugucucuacuaaaaauacaaaaauuagcuggguguggugguggacgccuguaaucccagcuacucaggaggccuaaggcaggagaaucgcuugaacccaggagacgaagauugcagugagcugagaccgugccacugcacuccagccuaggagacagaacaggacucuaucucaaaaaaaaaaaaaaaaaaaguagcguggucaaaacuaaaauucggcugggugugguggcucacgcuuguaaucccaacacuuugggaggcugaggcggguagaucacuugaggucaggaauuugagaccagcgcagccaacauggggaaaccccaucucuacuaaaaauaaaaaaaaucagcugggcgcgguggcacgcgccuguaaucccaucuacucggaaggcugaggcaggagaaucgcuugaaccuggggcuugaacccaggaggcagaaguugcagugagcugagaucgcaccacugcacuccagccugagcgacagagugggacuccaucucaaaauaaauaaauaaauuaauuaaauuaaauuuaaaaaaaaaacuaaaauuuuaaaaaaacuaaaauuaauagcuuuucccaacaaaaaguguaaggacuuuaaaauucuauuauuucaccuuuaauaaccaagccagugaauaauucuauuaguaaggaucauuuauacuuuuagaguaaaacaaguuuggauaaaauuuuccaccuagauccaacaaucuacauaucuauuagcagacuguuucccacagaagaaugugugcuugaaugagaagacuuuagaguucccucuaacacauuauuuucuaaugauaaagaaacaaaugguacuaggaugacuggagguccacaugcaaaagagugaauguggaccccuaccucacaagacacacaaaaauuaacucaaaauggaucacagacuuaaaugcaagagcuaaaacuauaugacuuuuagaagaaaauauaggagccaaucaucaugaccuugggugaggcaaugauuucuugacuaugacaccaaaagcauaagcaauuaaaggaagagauuuuuaaaaagaaacugauaacuggagcucaucaaaauuaaaaacuauugugcuucaaacaaccaaugguagaaaauacuuuauagaucaucuaucugaaaaggaucuagaguauacaaagaauuccuaaaacucaaaaauaaaauaacaaaugacccaauuaaaacaugggcaaaggauauguaugaauagacauuucuccacggaagauauacaaauggccaauacccacaugaacagaugcccagcaucauuagucacaagggaaauguaaaucaaaaccacaaugaaauaccgcuucacaccuacuaggauggcucuaauggaaaagacugacaauaacaaaugucagcaaggaugcagaaccccgacacccucauacacugcuggugggaauacaaaaugguguagcuacuuuggaaaccaguuaacauuucucaaggaugaacaagugguaacugacuuggcaagcaagguugaaacuaggccuaugcaagugguauggcaaaaagccuaaguucaaaugaguuugagccacagagaccaggaaagcauaaggaauggagacaccagguaucugugaaggcaagggcggaaacagaaggauaaggugaaaucucuauagagaacacuuacacccugaucuccuccuuuacagcacagggccagacaacuaucccuccccuagcccaaaagacaguaaaaguuuaaaucauauaaugguuaaaccacagaggaucuggaccugguaauaccaggcaaaacugaagggagggacaaaaugucaccugaagaaagggggauuaagggagagauuacacauugaauguuaaaaccacuggcaccuuucccccacucagugacuggaauauaggcagugggacuuacacuucuugaauagaauacuagaagauucaucuguggagaaacuaagucaccugagagaaaagacaguuacugacuuuuuuuuuuuuuuuuuuuuuuuuuuuacugcucaugcucccuuucucaagaaacuguuaugaauguacuccaccaaggcaagaaaggaagaagacauggaauuuaaaaaacagaggaucuacuaugaaagagaaaggugaagggaauuccaggcugaugguaaaugcaaauuccaggaugagaguugggcagcaggccuagagugcacuccguccugggaggagccagaugauagagggcucuaggagagaaggcuccaagggaaaaugaaacaaguaagugaccugacgugugucugaaccagcccagaggagauccauaguucugauaaggagucugggguggaaauaauagguacauggaacacuaugcaaacaaaauacuaauuauuaauccugggaaauaaaaguaacugcaguuuacuaugugacucagcuauaaauaauauaaauacuguauauuaaccugauaaaaaugaugauuuaccuaaauugggaggauggggaagagaaguauuuguccggggacaggggagcugcaagaguacuaaaccguaucucccacaguaugaugucaaaagauaauauaaauaaauaagaaagaauaacgcaugcauguaauuuagaaguauaaugauaauuaccagaaagaaaugaaagugguugccucugaggagaagaaggaagaaggauuaggaauggggaaagguaaugcagggaacuacuuacugcuucuuaaaauaaguuauaacuccuacacacuuauaacacuauauuuuuuuuaaauuauacauuuguauucauaaaaaaaaucccuuuuucugaaaugcccaacauauaguaaaugcucaaaaaaaaucaggacucuuggccaggcucgguagcucacaccuggagguugagguggguggaucacuugaggucagaaguucgagaccagccugaccaacguggugaaaccccaucucuacugaaaaucuaaaaauauuagccaggcaugguggugcacaucuguaaucucagcuacucaggaggcugaggcaggagaauugcuugaacccaggaggcagagguugcagugagccaagaccguaccacugcacuccagcuugggcaacagagugagacuccaucucaaaaauaaaacaaaagcaggacucuuauccuuuauuuaagugauuauuguagaccaguuagcuggaguaucaccagagaaugaaucuauuuuaaggcaucuccauccaauacuuauacuauauuugagaauucgaauuuuauaaacaguuauacuucagaaacaaugacuuuccauucuucaacuacucugauaagaaguaccugguccucugugagagucucagcaucccaguugcugcaacgaaguagaagggacuugucaaggggaaaguucaaaacagucucagcgagggacuucaggcuaagcccauuacagagcaaauuguuucuaaaagaaacaaagaaaaccaugcaucaaaaacgggcaaaggacauggacaagaaaaucaaaaaagacauauaaauggccaauaaacagagauaacauacugaaucucacuagaaaucgaagaaaaugauaauuuguuaucuauuugugaaacacuuuauaaauccuuucuguaguuuaacucauuuaauacucacaccaacccugugagguggcuacauuaucaacucuacuuuacagaugaggaaacugaggaacagagaggcuuaguacugugccaaaggucauacagcuggcaaguggcagcacugagacuccuacccaugcagugugcucccgagucagcuuuuagccucuauccacacugccucuaacagcacacagugacaguggcauucuggggagcuggugccaaagaaaggagggccugaugaaggggggcuuuuacuguuauacuccauagacuuucgcagaguuuuaauuuucacagcaauaucuuaauguauuacuuuaaaaaauuauacuucacuuauaagaucuuuauauaagccaaacuaacaaacuaaaauaaaauuucauuuuauacuaaaaaauugugauaaguacagauuuuaaucaggccuucuuuuaguuuaccaaaucuccaaacuuuuagugacugugucacuucaggcagggcaagaggcuguuucaguccacguuguuauaaaugaggacccauacauaaacaugaggagguaauuacgacuccccgccccaaaaagacaagcugaaaucaaauuuccauaggaauaaaauucuaaaggaaaucucucuuccucccagauaagggcuggucuaccaucauuuuuggccuaaagcaggcucuacaaacucaaaggcuuauuaggaggagccaggguuacaaugggagugguggggacucuggcaaacugaacagagcacgcucaucuaaagggcacauaugcuacccagccaaaugcugccaucuagaacuguagacucaguguagucagauuaccuaauuucaagagaagccagaaauacagauuuuuacauuaaauauucuugauuuaaacaaaaauucccaaaaauaucauaugggaaaaaagaaaaccaaaaacccuuugcagccauaauuuagccagugggaccaccagcuuuuagccuguagcuuacagagaucccucaguaauguuugaucuaaaaaggcuaauucuagguaaccaaaguuucacagaagguggaaugucuccuuacaaauucaauaugcaucuuagaagccucuaggcuccuauacaauuucacaugucucacuauugagucccaggcaucuacaaaucuggcuaaaauauuugucccgcagcuauaggaaucccagcauucauacaaaccacaccucugccgcauggcuagguaucggagguccaggcacccccuaacaacgaggccauaauccugcagaagcuugcuggcaucuucugagcaucccacuccaacuuucaaaauggugccaucugccaaaauauccaauaacguucuugguaguguuuuuccuccacagauuagcuugggcaggcgaaccaagacacacaggccacuuggggaggccauuuguagaagugacagagggcuggcuuugccuuccaaauuuaccugcaacagaggaagacaagguugugguucacaccugagcacagcagcgagcauaacauauaacugugacaaaaaagucuaagagguacauccuuaacuucccaaagguagcaucugaccagguuuugguuugcaucuacagauaagucuacaguaacaaaugcaauggacuuugugaagcagugaccuaaacaaagguuaccgagaaccccaaacgccaaggucugaaauauaaguccauaaacagcgaccagccgacacaggggagcucugggacauacacuggcagucauauggaacaugcugguuuuaaaaggcuaaggaggcugggcacgguagcucaugccuguaaucccagcacuuugggaggccaaggcgggcggaucaccugaggucaggaguucaagacaagcuuggccaacauggugaaaccccgucucuaccaaaauuauaaaaauuagcugggcaugguggcaugugccuguaaucccagcuacaugggagccugaggcaggagaauugcuugaacccgggaggcagagguugcagugagccgagauugcgccacugcacuccagccugaacgacaagagugaaacucugucucaaaaaaaaaaaaaaaaaaaaaaaggcuaaggaaaaaaggcccaggaguagagugagaaaugauaaacauccucuuuucauuauccagccucucuaauguacacgcagguaacucuagucauuuaccuuaucaucacugacucaagauccaauuuuuaaaaagagguagaagauagaguacuguaaauaagugguaccugauaauauaauaaauccagguagcaccaagugcuuucucagcauuuucuagucacaaauggcuuucauaaaaagaaaaaaaaauguauauugagcauaaguuagggccuuuaaaucuuaaaagauacaaaaaacuuuauacaauaagugaucgagguuuaaucuuuuuucuuuuuuuuagauggagucugggucugucgcccaggcuugagugcaguggcucaaucuuggcucacugcaaccuccgccucccgaguucaagcuauucuccugccucagccucccgaguagcugggguuacaggcacgcccagcuaauuuuuguauuuuuuguagagaugaaguuucaccaugucacccuggucucgaacuccugaccucaagugauccuucugccucggccuuccagagugcugggauuacaggcaugagccacugcgccuggcugagguuuaaucuuuuuggggucauagauaaguuugaaaaaaugcugaaagcuaaggauguuauuccuagaaaaauguacauacaaaacucacauacauuuucaagggauuaaaauuucccuaaagcuauccauagaacccagauuaaacacccaauaaauucuaauccuucucacuugucaggagaggaauauaggugaaucaguuugaccaaguauggugagaucauggcaaagcuagggcuaucacacuaucaccuaaauuucccagucccuagaauaguaguucucaacugaggguaauuuuguaccccaagagacauuuggcaauaucuggaaaaauuuuugguugucacaaguggggaggaaguacauaggcaucuaguaaguaaaggccagaaggcugcuaaacauccuacaauguacaaaaaagaaucaucugcccaaaaugucaauagcggggaggcugagaaacucugcucuagggcaaugugguccucuugcuacuguacuagcugccugcugggccugcagugccacaguugcauacaaaguaauggaagagagcgugcugauuuaaggaauuuauaaucuuacaggaggaguaggagggauacacauaaacacaagcucacacacacagaaaaugacaugguaaaugccaaaggaauguuucaagcaaagugucacaauuaaucagaggagguacauugcauaauugaagugaccaaaaucacacagaggaaauagucaagaucacaaaagaacugcuguuaaaaaaaaaaaaaaaaaaacugggagggcucuggcccucaacuuuuuuuccaagucucgcucuguugccuaggcuggaguacaguagugcaaucucagcucacugcaaccucucccucccggguucaagcgauucuccugccucagccucccgaguagcugggauuauaggcgccugccaccacacccagcuaauuuuuguauuuuuaguagagacaggguuucaccauguuggccaggcuggucucaaacuccugaccucaaaugauccgcccaucucagccucccaaagugcugugauuacaggcgugagauaccaugcccggcccucuagcccucaacuucuuuucuaaggcggaguaaaaccaugaucuaacucacaaaagacuuacgcuuccuucuuaggcacugcuuuaucagugagagcuauuuucguauccucacacgaaagcaugccaguuugaucucauugucuauuucuugaggcucagccaagguuacaaagaccugugagaaacacgacuacugggguuccaguucucuaauaauucauccggaugugaccaaaucacuuuuuuaaaaauuaaugaguaguucuuucccucugugauaucagcuuucuccaagaaaaagcuauaaaucucuacuucuaauagcuaguacugcuaauuugacauaaaacucacuacaaauuccuaagguucaauauuuguaccucuuuacagucaggucucauugucuaccauacauuaauuuccuuguuaauacaguggugaguaaaaagaaaagauaaaauacauuaaauaaauaacuagauaaauagacagauagguaaauugaguugucuuuaauguuucuggauugugcuuaagauccaauauacuauaaucaaaguuuucucacuaggaauccaaauguuuaugauuccacuagguacauaacuuauauugaauauauaauuggaagaauaauguuucuaggagagucaauuuagcuuaaagaauaagauaucuagucucuauuucucauauuucccccuuuuugcuuucuaaugucuuuuugcccugacaucacuacucaugggaaacaagaaacccuuggcuuaucaacauuauuaaaaagugacacguuuuaauuucauuagcauuauuuaaaccaguggucuuauuagcauuauuuaaucuaggguuuuuaaaauuagucaacauauaugaaaauguuugagacauauacuauauauauuuauaaauuacgcacauauaauacuguauuaauguguuauauauacacaaaaguacaaaguuuaacugaacaauaacaacaaucauuacagauacaauuucuaacacucugcuguuccagugauucauuuagagaacaauggguuagaguccuccuuccacgagccaggggauaauccauuuuggcuucaguauucuuaaaagaaaaaaaccaacaaaacaguauucauaaaaaauaguuucuggaauggccugugauucuuuaaaugacuucaugaaggcuacagagaguaaagaaugacaugggaccaucuucugggcuggaacagguuaacuaaugagcaccccuagucuguggaguuuauguaucaguuaaauuuagaccaggguuuugagauaggaaugaguuuacccuguucaggcaacagaacuaaggcccaauguggcuagacgccgauaagaguaggaugaaaagagaguaggaggagacaaaaucagagaugcugaaagaagcuacagcaaguaagaccuuaagagcauguagguaauugagacaucugcguuuuauucuuuuuuuuugagacggagucucuguugccaggcuggagugcaguggugugaucucggcucacugcaaccucugccucccggguucaagugauucuccugccucagccuccugaguagcugggacuucaggugcccgcuaccacacccagcuaauuuuuguauuuuuaguagagacaggguuucaccauguuggccaggauggucucgaucucuugacaucaugauccacccgccucggccucccaacaugcuuggauuacaggcaugagccacugcaccuggccaucugcauuuuacucuaagcaauggaaggguuuugggcagaggacugacacaaucuaauuugcauuuaaaaaaaauauuuuggugacugcauggagaaaggauuguacaugcacaagagucaaagcagggaggccagucaagggaagauuugcaauaguccaggugagagauacuugaagcuuggacucaggagguaguaggggugugauauaguuuggaucuguguccccacccaaaucucauguugaauucuaauccccaauguuggagguagagccuggugggagaugacuggaucaugagauggaguucuuauacaugguuuagcacccuucccccuuguuacuguauacugagugaguucucacaagauaugguuguuuaaaaaugugugguggcugaguaugguggcucauaccuguaaucccagcacuuugggaggccaaggugggcggaucgcuuaaguccaggaguuugauaccagccugggcaacauggggauggguaugguggugugcaccuguagucccagcuacuccagaggccgaggugggaggaucacuuaagccugggagguggagagugcagugagccaagacugcgccacugcacuccaaccuaggugacagaguaaaacccugucucaaaaaaaaaaaaguguguggcaccuccccgccgucuuggugcugcuccugccauguaagaugccuguucccgcuuugccuuccaccaugaguaaaagcuccuggaggccucaccagaagcagauguggccaugcuuccugcacagccaauuaaacuccuuuucuuuauaaauuacccagucucagcuauuucuuuauagcagggcaagaauggacuaauacacugggucuacaggaugaugguuuugggaaaaucaccuugcucagccuuuauugcaccaauuauuuguaccuguuaugcaaggaaauauguagccagagucuccagaaaggaccaggcaggagucaggggaucaaaaagguauuuaaugucuccaccugccucaggagaagggcaauaauagcuccuaaaacauggcagaauauucauuuuguacaggugauuuauccacaguuauaccucauuauagguaacucaaagaaaccuauaccucuuugugauagcaugcuguuauuuccugcuuuguauaaccacuucuuuggauuugcauauauuuugccauuaaagaaauuuaacauauacugucuguuuauuucugccuuucaaucauaucaccauccuguuggacaacccucugagagaagaaugucucacugauuuuaaucuuaaauguggggaagacuagggauaacaaguuugggaagaaaaaucaagaaugaauucuguuaggaacauguuaaguuugagaugacuauuagacauucaaggagagaugucaaguaggcaggugaauaugaaaggcuggcauucugaauuugagaguaaucaccauaucaaugguauuuaaagccauacaauuagaugggaauacaggaaaagaauggaaauuagaagacauaaauuaguggcccacggauccaucugcugacucacagacaugcuuuuauuauaauauuauuuuuggucuccacguauuuaaaaacuuacgccagaauuuuuaaauuaguagaguucacauuuuaaagaauccauacuccaaguuucuuuuuaaagaacugggcaauccaguaacaguugguuugaacuauauggcagcuuuuucauuuauaugaggcaugaauucucuaauucaccauaugucuuuucaacugaagccaaauguugucuucacuuaccaucauauuuguacaccacuauuuuucuaauacaaagaaauauuucucaggauccauguugcuaguaaaacuacaaaaaugaaagauagacccuagaggccuuauguuuaaagaaaacaugaaagguaauacauuuccuuacgaauuuaagaacauuccuauguauuaaaaaaaagcaaacaaucacucuauaucauucauuuacagaacgugcuugacucuuguaggcaucucaguuugcaauaucugggguggauacagaagagaccaagccugacccauuucaauauuuagauaucagguaaaacaggaaucagaaaaggaaaaaguagaaaggauaauaagauaggagauagaagaaugugagugugaugcuuuugagagcaagaauaacgaguccaaauaaguguccacuggacuagaaaacaagaaagccaucaacuugaccaguuucaguggaguaauauggaaagaugucagauuaaaguugguugaagaauaaugaagaauaagaaauuauauccaagagaacagaaggaaagaaacaauagacauaagaguagaaaucaauuaaacacaaauauaaagaagaucaacaaagcaaaaaguugguuauuugaaaagacuaauaaaauuaauaaacccauggaaggaauuaugaagaaaaaagaagcacaaguaagcaaagucaggaaugaaaaaagagacauuccuaguuaucuaccaaaugggguaaaauuuuucagaggauaucauaaacaaauauaugccaauaauuuuuuuuuuuuuuugagauagagucucacccuaccaccuagguggagugcaauggcacgaucuuggcucacugcaaccuccaccucccagguucaagcgauucuccugccucagccucccgaguagcugggauuacaggugcgcaccaccacgccuggcuaauuuuuuuuuuuuuuuuuuuuuuuuuuuuuaguagagacaggguuucaccauguuggccaggcuggucuugaacuccugaccuugugauccaccugccuuggccucccaaagugcugggauuauaggcaugagccaccucacccagccagccaauaauuuuuuuuggagggggagacagggucucgcuuugcugcccaggcuguagugcaguggcaugaucauagcucacugcagccuugaacuccugggcccaagccauccuaccaccuuagccuccugaguaucugggacuaaagacucacaccaccaugccaggcuaauuuuuuaauuuuuuuguaaagacagauucucauuguguugaccaggcuggucucauacuccuugccugaagugugauccuccugccucagccucccauaguggugggauuacaggcaugagccacuacacuugguuuaugccaauaauuaaaaaauuuuaaagauaacauauuuagaugauaaaugaaauauauaacuuaucaaaacugagacauuaagaaauagaaaauauuaauagcucuauaacuauucaagaaauuguauccauaauucaaaaacuucccuuaaaggagaacuccagauggcuucaccaguagauucuaacuaaacauuuuaaguaaaaaagaaugacaaucuuauacaaacucuuccagagaacauaaaaauaggaaacaccccuaaccuguuguaugaagcuagcauaacuuuuuuaaaucaaagccugacaacggccaagcacaguggcucacaccuguaaucccagcacuuugggaggcugaggcagaaggacugcuugagcucaggaguuugacaccagccuggacaacauggcaagacucccaucuccacaaaaaaauuaaaagauuagccaggcauggugguaugcaccuguagucccagcuaccugggaggcugaggugggaggauugcuugagcccaggaauuugaggcugcagugagcuaugacugagacacugcacuccaaccugggcaaaaggacaacucuaucucuuauugauugauugacuuagaaagaguuucacucuuguugaccaggcuggagugcaguggcacaaucuugguucacugcaaccucugccuuccgguuucaagcgauucuccugccucagccuucccaguagcugggauuacaggcacccacaaccaagcccggcuaauuuuuguauuuuuagaagagacgggguuucaccauguuggccaggcuggucucgaacuccugacuucaugauccgcccaccucggccucccaaagugcugggauuaccggagugagccacugcacccggcccaacucugucucuuuaaaaaaaaaaaaaaaaugcccagcacgguggcucacacuuguaaucccagcacuuugggaggcugaggugggcggaucacgaggucaggagaucgagaccacagugaaaccccgucucuacuaaaaauacaaaaaauuagccgggcaugguggcgggcgccuguagucccagcuacucgggaggcugaggcaggaguauggcgugaacccgggagguggagcuugaagugagccaagaucaugccacuguacuccagccugggugacagagcgagacucugucucaaaaaaaaaaaaaaaaaaaaaaaaaaaaaaaaaaacagagagacaaaacacuugcugagagagauggugucugagacuggcauucaaacaggagcaagaguugcccaggugcaggcgccagacaggaggagggcauuuaucccaggaauucaaaaaucaauguauuucaacacaauaacagcauaaagagagaagauauauaauuaucucaacaaaugcagaaaacauuugauuaaauucaccaaccauucaugauuuaaaaaaaaaacucuuagcaaaccaagaauagaaaugaacagauuuaaucugauaaagggaucuacaaaccuacugcagauauuauacuucaaggugaaauguuaaaagcugucauuuugagauagggcauaagucaaggauguccacuaucaccacaucuacugaacacuguacugugauccuagccagguacaccaaggcaagaaaagaaagaaaaaaugacaaggacgggaaagaaauaaaauggucauuuucaaagauaauagucuauauagaaauccaaaagaaucuacaaguaauuagaacaagugaguuuagaaagauuccuuaauacaagagaaauauguaaaacucaguugcauuuuuccauguaccagaaacagaaaaauguuuaaaaucuccauuuauacuuaaauuuaaaaaucacagaaaacuauaaauacauuauuaaaagaaacuaaaggucuaaacaaacacuuagauucaaaaacucaauauuguggucuaacaauuccacuacuggauauauacccaagugaaauaaaauuaguaugucaaagagauagcugcacacccauguuuacugcagcaccauucauaauagccaagauauagaaucaaccuaaguguucaucaacagaagaauggauaaagaaaaugugacucaggauauaaaaucaaugugcaaaaaucaaagcauuuuuauacaccaauaacagacaaacagagagccaaaucaugagugaacucccauucacaauugcuucaaagagaauaaaauaccuaggaauccaacuuacaagggaugugaaggaccucuucaaggagaacuacaaaccacugcucaaugaaauaaaacaggacacaaacaaauggaagaauauuccaugcucauggauaggaagaaucaauaucgugaaaauggccauacugcccaagguaauuuauagauucaaugccauccuuaucaagcuaccaaugacuuucuucacagaauuggaaaaaacuacuuuaaaguucauauguaaccaaaaaacagccugcauugccaagacaauccuaagccaaaagaacaaagcuggagacaucaugcuaccugacuucaaacuauacuacaaggcuacaguaaccaaagcagcaugguacugguaccaaaacagagauauagaccacuggaacggaacagagcgcucaaaaauaauaccacacaucuacaaccaucugaucuuugacaaaccugaaaaaaacaagaaauggggaaaggauucccuauuuaauaaauggugcugggaaaacuggcuagcauaucuagaaagcugaaacuggaucccuuccuuacaccuuauacaaaaauuaauucaagauggauuaaagacuuaaauguuagaccuaaaaccauaaaccuuguccaugccaggacauaggcaugggcaaggacuucaugucuaaaacaccaaaagcaauggcaacaaagacaaaauugacaaaugggaucuaauuaaacuaaagagcuucugcacagcaaaagaaacuaccaucagagugaacaggcaaccuacagaaugggagaaaauuuuugcaaucuacucaucugauaaagggcuaauauccagaaucaacaaagaacucaaacaaauuuacaagaaaaaaacuccaucaaaaagugggcaaaggauaugaacagacacuacucaaaagaagacauuuaugcagccaaaagacacaugaaaaaauguucaucaucacgggccaucagagaaaugcaaaucaaaaccacaaugagauaccaucucacaccaguuagaauggcgaucauuaaaaagucaggaaacaacaggugcuggagaggauguggagaaauaggaacacuuuuacacuguuggugggacuguaaacuaguucaaccauuguagaagacaguguggcgauuccucaaggauccagaauuagaaauaccauuugacucagccaucccauuacuggguauauacccaaaggauuauaaaucaugcugcuauaaagacacaugcacacguauguuuauuguggcacuauucacaacagcaaagacuuggaaccaaauguccaucaaugauagacuggauuaagaaaauguggcacauauacaccauggaauacuaugcagccauaaaaaaggaugaguucauguccuuuguagggacauagaugaaguuggaaaccaucauucucagcaaacuaucgcaaggacaaaaaaccaaacaccgcauguucucacucauaggugggaauugaacaaugagaacacuuggucacaggaaggggaacaucacacacuggggccugucauggaguggggggagggggaagggauagcauuaggagauauaccuaauguaaaugacgaguuaaugggugcagcacaccaacauggcacaaguauacauauguaacaaaccugcauguuguguacauguacccuauaacuuaaaguauaauaaaaaaaaaagaaaaugugauauauaaaucucucccuccaaaauggaauauuauuuguccauaaaaaauaaugaaaucuugucauuugugacaacauggcuaaaccuggaagacauuauguuaagugaaauaagccaggcacagaaagauaaauacugcaugagcccacucauauguggaaucuaaaaaaguugaccuuggugggcauaguagcucccucccauaaucccagcuacucgggaggcugagguggaaggaucacuugaggccagaaauucaagaccagccuaagaaucacagugagacuucaucucuaaaaaauaaaaauaaaaauuagccaguugugguagugugugccuauaguccuagcuacuugggaggguaaggcaggaggacugauugagccuaggaccucaaggcuguagugaguuaugaucacgccacugcacucuagccuggguaacagagcgagaacaugucucuaaaaaauaaaagaguugaucucauagaaguagagaguagaauaguguuuaccacaggccaggaugguugggaggagaggaggaugagaaaauguugaucaaagaauauauaauuacaguuacauaggagggaugaguucaagacaucuaguguacagcauggugacuauaguuaaugaugauauauuguauuacuaaaaugcaaagauaguguauguuaaguguucucaucauuaaaaaugauaacuaugugaaguaaugcacuuguuaauuagcuagauuuaauuaucccgcaauguauauaugcauaaaacauuauacauaauauauauaauuucaugucaauuuuuuaaaacccuucaauaauauaaagaagucaguucccuacaaacugaucuauacaauacaaucucaaucaaaauuucaagaaaauuuuauaggaccugaaaauugauucuaaaacguauaagaaaauguaagccaggugugguagcaggcaccuauugucccagcuacucggguggcugaggcaggagaauggcuugaacccaggagguggaggcugcagugagccgagaucaugccacugcacuccagucugagugacagagugagacuccaucacaaaaaagaaaauguagaguaucaagauuauccaagauauuguggaaaaagaacaagauggcaggucuugcugccccagauauccagaguuauuuuaaagcaaugguaaauaagaaaguauauaauaauuggugcaacaacagaaaauuagacaaucaagaagacaaaaacagaucuagacacauacagacacuuguuuugugauaaaguggcauugcagagcaaucaggaaagguuuaucuguucaaucugugauucuaggcagauugacuaucccuuuaggagaaaaaauuaaacuuaacccuaccacacaucauauacaaacacaccuaaaaaaucaauuucagguggauuguaaaucugaaucgccaagguuaaaaccauaaaacuccaagaaaaugacauggggagaauauguucaugacuguguauagggaaagacuugaucaacuguacuacacagaucuucuguuuaucaaaauuaaacaucaaaagaauguaaaggcaauucacagaaugggagaaaacauucacaacacaaauuuaacucccggaggguucauaugcagaauauguaaagaacuucuauaaagacaacucgauagaaaaugaggcaaaaaaaaaaaagaaaaugaggcaagagacuugaauggacacugcauaaaagaggauaucuaaaugaccauuaaaauacaaaaagauguucaauuucauuaguaaucuggaauaugcaaauuaaaauaauagugaacuauuacuacaagcccaacagaauggauaaaauuuuaaaauaugacaguaccaaauguggacaaggauguaaaacaaaggcaauuuucauauauagggagguuaaauuaguguaaucacuucugaaaacagcuagaaacaauggaaucagucauaugcuacggaugggaagguaaauucauaaaaagaucuugguaaacaguuuggcaucaucuauaaaaguuaaaauugugcgugcaugugcacacaaacuccuugacccagaacuccacucauagacacauacgcccaauaaugaguguaaauguucaauugcaccauucuuugcaagagcccccaaauguaaaugauauauuguauuauacacacacacacacacacacacacacacacacacauauauuuuugagauggagucucgcugugucacccaggcuggagugcaguggcacacucucagcucacugcaaccucugccuccuggguuccagcaauucuucugccucagccucccaaguaacugggauuauaccuguaugcaucaccacaccuggcuaauuuuuguauuuuuaguagagacgggguuucaccauguuggccaggcuggucuugaacuccugaccucagguucaggugauccacccaccuuggccucccaaagugcugagauuacagguguuagccaccacgcccggacuauacuguauuuuauauauauauauaaauguccaucaauaauagaauggaaaaauaagucaugguauauuuauaccauggaacacuauauggcaacaaaucauagucacacccaacacagguaaaucucacaauguuuggaaaaagaagcaagacaaaaaagagcacauacucgaugauucauuuauacuaaauuuaaaaaacagguaaaauuaaacuauagugaugagggaggcaugccuaagcaguaaaaguauaaagaaaacaagaaaguaaauagacuuucuugagacaggauaaugguaacccucagagggcagugaggggacaaugauuucaaguggacacaacaggagcuccuggaguccuagcaaucuuacguuucuugaccuaguuucuaguuacacagcugagcuguucucuuuacauaaaucauucaguguuuauuuuuguuccaggcacuuuucuugauguguuauauuucacaauaaaaaagucuaaaaaaagacucaggggcagguuaaacagauuagacaaagccaaauaaagaaaaagggaauuguaaaagagaccagaagaaaucguauauaaugaaucuagagagacuaagauauguuaaauauuaaauuccagcaagaaagaagaaaggauaaagacaaucuuuaaagagaaauuuuaaauugauaaaacaucaauccuauuauccagauauuuuucugaaucccaagcuagaaauaaaacaccuagacucaucauagugaaccuucagaaccauaaacucaaagagaagaucuuaagaagagauaugaaaaaauuacauuacuuacaaagaaucaagguauagacugacaguuaucuucaacagcaauaacggaagccagaaggcaauggaauacuauccugaaaaugauaaacugccaaaccagaacuuuacacccagagaaaaucucuuuaagauuaaaaucaaaauacagacauuuucaaaaugaugaaguuuauuaucaaugggcccuaaacuguuaaagaacgauuuuaaggaaaaugauccccaaaagaaggucagagauauaagaaaaauguaagcaaagaaaaagguaaauacaaggucaggagaucgagaccacccuggcuaacacagugaaacccugucucuacuaaaaauagaaaaaauuagacgggcauuguggcacacaccuguacucccagcuacucaggaggcugaggcaggagaaucacuugaacccgggaggcaaagguugcagugagucaagauugcacuaauguacuccagccuuggagacucugucucaaaaaaaaaacaaaaaaaaagguaaauacagcuggaugcaguggcuuaugcuuguaggaggaccaagugagaggaucacuugaggccaggaguugaagaccagccagggcaacacaacaagaccccauuucuacaaaaaaaaaaaaaaaaaaaauuauccaggugcaguggcacaugccuguagucccaguuacucaggaggcugaggcaggaggaucacuugagcccaggaguuugaggcugcagugagccaugcucacacaacugcacaacaaagcaagaccucaucucuuaaaaaaaaaaaaaaaaaaaaaaaaagggcccagcaugguagcucacacacaccuguaaccccagcacauuuugggaggccaaggcaggaggaucacuugagccuaggaguuugggaccagccugggcaacacagcaaaauccugucucugugaaaaagagauggcaugugguggcucacaccuguaaucccagcuacucaggagggaggauuacuugggccugggagguuaaggcugcaguuagcugugaucgcacaacugcauuccagccugggcaaaagggcaagaccccaucuacaaaaaaaaaaaaaaaagaaaagaagaagaauacaggaagguaaacacuuugguaaaucuaaacaaauauugacuauaaaacaacaacauaggccaggcacgguugcucacgccuguaaucucagcacuuugugggacugaggcgaauggauugcuugaguccaagaguuugaaaccagcccggaccacaccgcaaaaccccgucucuacuaaaaauacaaaaaaauuagccaggugugguggcgcacaccuguaguuccagcuacucaggaggcugaggugagacaaucaucugagcccagggaggucaaggcuaaagugagccaaaaucccaccacugcacuccagccugggugacagaguaagaucuugucucaaaaaaaaaaaaaaaaaaaaaaaaaaucaagaaccauuggaaccaagugacagugguggcacauaccuguaguccuagcuacaugggaggcugagacagaaggaucauuuuagcccaugaguucgagguucagugaacuaugauaaguaccacugcauuccagccugggaaacagagugacaccacccugucucuaaaaaaaaaaaacaauaaagaagaacaaaaauaauaaucgaauaaacauuuacauaaaagugaaugaaaaggaaagcaaaacaggaauggaggaauaaauagagcaagaauggaugauuuuucauuucugucuucguuuuuucuuuuuuugagacagggucucacuugcucugucgcucagguuggaaugcaguggcgugaucucggcucacugcaaccuccaccuccugggcucaagcaauucuccugccucagccucccaaguagcuaggauuacaggcgccugcuaccacgccuggcuaauuuuuguauuuuuaguagaggggaggauuucaccaugcuugccaggcuggucucgaacuccugaccucaagugaucugcccgccucggccucccaaagugcuaggauuacaggcgugggcuaccgcgcccagccuauuuuuguuuucuauucaucucuuaaauuuauucuaucuuauuuuuacaaggaaggaagccaugaaugacuuuuucauugaguuuuuuaugacagcaaucaggaaaaugcagucaugccuaaagggaaauguggaauccaaccugaguuuaauacacaucaaaagucaaaaugaggugggguuagauuauuugccacuuuaacuuuucuaugccucugcuauaguaauuaaaguguauuauuaucagaucaauuacuauucacuucagucuacccugcuguugcucaaguuauccuucguuuaguuggaauaauccaggugcuuggcacaggugaauuuuccuaaucugcuagagcuuaccacuuaaacccuauuuucuucuauuguugcugauguaaauaguucuaaaaugauguaacuuuuuacacagaauagauuaaaaucacugauccuuucuugauggcccaaggucauugguauaaacgacuacuacuauugcugauauaaagaaacacccucaguagcugugguguaagggcuuuugugacuacaaagauuuccccacacugucagguguucucuuuuuggucaucacaguguuggcaucuaguagccucuucuaucaaccugugaacugauuuuguggagccauucugcuuagggacucuuuuaauuacauuuccuggauacagcaagagaaauagcauuagggguggaaccugaagauguuauuaaacugcugcaaucucaugauaaaacuuuaacagaugaagaguugcuuuuuauggaugagcaaagaaagugguuucuugagauggaaucuacuccugguaaagaugcugugaacacuguugaaaugacaacaaaagauuuagaauauugcauaaacuuaguugauaaagcaauggcaggguuucagaggacugacuccaauuuugaaagaaguucuacuguggguaaaaugcuauuaaacagcaccacauaguagagaaaaaucucucaugaaaggaagagucaaccaauguggcaaacuucuuuguugucuuauuuuaagaaacugucacaggaacuccaaccuucagcaaccacuacccugaucagucagcagccaucaauaucaaggcaagacccuccaccagcaaaaagauuacaacuugcugaaggcuuagauaauuauuagcaauuucuagcaauaaacuaauuaauguacuuuuuaaagauauaauguuauugcauacuuaauaaacuauaguauaguauaaacacaacauuuuuuuuuccccgagacaggaucucccucugccacucaggcugaagugcagugguguguucauagcucacgacagcuucaaccuccugggcucaagcaauccuccugccucagccucccaaguugcugggacuacaggugggugucaccacaccuggcuaauuucucuuuuuguagagauggagucucgcuaugcugaccuggcugacugguauuaaacuccccgccucaacugauuuuccccaccuuagccuaccaaagugcugggauuacagucaugagccaccgccacacucagcauaagcauaacuuuuauaugcacugggaaaccaaaaaacucauguaacucacuuuuuugcaagauuugcuuuauugccauggucuaacaucgaaccuacaauaucuccaaguuaugcccauauggugaaaauuagaugaugcaagcaaaacauauaguacauggcuuagaguaaaugauguuucaaauguuaacuguuaucuuuuaaaauccuaaguaauaauuuccauuuaaauagaauuccuuagcuauuuucuccacggcauccuuaugaaaaugcuacuacaaauauuaacaguggcuaauauuucaugaacacuuacuacuauauguucacacugugcugaauccuuuaugggggugaucuauuugaauccuuagaaaagccacuggagguagguaccaugacguuccuauuacaaacaaccaaacaaacaaagacuuagagaggcuaaauagcuuguccaaguucacggaaugauaaguggggaaaauacaauucauauagguuugacauaauuguaauccauaauuguaagcacuccgccauccugagaggaacagcagcuucuucuucugcuaaaaucugcuuauaagcaaguugagaacaagcuaauucauucuccuuuaaccuuauuuucuacuugacuguccaaggucccaguuggaaaagcagaaguuguuuuuuuuuuuuuuuuuuaacuuuugcuuuuuaacuuacccacucacagucaauuccaaguacuggaaaaucuucuaauucacuucuaagcaagggcucgauuugaucccacucugccuccugagacaccgucaccaccuuugcuuuaaggauccguuccuuccacgaggaucugggggcacuggagugcagcugaucaucuucuggagggggcagcucucuacugcccagcacuuucugcuguggcuguugggucacaggacucguuuuacuccuucggcggcgcuggaugccuuuccagaggacaaaccccccuacagccacacccagaaggguagucacugucaaagccacuaaguucugucuagacaucuucgacuuuucuacucuuuagaaaagcauaucacuaaucccacaaucugcaaaacaaauggcaaaaauauauuuauauacagaauauaaaccuuuacauaaacaaguuuuccucuaaaaaaugccccauuuauaaucucugugcccacaaacuaaaacaacugcuauaaauuuccaugugaaauaguagcaaugguuuaauuucuucaucuuuauaaucucuguauuccaucucuaucuccauccucaccccaggaaaucucccugcccucugacaguuccccauggcucucuuaaugauauaaaaucauaucagucaaaacaacaggcuauguacacaaugaagugugaucuaggaagaaaaaaaaacaauaagcuagacucucaccucuaacugcugauuaaugaaugaauuuuuuaguuaauggaucuucuucaaaguauuuuguauuuuaaaccuuugaucaccuaacaguugaaggaaaacugcuucucaauuuaaaaaaaauuguaaucaucagucaguugguagggagacuuuuuuuacuucucuggaaggugcggcagugagggaguggaggaaacagguuugacucaacacuuucuguugcuccagaaggcucagcaguucuccauagaaacugauacgguuauuguaggguaagccagcggggguacaaaagagaaaggaucagaaaagcaaaagaaaaagguagaacuuagagagauauacaagaugcauagaaggcggaugcaaacugaaguguccacagcgccaggcagguuaauguaaaucaaugaagcaagccacaaaauaguuccuuuuucauuuuucuguaacauguggcuuucuccauguaguuucuguuuuccuauaugugagaaagaaaugaguauacagcacuauuucuguucuauuaaaauaacaguaaaagugcaacaguaaauaguaaguggccugggccgggcgcgguggcucaugccuguaaucccagcacuuugggaggccgaggcagguggaucacgaggucaggagaucgagaccaucccggcuaacacagugaaaccccgucucuacuaaaaagacaagaaauuagccaggcgugguggcgggcgccuguugccgcagcuacuugggaggcugaggcaggagaaugguaugaacccgggaggcggagcuugcagugagccgagaucgugccacugcacuccagucugggugacagagugagacuccgucucaaaaaaaaaaaaaaaaaauaguaaguggccuggccaggugcaguggcucaugccuguaaucccaggacuuugggaggccaaggcagguggaucaccugaggucaggaguucguuccagccuggcuaacauggugaaaccccaucucuacuaaaaacacaaaaauuagccaggcgugguggugggcaccuguaaucccagcuacucaggaggcugaggcaggagaauagcuggaacuugggagguggagguuucagucagccgaaacugagccacugcacuccagccugggugauaagaguaagacucugucucaaaaaagaaaaaaaaaaaaaaaguaaauggccuuuggucucagggccagggagaaaacauggagcagcaaccauucggcacaagcugaugauccugugcaggaagaaggcccaguguggucaaauacuuugcuuguuuaagauaagucagguaucugaauuuuacaugaaaugucaccauuuuuaaaugcuggcaauaaacuuacaguuuuaaaaaauauugcgccagccaaacaaaaacacccuaggcacacaccaggcuacccaucuguggccucuggccuaaaagcuaaauugcccaaagacagagcaaucagcugcacccugccuauacuucucuauggcugaagguuucccacugaauguguaugguuuuuauuacuauuuaaaaguuucaucaauaacuuuaaauuuuuuuuuuauuagauggagucucucgccgucgcccagaccugugugcaguggcaugaucucggcucacugcaguauccgccuccugaguucaagugauucuccugccucagccucccaagcagcugggacuacagggguaugccaccauacccagcuaauuuguguauuuuuaguagagacaggguuuuaccauguuggccaggcuggucuugaacuccugaccucaagugauucaccugucucagccucccaaaaugcugugauuacaggugugagccacugcacugggccaaaaaaaaaauuucauauuuacaauaacuucuggauuauaaucaugccuguagagauaugugaguauuagagaagaaaaacugaauuacaacaauuauuagaguaauaaugaaaagugguaauaguuaugcuguuuuaaaaacauuuacuuuauuccagaaacugugcuaagaauuucauauguauuuucuccagugcuuuuauugaagaggaaacugaagcuuaaugagauuaaauaacuuguguagagaaacugcugauuaagguaaucugagaagacauaaaaguccuucccuuuuccacucuaaacaaugcaaaugcuggagaaaccacugaaaagauaaaaauguaaaacacaguuaagcccccaaaagaaagaaagaaaucaucaggugccagaaagggaggaggaaaccccaaguggguggaaggcugggcgcaguggcucaugccuguaaucccagcacuuugggaggccgaggcagguggacggcuugagccuaggaguuugagaucagccugggcaacauggugaaaccccaucuacaccaaaaauauaaaaaauuagcugggcgugguggcacaugccuuaaguaucagcuacuuggggggccugaggugggaggauagcuugagccggggaggucaaggcuacaggaagcugugauggugugccacugcacccacugcacucuagccugggugagagagugagacccuaucucaaaaaaaaaaaaaaaaaaaaaaaaaaaaaaagugggugggugggagaugaagcugggcagagaccagaacucaugccagccccagcgcuggaguauaucagcaacccagaggcagaacucuaggccacaggcccaagacacagcuggaauccaggggagugccacccuauccacaaaccagaaguauuuacccaccuuggccugggcaagccaccugccccaggccaaaggcaugaacagagucccuugaaagaggaaaauuccucagcugggugcaguggcucacaccuguaaucccagcacuuugggaggccaaggcggacagacagcuugagcccaggaguuugaaaucagccuggccaacuuagugaaagcccgucucucuacuaaaaacacaaaaauuagccaggugugguggugcaugccuguaaucccagcuacuccagaggcugaggcaugagaaucacuagaaccugggagguggagauugcagugagccaagaucacgccacugcacuccaaccugggcaacagagugagacuaugucucaaauaaaaauaaaaaauaaauuaaaaaauaaaagacaaauccucaagccuacacuucucuauggcucaagcagauacaaggcccaaguucacauuauccucauaaaagggaacccuaagccaagaaauugaauuuacacugguucagaacugguaaauucuauuggaaccaggcagagucuaucauaacacacacacacaaacacaccccacauaggaaacauacaggacuaccauggaagaucagucccuagaaggggucucacaaugaaucacaacaaaacaaaauccuaaagccaauaaaaauagugcauagagccaucaaacaaagauuuccauacuugagaucugaaaaggacuuuaaagaauauucagagauauuaaugaaaauaauaacuaaaacaaagacaaaaauauauacauucuagauaugaaaaauauuuauuaaaaauuuuuaaaaacucaauacucaauagacagguuaaaauguagaccagacauacagaaagaguuaaugaauugaagaaaaaaaucugaggaagucaccagaauguaguagacagauaaagagggagaaaacauacugaggcgaagcauggugucucacgccuguaaucucaacgcuuugggaggccgaggugggagcaucacuugagcccaggaguucaagaccaaccugggcaacauaaugagaucccaucuuuacuaaaaaaaauuuuaaaacagaaagaauacacaacaaagcagagacauggggaauggacugagaaacuccaauauucauggaauaaagauuuggaauguaugaagggggucagauuugguacuauucucugagccccaagcuggauaaauuaaaucuauucacaaaaagacucauauaagaauguucauagcaguuacuuauuuguaacagccaaaaacuggaaacagccuguuggccugaaugauuaaugugugacuguugguucauucauugucuguccaugagaacaggaaccuuaacuggcuuuguuaccaccauuauccccagugacuagcagggagcugaugauacucaguaaauauuuacugaaugaaugaaauucagcucaagguauuauauguuaacauuuguaugauaaaugucucuaauucaaucaccagauuacaacauucuguuuauugaaaugaaaaaaguuuuuuaaccuuaucgagccuugauguuauaaagagguaguaugguucaguacuggguugggagucagaaaaaaauuaaacugugguaacaguuuacucugggauccaagcuuuucgaucccucacuaaaucucaucagugaaacaaucugucauucuuaaguuuuuuauauaaauuaacugaacauaaaacuuuuuuuuuuaagacagaguuucacucuguugcccagacuagacugcagcacaaucacggcucacugcagccucgaccuccugggcucccacuucagccuccugaguagcuggggguacaggugcaugccaccaugcucagcacauuuuuugauuucuuguagagaugcgggucacacuauauugcccaggcuggucucaaacuccuaggcucaagugauccuccugccucaccuucccaaagugcucggguuauaggugugagccuuaugccuggcuaaauaucaacggcuaccuaaugauaguaggauuauuaacaauuuuuauuuuucaaauuuuauacgaauauguacauauuuguaauuagaaaaauacacucuuuuuaaacuggugcucuuuagagauaggcaaucccacuugacaaaacacagaaucauauucuuggaauaaaucacacuuuaaugaguuaaaugauuauguauaaaguguuugaaaugcaguauaugguagacaacacaagaccuaacaucaaauagcguaggcuuaaauccagccucuguuacucacuagcuguaggaacuuagccaauuugccaaacuucucuaagccucaguuuccucaucugcgaaacaggaaggacagucuccucaucugugaaauaggaauaccauuauguaggauuacugugaggcuuaaguaaaaugauaaauaaaauucaccuaguauauuggcuagaacauuaggauucuauaaauguuagcuauuacuacaaaaccacagaacuucuauuaaaggaaaucaaaaaaucagaguuaaaauuuuggagucaaguucagcucccacccaauucaagaauccuuuccaugauaaucccaacagaucaugaccuagucucugacugaauacuuccaguaaccgaguucaucaccuucagaggcaguuuuuguugaaaguccuugcguucuauaaaaguuuccugcuuacaaauugcccucuuugacagccucugcaaugacaaguguuuacucccuccuuaaagccuguuaaauaggugaagagagcucugagacuccccuuauagucuuccugugaccugguuuauagacucuccuggccaaggccuucugcacagacccaaguuuguuaauguaucucuucaaauguggcauucaggucuauacgcaauacuugaagccaggcaugauggcucaggccuguaaucccagcacuuugggaggcugagguaggcggacugcuugagcccaggaguucaagacuaccuagggcaacauggugaaaucccaucucuacuuaaaaaaaaaaaaaaauuacaaaaaacuagccagccaggcaugguggcaugcaccuauagccccagcuacugaggaggcugagaugggagaaucaccugagccugggaagucaagacugaagugagcugugaucacaccacugcuguccagccuaggcaacaggagugagacccugccucaaacaaacaaacaaacaaacuugagacacggucuaacugaugcaggcuacagugauacuauuacuucccagcagcuggauccuauauuaaugcuguaugaaaugauacauuuuuaaguaacagaaucucauuguugggucauauaaagcuuguaguaaauuaaaauucacugaugccaaaucaaguucuucauuuuauauauuuguaauuuauauuuuguacuuaaaucaaaaauccuucuucuaaauuucaucuugucuguuucagccaaauguuucaucuauugaggccaaucugcaucuugauuaugcuucccucucaaacauaauuuuacauaaaaaacugaauauuuguuuucagagaaaauaacaucuccuaacauacgguuuuauuaauucauuuuuauuugaagagguuuuguaaacugcauuuuuuuuucuuuuccagccaagggauucauucagcaaacuuuuuacacaacacauuauauaagucagacacugauagaccccggguaaaaagagucgaaaggcacaaucugccuucgaaaaauucaugauuuagccaaggaaaaauacacguaaugaacaaguugcaaagagugggauaacaccaacaagugaagcacacacaaguacaugaauggcuuggacuugaggaaagaguggggauauuguuuuuauuuuuauuuauuuuuuugagacagggccucacuuugucacccaggcuacagugccguggcaugaucucagcucacugcacccuugaccucuuggguucaagugauccucccaccucaacccccccaaguagcuaggaccaaccacaggcacaugacagcaccccaacuaauauuuuguauuuuugguagaaacgggguuuugccagguugcuugggcuggucucaaacuccugagcuccaacacccgcuaauauuuuauauuuuugguagaaacgggguuucgccagguugcccaggcuggucuugaacuccugagcucaagcgaucugcccacaucaaccucccaaagugcuaggauuacaggcaugaacaccacaccuggccgaguugggguauuauuaagagaaaacauggcugagugcgguggcucacaccuguaaucccagcacuuugggaggccgaggcagguggaauaccugaggucaggaguucaacaccagcugaccaauauggugaaaccccaucucuacuaagauuacaaaaauuagccgggugugguggugugcgccugcacucccagcuacucaggaggcugaggcagaagaaucgcuugaacccgggaggcggagcuugcaguaagccgagauugcaccacugugcuccagccugggcaacagagcaagacucugucucaaaaaaaaaaaaaaaaaaaaaaaaaaaacagagaaaacacuugcugagagagacggugucugagacuggcauucaaacaggagcaagaguucuccaggugcaggagccagacaggaggagggcacugcaaguggagggaacagcuugugcacaaaugggaagggcaggaagcaccacaggauaggugaaacauuuaaacaacuguaaaauguaggugggcacaguggcucaugccuguaaucccaguaguuugggaggccaaggugggaggaucaccugagaucaggaguuugagaccggccuagucagcauggugaaaccccaucuuuaauaaaaauucaaaaauuagccaggcauuguggcaugugcuuguagucccaguuacucaggaggcugagacaugagaaucacuugaacccaggaggcggagguugcagugagcugagaucauaacacugcacuccagccugggggacagaguaagacuccaucacaaaaacaaaaacaaacaaaaaaaaccaacguaagauguauuauacauguaaaauauacaccaaauuuuugaauacuuacuacaaaaaaaggauguaaacuuuuuauaauuuccauacugauuuuuuuuuuuugagauggaguuuugcucuugucacuccggcuggagugcaauggcacgaucucagcucacugcaacuucugccucccgaguucaagcaauucuccugccucagccucccaaguagcuaggacuacagaugcccgccaccacacccgguuaauuuuuguauuuuuaguagacacgggguuuuaccauguuggccaggcuggucucgaacuccugaccucaggugauccacccaccucggccucccaaagugcugagauuacaggcgugagccaccacgccuggccucauacugauuuuuauggugacuucuuuaucgugguaaaauauauauaacauaacauuuaccauuuuagccuuuuuuuuuuuggagacaaggucuggcucuaucgcaaaggcuggagugcaguggcgcgaucuuggcucacugcaaccuccaccuccugagcucaagccauccucccaucuuagccucccaaguagcugggacuacagguaguccccacgaugccuggguaauuuuuuuuuuguauuauuuuuguagagaugggguuucacaauguugcccgggcuggucucagauucgugagcucaagcgauccccuagacucggccucccaaagugcugggauuacaggccugagccaccacgccuggcccauuuuagccauuuuuaaguguacaauucaaugacaauaaguacauucacacugcugugcaaccaucaccaucacccauuuccagaacaacuucauccuugcaaauagaaacuguaauucaacaagaauucccauucucuucuaaccccugauaagcccuauuauaccuucuaucacuaugaauuccauauugauuuuuuaauauuuauguugaaauaaugcuuggaauauacuggguucaauauagucaugugcuguauaacaauguuucggucaacaacagaugacacauacaauaguucuacaaaauuauaagauuacaauggugcagaaaaauuccuauugccuagugacaucauagccauccuaaccguccuaacguugcugcacaaugcguuacucacaaauguguguaauuaugcuggaguuaacgaaccuacagcacagccagucguauaaaaguauagcacaugcaauuauguauagcacauaccugauaacgacaauaaacgacuauguuacugguuuauuuauuuaccauauuuuuuauuuuacgguguacuccuucuacuuauaaaaaaaauuaacuguaaagcaaccucaggcagcuccuuccgaaguuauuccagaaggcauuguuaucauagauacagcuccaugccuguuauugccccugaagacuuuccagugggacaagauguggagguggaagacagugauauugaugauccugacucuguguaugucuaagcuaacaugaauguauguguuugugucuuaguuuuuaacaaaaaaguuuaaaaagguaaaaaaaaaaaaauuuuaaguugaaaagagcuuauaaagagauaaacauuuuuauacagcuguacaacauauuugugucuuaagcugaguguuauuacaagucaaaaaguuaaaacaauuaaaaaguuuauaaaauaaaaaaguuauaguaaacuaagguuaacuuauuauuccaaaaaaauuuuaaauaauuugaguguagccuaaauacacacguguuuauaagaucuaaaguaguguacagucacguccuaagccuucacauucacccaccacucacucacagguucacccagagcaacuuccaguccugcaagcuccaugcaugguagauacccuacauaaguguaacacuauuuaucuuuucuugagacggagucucacucuguugcccaggcuggugugcaguggcgugaucucggcucacugcaaacucugccucccaaguucaagcgauucuccugccucagccuccugaguagccggggcuacaggcgugugccaccacacaagacuauuuuuuaaauuuuuaguagagacgggguuucaccauguuggccaggcuggucucgaacuccugaccucaggugaucugcccgccucagccucccaaaguacugggauuauaggcgugagccuccaugcccggcccacuguuuagcuuuuauaccacauuuuuacuguacuuuuauguuuagguauguuuagauacacaaauacuuaccacuguguuacaacugccuacaggacucaguacaauaacaugccauauaggucuauagccuaggaguaauaagcuauaccauacagccuagguguguagucagcuauuccaucuagguucguguaagugugcucuaucguguucacaaaaugacacauuucacagaacagauccucauuaagugaugccauuacuacaguucaccuuguuucuuuuuauaucuuuaauguggcuacuagaaaauuuuaaauuggggcucacauucuacuucuaauggacacuacugugcuaaaauauaaugugcaaguaaggaaauagagaugaugcuggaaugaguagauacaggacaagucaugaggggccaucauuauccuacaggacacuggagagcaaauaacagacuuauaaggagagugacaggaugagaccaccaugguacuaaugugggugcuagccuggaggagagcaaggccguaggcagagagaccuguuagaagcucauaaagcagagcggagaggcaaagaauacucgaauuauggcagaggaauguagaaugaaaaagaaccacagcuccugaacagaaugacugcaucacaaccaccuggaaaaacaacaaagucaucaaccaacuuuuagaaauuauaugguaauucagaaagucugaugaguauaaaaucaauagcuuuccaaaccuauuauaaaaaugugaaaaaagaaaucucauucauaauagcaauauaccuguacacuauuuuaaaacuacauaaaaaaaccacauaaucacauacacaagucuaggaaagaauucaacaagaaaugugucagaucaauacaaagaggaacagaaaacuuuagugaagaucuagaagaagaccagaagaguggagauguaugauagcagcugucaaacaggaccaaucaugugccaggcacuuuacauguacauauauacucauauuaaaguauucauuuaauccuuucaauaacccuaugugggagguacuauaauuauccuauuuuugauaagaagaaaagauuguuuuauagaaauacucaaaauaauauguaaauucaauacaaacuucauuuuaaaaaacuuuuuaaaagaaugaauugacugugugcagaugagaaaaauggaugcagcaacauggaucagcuggaggccacgaccugagugaauuaaugcaggaacagaaaaccaaauacugcguguucucacuuguaagugcagcuaaacacccaguacacauggacauaaagacgggaacaacagacacuggggacuaccagaggggaggggaagacagggaagggggccgcaggcugaaaaacgaccuauacccaauaccugagugaaggacucauccauaccccaaacuccagcauaacauguuacccauguaacaaaccugcacauguaccacccugaauuuaaaauaaaaguugaaauuauaaaaaaaaaagaaugaaucaaccaucgagacagcgaaaagacaacccacagaaugggaaaaaauauuuacaaaucauauauuugggaaggguguguaucuagaauacacaaaaaucucuuaccaccaaauaauaaaaagacagaccaauuuaaaaacuggcuaagaaucugaauagguauuucuguucuuuauuuuuuaauauauuuuuuagagacgagaucuggcucuguugcccaggcugcagugcagugaugcaaucacagcucacgacagccucaaacuccugggcucaagugauccuucugccucagccucuugacuacaagugugcuaacugaacagacaaguccagcuaacugaauagacauuuccugauagaggguauacaaauggccaauaagcacuugaaaagauguucaauaucaugagcuguuagggaaaugcaaauccaaaccacaaucagauaccacuuuacaccaaguaggaugguucuauucaaaaaaacaaauaaggccaaguaugguggugcacaccuguaauuccagcacucugauccaaggugggaggaucacuugacgccaggaauuugagacuagccugggcaacauagugagacccugccucaaaaaaaaaaaaaauuaauuggccaggagugguagugugccuauagacuuagcuacuugggaggcugaggcaggaggauugcuugaguucaggaguuugaggcugcaguaagcuuugaucacuccacugcacuccagccuggucaacagaguaagacccugucucucaaaaaaaaaaaaaaaaagugcuggcaauaauguggagaaauuagaaaucucaugcauuguuggugggaaugucaaaugguacagcugcucuggaacacagucuggcaguuauauaaccuagcaaugccacuggcagguauauacccaagggaaaugaaaacacauguccguacuaaaguucauagcuauucauaauagcccaaaaguggaaacaacucaaaugucaauuaguugaugaacagauaaauaaaauguagcauauccguauguuaugaguugaaucguauuccccaaaaagauauguugaaggucuaacccccaggaccugugaaugugaccuuauuugaaaauagggucuucgcagauguaaucaaguuaacaugaggucauacugaaguagggugcgcccuuaaucaacuaugacuuguguccuuacaggaggaggagaagaaacaggcuuacgcugagcgaauccaaugugcagacagacacacagggaaggugaccauuugaagacggaggcagaaacugaaguugugcaacugcaaaccaagaaaugccauggauugccaacaaccaccaggaacuagaagaggcaagguaggauucuccccuagagccuucaggaagagcacaacccugcugacaccuuaauuuugaacuucuagcuuccuuaacugcgagagaauaaaccucuguuguuuuaagucagcaguuuguguuacuuugaccacagcccuacaaaauaaauauaccacaggaugaaauuucauucaguaauaaaaagaaugaaguacugaaacaugcuauagcauggaagaaucuucaguacauuauccuaaguuaaagcagucagucacaaaagacuacacauuguaugauuccuuuuacacaaaacacccagaucucgaaagacagaaauauuagugguugccuagggcuggggucucaggggagucagggauagggacugacuucuaauugguauggguuucuuuuuggggugauaaaaauguucuaaaauuagacuacggugauguuugcacgacucuaugaauauacuaaaaucauuaaauuguacacuuugaagaauuguauggugugugaauuacuucucaauaaagccauuaaaaaaugauuuggagcugcguguggugguucacaccuguaaucccagcauuuuggaaggccaaggcgggugagucacuugaacccaggaguucaagaccagccugcgcagcauggugaaacuucaucucuauaaacaauacaaaaauuagccaguguggugguacacaccuguagucccagcuacuuggggggcugaggcaggaggaucacucgagcccaggaggucaaggcugccacugcacuccagcugagugacagagugagaccucaucucucuuuuuuuuuuuuuuuugagacagagucucgcucuguuacucaggcuggagugcaguggugcaauuucagcucacugcaaccucugccuucuggguucaagugauuuuccugccucagccuccugaguagcugggauuacaggcgcacaccaucacgcccggcuaauuuuuguauuuuuaguagagacuggguuucaccauguuggucaggcuggucucaaacucuugaccuggugauccgcccgucucaaccacccaaagugcugggauuacaggcguaagccaccgcgcccggcucccaucucuuaaaagaaaaaaauaauugacaaguugacuguaaaauuaaucuggaaaagaaacuaauaauaaccaaaaauauuguuuuuuaaaugagaguacaugagcugauauaguauaugacuuccaauaaaauaauaaucaugauggaguauuuacccuauuaaugucaacauauaacauauaguuuaauauaggauguugugguauugguccagcaaaauagaaaaguaugccauagaacagaagacagucuagaaacagauccuguaugauaaaugagcacaugaggccaggcgagguggcucauguccauaauuccagaacuuugggaggcugaugggggagaaucuccugaggccaggaguuugagaccagccugaacaacauagcaaaaacucaucucuaucucuacaaauaaaaauuaaaaagaaaaaaaagaaauuaguacaugguaaguguggcauuucggauuaaugguucaagaauggacugacuaggccgggcgcgguggcucacaccuguaaucccagcacuuugggaggccgaggcagguggaucacgaggucaggagaucgagaccauccuagcaaacacggugaaaccccaucucuacuaaaaauacaaaaaauuagccaagcgagguggugggcgccuguagucccagcuacuugggaggcugaggcaggagaauggcaugaacucgggaggcagagguugcagugagcugagaucgcgccacugcacuccagccugggcgacacagcgagacucugacucaaaaaaaaaaaaaagaauggacugacuguucgaggugacaguauuuggaaaacaacaaucacacacacacaauuccagaggaauuaaagaaaaaaaacuauucccacaagaagaacuucaaggagaaaacagagcuuuaggagaaaacccuccucucucuaaaaguagagaaggauuuuucaacuucagcacaacugacauuuuuggcuggugaaauucuuuguugugggaagcuuucccgugcgcuguaggauguuuagcagcacccucgcuuuuacucacuagauaaccaauagcagcaccauccuaguggaacaaacaaaaaauguuuacagacauugccaaauaaccccgagagcaaaaaucucugccauuuaagaaccacucggauugggaaugauagccacaaaauacaaacacacacauaacagacugauaaauuaaaaccuaaaauuuuaaacuuuguuucaacaaagaugccauauaguuaaaagacaagcaacaacuuaaaaaagcaauaagcagggaguaaauauuauaaacacauaugaauaacaaaagaucaaaauccagaacauauaaaauacuauuauaaaucaauaaggaaaagacaauccaauagaaagagauguuucucaaaagaggaaauacaaauggcugacaaucaugaagauguucaaucucaauaguaaucaggggaaugcaaauuaaaacagcaaagagaaaucacuuuuccauccaucagauuggcaaaaacaaaaaagaucgauaccauuaaaugaucaaaagagcauggugggccagacacgguggcucacgccuguaaucccaucacuucgggaggccaaggcaggcggaucacucgaguuuaggaguuugagaccagccuggcaaauacggugaaaccccgucucuacuaaaaauacaaaaauuagccaggcgugguagcgggugccuguaauaccagcuacucgggaggcugaggcaggagaaucgcuugaaccugggaggcagaggcugcagugagcugagaucacgccacugcacuccaaccugggcaacagagcaagacucugucucaaaaaaaaaaaaaaaagagagagagaauggaggaaauuauuauccaccguggguggcaguuuggcauuccuaaauccccauacucucccacccagcaauuccaccugcagguacccauccuugagaaaugcucucacaugggcucucacagaggugugugggaaggauguucuccgccauacugugucuaacaaugaaaaacuggaaacaaucuauggaaucuuacauaaccauggaauuuacagagcaaguagaaagaauagguagaucucuagguacugacaaagaaaaaauuccaagacccguuuuuaagcauaaaacgucaaguuguguaaugcauaaaacaugcauauuuguaaaaguuuaaagcgaaaucuuacaaacauauaucuuauacguacacauacuugucaaauaaaugcaaagaaaaauacacacaaacugacaacaguucuuauuuugugggaaagggacugguaaagaagguggagauggaaaaaaacaaaaucaaagaggaucugucuuccacacuccccacccucaccaccaagaacaucaagcuaagaaagaucuguguuuaaaauuuuuacauaauuuuguuacaaggcuuuaugcacggacuauaacuagaauauuuuaaaaauacauuuuuaaaacaagcucaacuugaccaaauuuaauccaucuuccccgcugcgccccaacccgcacuuccuaauuccuaugauuaacaaaaccuuucaauuccuucuauccuuggaacagaacuaagaaaauaaaguauaauuucaauuuuguguuuuugaggagaggguauauaaaggaguuugaauguuggaaucauaucaaaagcuuaucgggggauugguuuguuuguauuuuaaggagcagaugucaauuuuguaauaaauaaugauuaagguucuuaguuuugauccaucccagggaugugaaaagccaaagagguggcucccggcaaggcccagagcaggguguggucugggaggacagggaugguagcgaggguggcggcucacacgaauccaggagagaaaacagcagcuguugccgcgucgaacccgcagcgcccgaggagcuaccaggugccgcgggcggggccuccuuuuuagcugacugggacacgcagccucgaaggucugguagagucucccagggagaggguaagggggucgaaaggagaggcccaaggagggcgugggaggccgcgggcaggggugaggcccuccuugcgcaccugggugcugaaccgccccgccgugugcgacgggggcgagggggucacgccgaggggcggggagaggggcagggccaacucgcuccgggacagcgggggccccgcaaugucacccccguacacgguaauauccccccgcuccacgaccccucuuagucugcacuggaagcacccccugccccgcgcacaauccuggugcaaggcuucgccggcuucugagccucacuuaccugcugucucggacugggccgcacaccugcagcgggcucacguuaaagaccuggaaccugugcggccgccugcgcgcacccacccggauucacuagggccguaaccacuuccguu

SEQ ID NO: 192365 - RNA, 4894 nt, Homo sapiens
uaguuuuauaauauuuuauuaucaauaacaaacagcugcucuaaugugucuguccagcagcuguuaaagaguggaggacacccuugacccuaacaaggaaaacaaauuaagccuuuauguacaagcaaauuuagagcucuuuuaaguguccaaagcuauuaauuaguuuaauuaaggcauuaaacuaauucugaauuaacauuuuuauaaccaagaacuaaaauguucaaauuuuuuucuaguacaaaaaaauuaaauuugcuuuaguuauaaaagagcucugucaauauacacaaacuauauacuucagacauucacaaaaaugugagcagaaggcuuaucaaaagacauuuaauacaauuaguuuucaacaaccccuuggugguccacaucuacaaagauauccagcccaacccaaccccccuuccaaaucccacccccacagaaaagcacauacuuaccagaauuuuuagcaaguaugguuugggaauuuuugugguuuuuguuuuuuaaaaaaaggcccccagggcaaguuauuuacaguuuaauugccacugucaacugaucuggaccuugaucgggaccgggaccucuggcgauccacagaugcuggagacuuagaucuacuugaagaaccacguuucuggcucuucucaggcacgggagaccuacuaacagaacgggacuugcuccggcuccggcuccugcuccugcuucuugaccggcuguaagauuugcgacuacgggaacgggaucggcuacgagaccuagaggaacuucugguccgggaucgagaccugcuucuugaccuacuaugaaaaaugaaaagaaaucagccuagauaagacucuacaacaaacccauuaaauacaacuuuugacuuuaaaaaauuagagauaccugugccuuuugcugccuucaauuaauuuuauuuuucucccauuuauuuccuuuccagaaaguuuuucaauagcauucuuuaagucaccauaagaggcaaacucaaccacccuaaaauggaaaacagccacuuuuaaaguauauacauccuguagucucacacauugcacacagcagucuagguaagucguuucuauguucacuuuugcuauugcuacuauugagucuuauuucuggauaacacagcauuaaaagagcaaaguuuuggcacuguuauacuuugagccaauucauuguugaggggguucccuaugcaccgugggaugcuuagcaggaugccuagccccuacugacuacaugccaacagcauccucucucaaccaguugugacaaccaaacuugucuccagacacugccaaaggugugggggggaggagggaagcagcaaaauugucucuggagaaucucugcauucuaacauauucaaauuuuaaguccucaaaacuaaguucacaguaaaauuuuccggauauuuuuaaagacuuucacaguuuccaguacauacccuucauuuaauuuaggucggugugcauccgcaaacguuacuuccccagcuugucucaugaaaucuuugagauccuuaacacaagauaauuguguuaagcaaagaagaggaaaggggacacacaaacaaucacaugauauaaaaaaaacaagacuacugaaagagaagauguuagauaaaguacaaacauggcauuuaccacacuuguauucuaucagaauucaaaaauuaucuaugucagggcacggaauaagcaaauagcauauugcuuuuaagcaaaaugcuaaaagaaauucagauuuuaacauuaagguaguauuagucuaugcugagcucaguacaaaagaaaaaaaaacaaacaaaaaaacaacaaaaaaggaaacaguacauauuuuuaaaguaaagacuaaaguagagaaguuuuauuuaaaaaaacagaacauuuacaagacaccaguuauuuugugccccauaugucauuaaaaaaguuuacuuuaccuuuauuauuauuucccuaggcuagucaagcagcaaaccauuaaucggucggagaaaccuucaugacauaugcccgacuggcucuucgccacccacuugaaggacacuacccaaucgauggaagccuuuaaucgcacagcccucccuauuagcggacuauuggcggaugcagacauguucuacucgagcaguuaccaaggaccacuuuacugcgaucaggauuccaacgaccaccuaauuucguaucuuucaacucuuuucgaccggaccucuuauucggaagcguuacaggaagacaggucucaacuuagggaucagaucacguuaucaacgcucugggaucgcugcaaccuggcacuucaaggaagugcaccgauaacgucuagaccggcaaacacagaucuagagguggccaacugaucacuguaggagcugacuggcaaagucaaccaggcccaaccaagagugaccaagacaacgauuaggauaacccacaggcacuccucgucauaaggccaacgacacagacaggcuggcaaauaaaggguuuaauauuugguuaaaaauugauuuuaaaaaacaagaaaaauauccucaaaacauuuacauuugaucacuaauauuaaaguucaaaauaucccccaaauuacauuuaauuaaauguuuaaaauuacaauuccauuaaauccauuaauuuaaaacuacuuuuaauaaaacaauacaacauuagcuacccauuaacuuuuuuaaaaagccacaucaaaauaacucaaaacuguauuucaacaaaccugccagcugacucuugaggauaaauucucaacuauaagacgauuuucuguucuuacagguggagcauuucugaggaagaaaauucguauucacaauggaagaaaugcaaugacagcacuuguguucaacugugggcaaguucaagccaucagauaucacaagccauucuaaugacuuccgucaauagauuuguguucuaugacucauauagauucaucaagaacaacuggcuaacgugggaauagaagaacagauuauacggcaggacccaaaaucaucacugcuaaugacuccugaaucuuaaaugcuaccccuacaauaauuguucaaugcagccauccacccuucacauaccgucuaucauuucgaggucugcgacuacuaaaacggucagaguaucguccucuaccucuuccaccucgugaccgagcccuagcauguucaauaguaacccuacaaaaagggaagaaaaaucuccguuacacacuuaagcuacauaaaucuacuuagaaaaauaugccagcagacccagucugcucuaugucccaggguuaucuaguuacacaggaaucucaccuuucacuacagaguucuuuuccaucaagcucauacacagcaucaucugcaucccuuggauccucaaauuccuaaaauguaagcauaagacucuuaacauuggcuuuagaagaguauucuacaacacauuaagagcacugaaaucaggagacagaaugggaagaguaucuuaacgacacugccauacagucaaaccuaaucaaggagccacugggagugggguuccagugagccggcaaguuaaaguuguuuucagccucaauaaaauucagacauaaggcuggguaacauuuucugaaggcaaauauuccacccggacucaagaucgaaaacaacugcuuaucaaaacucuaccuacuuagcagauaauucacccaguucuaaauacuuaccacaaaaccaaagccucuuuucagaucaauaucucuuauccguccauaucccuugaagaaucuuuccacguccuucucccuggccgcuggauuuagucucccgaugaauacccgacagccacucaugauguccggcuaguacuuccuauuagaaaguaauucaaucgagauaauagcaaugacugucacagagaaacgccugauuaaacaaucaaaaacaucaacggcauaaaauguuuacacagugauguuaugaacgagauugccaacagagccucuaaugaggccagguuaccugcagacaaaaugaaaacccagcucccucccaacacgguccgcuacugggcccagaccgcagcaaccgcaacgcccacugccaccuuuccaacugcgcagccgcacacucuccgggcucuccggcccccucccaucugccgcaguuaggaaaggccgagaagugcgggcggagccgcccgcgcccuccgcaaagccagcccaauggcggccucgcgggcgcgucacagcggguggaagccagaaucucgcgacgccucgaccgcgccugcgccaacagcagcgggcgggcgcucugcggccacaaaauggcggcgguggaaucaaaggcagcagagcugcgcgugccaaauucccucuucccuucuccucccagcaacccccuucucgggggucacugcggccgcccuacaaaaggcccagccgcaucgccagcaaagucagggagaucccggcccacuauucuacguguccaggagaugaagacauuaagacuggcagggacgggcgcacaaccgcuguguaaaaacgacccgaacagugaccgcccuuucaccucaguaccccucaaacaguaugccaaaagggagacgugccccagcgcccaccucgaaucaacugcgcucauuagacgccauccuccgcaaagagagcagccccggccgcucacgaucugagcggccaugaagaagccucgauccgagaaggcuugcccucaaagugagccacucaccuaccggacggggucuuuggcggcugagacccagacagguccguagucugcgacggagucgucgaccuccacgcagaccaggacuuaacucgucuacgccacuccacaacugacgcacuuagcagcucuggcgcuccacaaaau

SEQ ID NO: 192366 - RNA, 21455 nt, Homo sapiens
agguuagaacuucugaaguuuaauucuacagcacuugugagcauuuauuucucuuuugggucacaaaacuuggaaugggauuuggguauuugaguaauggguuaaacauauauauugauuaguucaggaauugagugacuuuaagaugcuuaucagacacuuuuagagaucccagcaagaggcagauucgguuucugguuucauagaguuuacagucacugaacaagucuuuaaaauaaguagcaaauucuaaguuggggauaggugaggcuucuuggguagacacccugucuguguucccggccaagacuugaugauucugauagauguacuggaaaugcuggagaaagacucaggcaagacugguguuuuugcugcucucucuaguuuaccacacuggcuuucagaauugcuuugggaccagaauccaggccaccaggggaagggcuaggcugugcaaggggagcaguccuccccuuuguaggugccauuucccagagcuccuggaauuguuucuucaguuguggcagcuguguagaucauuuuuguuuuaucuguaaaguuaaaaaggguuacagguguagagagagaacaagaggagugaacaaugaagcuuguuuaaucuggaaaguacaaaaauaccaacucagcccuagagugugcuaaguauauauuuuccaucucugucgucucucccaugguuuacucuuuaaacucacuuuccccucagucucccuaaugguaguacuaguaguaaaaguccuaaugaauuagacuauugugucuucaucaucacuucacuucuaacuucguuauacaguaaaacaacaggagaugaguuuauguaugcaaggucuguguugcauucagggaaugaggaggcaggcaggaaagaucuucgagaaagucuaaccaagagaguuuccaguucuucccuccaacccccaauugaucuaccucuucuuguccgugguguaggcggugaugcaaauuugaagauagcuuugauuccugcaccuuucuauacagaugggagaguucucuauacagaguuguucucccaucaggugcaggaaugaaaaguauaaaaacuugacagauuccuccccccugagaauagcuucuuggggccauuagguccaaagaaauacguugcuuugauuuaguguuuccacuggggucuucugagauacacugugaggaaaguucuuuucaagucuugagagcuaaagauccauagaguauuguccuuugaggucacuucaggucuuucugguacuaaaaccucaaaucugggaauuugguuggucuagaaacuucugugcacuuuuuguaagagggcagcaaaucucuugcguuccucucagauaagcaucagaguagauucuuucucacaacucuacuguagcuuugaaccaaagcuucuaaaaugguucuaguguauggucagccuguacuuguuucguguuggcugcuuggcaaccuaauuacaucuuagcuaauugcaaagggagagagaaucggcauuugcuugcuaguauaauguaacaaauuccaauagggaaaguuguguauuucuccuaggguguaaaucacagucccuagggucuagaaagguuuugaaggggacuucaauucauggacaugaagggacaguugaaggauuuggguagguacuuaggaagaauauacuaauguugagaguuauaaugaaauguguuauaaaguggguuugaauguccuguuuuuuuuuuuuuuuuuuuuuuuuuuuaaaauugguguuaaagugcacuuugaggaaggcacucuguucucuggucugucuugagguucaauuuuauuuugaaagguaauacucugagcauuuuagagaagagaugcuauguuaaccccauagugaucagaguaaaguauaaaucauauuaaguuuauuguggagguaguuacuguuuaacaaccguaugcuuaaguuuccuuuacugcguaacuagaguugaggaaucuuuuuuuuuuuucuuuauucuggguuauauuagggugcauugcuuucauauguuuuuccucauacggaggugccaguggugcuguggcucugaucugguuccaggaaaugagaaccuaguccugagaaauggaaacuuccccaacucuugcgaauagaggccuuucacacaacuaauaaccucaguuguccaaggcaguuuuguccuaugaugucuccccacugagacaaagcagcccaaauugcuucaguuuuaugagguaaacugcaucugcaauuucauucucccagcuagaaggaagaaauggagugcaguugauggaaguagucuuggaucuuuaaugcuucuugggugcuucuuggggcuaccugguucuuagugacuugauaagaguuaaagcccuauccaaaaagucccugcuagaaacuugcuuguuggcaggcucaggucuaauauuggagcagaacuugaaguggggauaauuucaguacucacccuugggagucuugaauuucucauagcaccaaaauauggcaaugaggagaagcccuucuccaagcuggaaaaucauguagaggaggggaaagaagaaaagugguccaaugacuucagguggaaaggccacauugaggaugguggaacagaguuggacauuuuggcauccagucuccaugcugacagugcgucugcaccugugccggugaagaaaaccccacauacacucagagggaacuggagggagcaacuuugucccagugcugcuaccaaagaguuucgcagcagauggaaucuagacccuggacagggguacuuugcuauugcugcugguguuuggauaccuuuggugucuggauuuuuaacccguucaauaccuucauucaauuuuuuucaagucuaaagucucuuguccaguuagugcaucugaacauauugccaggaaagugucuugcccagauuucagguuccuagcuucuuauucguuuccugaaagacuaggacaagaaugaagcccaugggacagugggaccuaaaauaauaccuaucuccaggcaugcaguggcucacaccuguaauccuagcacuuuggaaggcugaggcagguggaucacuugagcucauuaguucaaaacuagccugggcaacaugguaaaacccugucuccagaaaaguuaaaucagcuggucaugguggcuugugccuauagucccaguuacuuggggggcugaggcaggaggaucaguuaaacccuggagguugaggcugcagugagcugagaaugugcuacuccccuccagccugggcaacagagugagacccuuucuuaaaaaaaaaaaaaauaccuaccguccauugaggcagaagagagcagagagaacauaacccagcagaaagccaauaaaaggcaucagggaggagguggcaaucaagaguggugucauggcaaacaugaugcucuuccccacauugauggcagagagaacugugacggccacacugcacaagagaaugaugaucaucccucccugggaaugaagacaagaaaaggcaauuagaagaguuggggauagagaggaacagagguggggaagcacagguagaaauuggaggugggaaacauugcaauaaaacacuggaaguggaaaggaauaugaaagaccuuuaucuucuuuuuggauuccuuucuuuaaauuuuuuuaaaauuauuaacauuagagacagggucuuacuauguugcccaggcuggucuuacuccuggacucuuagcgguccuccugccuuggccuuccaaagugcugggauuacaggugugagccacugcacccagcccaucuuuuuagauuucguaucaguagcuaggaagcuuggggacagcugauuaacacuuugauuauuacaaacucagccaagcacaguuacugcuuuugacacaucucuggauagcagacuuucagugaaguguuacgugaggcuauucaggacuccugcaaaauggauauuauuuaaaagucaaguauuuuuggaacuuauauacacauuccuacaauacugucauuguuccacauacuuugaaacucaugagaacuugucauacauauuugucucaaauaccuugauuacagauagggauuuuauccauuuuaggaucaauucuggaaauugccaagagucauuugaaacaaagcugguaaacaagguggaugaucaagcccggaaauacgguuuuaaacccaaaaugaugucuaauaauaaggggacaaaccuacuuucuugagugaccugcaaauugaauaugaaggaaguucccaaaagaacuuucagaaauaucuugggugauaacaacaucauuggaaacuaugcaggucuacucugaaugaaauuauaggguuuuucauugugcaacauaggaugcaaccuuucaaagugcaugugcacuccaugcacuuuguacuuuccagugugcauuuuagagaauugcguccuccaaaaugauaaacagguauguguaaauuuaagacugucccuuuuaucuccugaguaaagaaauacuuaacuuuucucaaacuuaccauguuauuuuguaauaguuacauguguugguucauuuuuugguucauucacauguguugcauuuuauauuuccuaguaacauuuuaaaaaaguaaaauauguauagcaaaguuugccauuuuaaucacuuuugaguguacaguucaguggcauuaaguacauucauaauguccuaacgacauuuuaacauuuauauugcucaaauuucagcugcacagcuuuguguuucuguuuuuaauacuuguugcaacugauaugaucauauaaaacaucaccuauaccaauuagugguccuaucccagcauaggaaggacuuucacacaucucuugaauaaccaugugcuucaaguuuuauuaaaagacuuauuagcuaaugaacuucucaguuuaccuuugcauuuuuaguugauuuccccuuuuagauuucugucuuucgaauuuguccuuuacccaacagucaaauaauuuuuaaucucuaucaagaguggaguggauaauguaggagacauugaguuacaggaauuguccacgaauccagaagcccucuucuucuguauaggcauucacucuuauucucucacucauguucucugacucuuggggacugcacaguugugguuaugagcacauaauuugauaugauccuggugggaaagcugccucugcuagucuccagguguguaagcucuggggagucacucaaccugagugagguugacggcauaggaccuggcauauaagaaccgcucacuaaacuguaacuccuguuauuacucaaaggggaggaauuaacauucuagagguuccugucacucucacugcugccaucucuggaaauuuauccugucuacaaccccugucuccugcugagacaaguggccccggguaguugcuucuccauaggcuaccacauuuuguaccaccugacuucauugcccugcucacaacugggaugagugcucauucaugggcagccaauccauuggcuuacacaugagaugacauguccacagucuacccacaaagguggcccgcacaggcuggugagugguagaaauaaucagauucucucauuuaggaaguuugcaggauuacagagagggaagcaauagcagggacaagugucagaacagaggucugggagcaauagccacaaguuggcagaaguuguaagacaaaggagaguuaggggucaguucagcaguagcagcaggugugggaaaugcaugaguagaguguugagucaaugaaauggugggauccuuauuaaagagugguggauggcuuauggugaaaguggcuccuggaccaugucauucucagauucaucacccuuuuagccacauagccuuuggauaaacccuugcauggguaaguuaaaaauuacuugaauugccuuuuaaaaugagcaugccugaaauuguaucuugguauaucuaaaugugaccuuccaccagcgaaugcaacugguugaacccggugugagcagauaccugcugccagagcuaguuauugaaaguuggguuauuuugauuugcaagguccaaggaggguuaugugugcguaagaggcuaggacaaucauuuguucguuuuccaguuuggcacucacuauauuauuuaugggacagggugacgaaggaugagcauaguccucgaagagccauagaagcaaggaaaccuuagcuuuugcagcuugacccacauguuagucucugcauccucacaggagugauuccaguuuuggaauauaggaagaucaguguagcuguugacuuuguggugguuuaacccuggagguuuagccaggggcaaaauggguccagggcaugccuggguuuuuuagauuaccuuuuauguagucccuuauuacuagucucuguuuuuccagccaagguauuucuuagcccuuuuaauguucucuggcuucauuuugacuucauuucgucuguggcauugaguagugaaugugcaacacaacaggaacagacugguugaaauaauccuggcucugccaaguaacuuuuccgggccucgguuacucuaucugcaaauugggaauaaggcaggagacugaacuucaucuuaaaggcuucuccagcuuuaagaucugagauucucggcaaggugugguggcucacgccuguaaucccagcacuucgggaggccaaggcggggagaucacaaggucgggagaucgggaccauccuggcuaacacggugaaaccccgucuuuacuaaaaaauacaaaaaauuauccggguaugguggcgggcgccuguagucccagcuacucaggaggcugaggcaggagaauggugugaacucgggagguggagcuugcagugagccgagcucgcgccacugcacuccaaccugggcgacagagugagacuccgucucgaaaaaaaaaaaaaaaaagggucugagauucugcuuuuugcaaccucagagaaacacuuuuaaagcuacucugagguagaaaagagacauguucucacaucaguugucauuagcacuaugacuugguauucuguuucccaguuuucccaccuauaaaauggaggagggcagaguagcauuaaaugauagcaguggucacuucacauuuuaauauucuuuauauuuuauaugcauuucuuuaagaucguuuauggguguauaggauuuuuuaaaaaagcaaucuuaugcaccccacaaacuaucuuaaaaaaaugaaaugaugcacacaaacauguuucucuguguauguuguuuuucugcugguguguggaagagcagcagacaggacuugcccuucauuccuuuauuuauucucaggcauuagcuaugggggcacugugauaggugcuguggauucaguguuaauuaagacagccuuauggucuugcuucuugauaaaugaguggggaauaaaaaugaacagauguucuuaaugcaguguaauaauugcuacagggguuagcuggaguguuggguguuaugggagugaauaggacaagcaucuuacucaggcuuaggagguuaaggaaggcuuccugggggaggcgcuauuuguguugagacuuaaaggaugagugggagugauccagugaaagauggugaguggggugagaauugggaagaagaguguuccaggugaagagaagggcacgugcaaagagaaaagagcugagacuggugaggucaguugaaaccaaaucaagaagugccacauuaaggaguuuaaacuauccuagggggaaggagucaaugagaggcuuuaagcaguggagugacaugauagaguuuguacuucacaucuucacccucagguuagaacugggugaggagguuggaugagaaggccauuugaguugucuagugagagguaaggauagagaggaaugaauggauuccagcaacagaagguggaaucgacagucauugauuagaugggugugaguggugagggagaagggaacauugagaaugacuuccaguuucugguuggggcaacugggcacacacacagugccaccgacugagauaaccacauggggaggagaugacuuuaacauauauugaguuuuaaaugucugagguauauucagauagaaagaccugguagauaauaaauggauucuggagugaggauagaguugacaucugaugaugcuguucuggaagucucgguuugcagaugguaauugcagaccugagagggaccagauccugugcugggagaggucuggugagaaaggcagaaagcuuggucugaaugcagagaagugccuuugaccagaggaacucauaagggagucugaaggucaugagagguaggaggaaagcagcagagcuuagagucacuaaagcugacagagaaggcuuuugaggaggcaguggucaauuauguccaaugcugcuagaaggucaaggaaggauugagaaauguccauuggauuuggcaaagaaaguggagcagguggucaucaagaugcuggguggaugggagaccaaggagagaagagagggauucaaauaauggaaacgaauugcugagggccuggucacucaugagagagcucuggcgguggcaugggggaaauggaagguguuugagaggaagcgauugacagagagagagaggagugagggggacuacuccuaaaaccuggcuaggaaggagagcaaagggagauauuagguggaaugggagguggauuccacaaaaaaucccagugagagacacuuuuuguuuuguuuuuugaagauagaagauaugugaguucguaucaaagcugauugugaagaaccaauacagagauauuuuagaaaugagagagaggggaggcugcugggccaggggcauaaucaauaaaaggaggucucuugaguacaaggguagagagaaugauugcaauccagggcugagguggggugacuggccacagaaaggaggagggaugauuccuccauguccuccagcaggcgggaaggggagcuguggccauggcacugggacaggacaagggcaaaaacuacucuugagacaaugguagugugaaaauaaaaccccccugaaaacuggacucuugacuucuuuguuccaggcccaaagcugcugccaaacuuugggguucucagcagcacgccuugcagaccaggccagaggcauugauccaggggcagagaugguacaggaggucaggaggucaaguccuuccugaggaccaggaugaccuccuggcccugggggaugaauagugagccaagggggaggcuggcagggaccaaacuccaagguugaaaauauugguggagagaccauagcugcacucuaggaguucugcacacaaagcaguggcaugaugcccugucugugaccacagugcuucucaaaaccuuuguggccuuaauucacuccacuucccaccccaucccucucuugaaaugcugggaauggguacacuaccugucuccucuagcuucuugccacaucagccaaauuugcccuuagugccugcugaacucuauucaggcuucuccccagguuuaccuaaaugccucaagcccuuccuuuuuaauaaggcucuuugaccacuccagcccucacuguucccaucuccuugccuucugcaaauacuugcguguacacuggaauuggaucuuguuucucucguguguuacuucauuuucuuucuuuucuuuuuuuuuuuuuuuucguuuuagagauggagucuugcucuguggcccaggcgggagugcaguggcgcgaucucggcucacugcaaccccugcccucccugguucaagcgauucugcugccucagccuccugaguagcugggauugcaggcacucgcuaccaugcccggcuaauuuuuuuuuuuuuuuuguauuuuuaauggagacgggguuucgucauguuggucaggcuggucucaaacuucugaccucaagugauccacccgccucaacuucccaaaguguugggauuauaagcgugagccaccacgccagccucauguguuacuucacuuucugcaaauaucaaacucuggugacagugaauccuuagagugcauagcauaaaacuuagcaucuaguaggagcauauguauguuuauuauuaauauaaugauuauaucuuauaguuguauaugguguuuuuacucuuuugcccuaauuugucaagccucccagguucuuaccuugaugacauagcgcauguauuguggccguuuggauuugaggacgaucccuauggugcaaggaaugagaaccaggaccagugauaucacgaugccuuuauagggcaccuuguccuucagguccccaucauagaucccccuggaguagauguacaggaggagaggcaucaugccaagggcacagaagguggagcagguggucaucacaaugcuggugggagacaugggaagaggggagagagagagagcccauaaauacagacuauuuuguugagugccugcuaagugccacugugcuaagugcuugacauauguggcuucaguuccuuuuccccauaacauuaggcaguaagcauacuaucuucuuuucgcugacaaggaagcuggggacuagaagaguuguguccugcucaaagucgcacaagguaguaaguggccaaggcagcauuugaacuuagggugguucaacugcuucaaucccugugugcuucauuguggaaggagccauucugaucuccuucucuguaauggaacccuuuucgcauugagcaccucccccaugccaagcccauuuuguagaaagccaacugugugauuccauuacucuggucauuagcccauuggaccauggaauggcaccugacccacaguuacuaaaugucugguuuagagccuagggaauggcuucuuguagugacuuuguccaacggagacaauaacaauuagcuauaucagcacauuuuaccucguggggagucugagugugagacacagugacaggacacuuggucuuuggggauggguggcaugggagugaugcucaggcagaagucaaaaacccuacuagaaaaaucaauaaacagauaccaugauuaaaaggacuguaaaagaaauagugaagcaguaagaaacagaauaauugaagggccauaauggugggguaguagagaaggcaguaauagauacccauguugaguaagugacaagauaaccuggucagauuugcuuugcaucuuggauaguauuccaguccccaacucugguguucucauguucuuuacuuucugguuccucuugauauuauuuaaaauaaauuaugacacucagagccugaauaauauguccuuccagcucuaauauguauccuacuuguccaauuuccuuuuccauuuggaaucuuauauauguuagucccaggacccugucuagggagaggcccuccagaaaggucaacugagaaggaagcugauagggcaucuccuuagauuuauggacauuuacauuaacaauauauggcucugacuuuuauuccagugggaagaugguugggaggugagggcuuggcaagaucuuaggaaaaccacacucagugugucccuccuccuccccacagcccuacccuccaucuacacuucuuucauuauuucuauaaagauggaauauggcuuaaauaugcaugaagagcagccuauaucaaagguuccagagcguagccaucaagaacaauagguaggcaugucauaaggauaagagcuguuagaggugagaagagucccucaaagaaaauugugaacuagguaauaggaacucccccacccccgugaacacuuaaauacacacuugagcuuguaagaaauuaacacucaauuuaaguguggcauaguggcucaugccuauaauuccagcauuuagggaggccgaggagggaggauugcuugaagccaggaguuugagaccagccugggcaacaaaguaagaccccugucucuacacacaaacaaaugaacaaacaaaccaaaaaccacacacaaaaauuagccaggugugguggugugcaccaggagucccagcuacuugggaggcugaggcaggaggauggcuugagcccagaagguugagguuacagugagcuauguuagcgccacuccacuaaaaaaaaaggugcccacggacaagaaacaaaugcaaaguagugggggaacucaagcugaagcuucauagagggguucuggaggggagugggguguuagucuuggcacuguggaggcuuuaaugcccaaggaagggaccagaauugagguauuagaccugggaugggaggagcauugaaacugagcaaccaauaaaaggaucaugggaugaggggaggggaacuuucuaauuauaucaucaaauaugaaaucaugguggaaacaguauuuagaauauaaaaauaauaaaauacauauuuaaaaaacauggagaggggacuuuggauuaggcaaugguuucuuagacaucuaaagcacgaacagccaaagaaaaaggcaagucagacuucauuaauauuaaaaacuugugauucaaaggacaccaucaagaaagugaaaagccaacaagagaaugggaggaaauauuugcaagucauauaucugauaagggucuaauauucagaauauauaugaagaacucuuuuuuuuuuuuuuugagauggagucuugcucugucgcccaggcuggagugcaguggcgcagucucggcucacugcaagcuccgccuccuggguucacgcuauucuucugucucagccucccgaguagcugggacuacaggcgccugccaccacgcccggcuaauuuuuuuuguauuuuuaguagagaugggguuucaccguguuagccaggauagucucgaucuccugaccucgugauccacccgccugggccucccaaagugcugggauuacaggcgugagccaccgcgcccggccaauauaugaagaacucuuauaaugcaauaauaaaaaacaaguaaaaaaugggccaaggauuugaaugagauauuuucccaaagaagauauacaaauggcuaaugagcacaugaaaagaugcucaacaucauuacuuauuaggaaaaugcaaaucaaaaccacuuugagauaccacuuuauaucuacuagcauggcuauaauuaaaaagcuggacaauaacaaguguuggaggguauauggaaaauuaggaauccucauacacugguggugggaaguaaaauggugcuuuggaaaauaguuuggcaguuucuagaaaauuuaaacacagagucaccauauaacccagcaauucuacucuuagguauauaucccaagggaacagaaagcauguucacacaaaaacuugccugugagcuuccauagacauuauucauacuagggaacaaguagaaacaacccauguguccaucagcugaaugaauggaugagcaaaauguauuauauccauacaaugggauauuauucaauuacaaaaacaaaugaaguauugugacaugcuaucacaugaaugaaccuugaaaauaugcuaagugaaagaaguauagauacaaaaggucacauauugaaugcuuccauuuaugugaaauccauagagacagaaagauuagugguugucaaggguuggagcaggagagagaaauggggacuccugcuaaaugggauggaguuccuuuuugggguauugaaaauguucugaaauuagauaauggugauagguucacaggcuuggaauuaugcuaaaaaccaaggcaucguacaauuuaaagaauggauuuuaugguaugugaauuauaucucaauaaauaguaauuaaaaaccaugcagggagcaaauaaagcaauuauuaaagggcaauuuauagccuaacauauuuauauugaaaaagaagauuaaaaauuaaugaguuaagcaccuuaagagguuagaaugagaaaaacccaauaaaaagaaaaggaagaaauuuuuuaaguuuuguaaauuguuagaaucaguaaaaccaaaaauaggguuuuuuuuuuuucuuuuuuuuuuuaaaggccaauuaaauaggcaccucuggcaaggcagaccagggaaaagagagauggcacaaauugaugagguuagugugaaaaagggaacauaacuacagagaaaaugaagauuuuaaaaagucauuaaggacauuuucauacuuucauuuuuaacuuaaauggacaauuucaugggaaauauaaccuacaaaaccaagucaauaugaagccgaaaaccugauucaacuuagaaucauuuaagacauuuaauaagcaguucaaaaccuaucuucuagaacccuacaugauuuauacugucuuacgguaguguucuacuaaacaugcaaagugcagauuguugcaauauuaugcaaaucuguccagauaauauaaaaaggggaaacaugcccuaauuuauuguauaaaguuaauaugaucuuggaacgaaagcuggagaaugauauuacgagaaaagaaaauuggggaccacucuuauuuaugaacauagaaacaaaaauaauaaaauauuagcaaauaaguguuuuaaaaaauacaaugaacaagaugaguaagaaugauuuaacauuagauaaucuauuaauacauauuacuauauuauuaaagaaaugguacaauuuuguagcuauagaaaagucaacaaaauuuaauguucuuacauaauaaaaauuuaguacacuagcaacggaaugaaaauuccuuaacuugaaaggaaaucuauuagaaaaaguauauuaaacguuaaacuuaaugguaaauagagggauuuucuuuaacaagaggaauaaagcaaagauagucauuauuauuaccuguuuuauaaauuauacuauauauaggcccuaguaagcacagcaaaacaagaaauagaaaaaguauagggaugggaaaagaagaaaugaaacuuucuuguuuugccaaugauaggauuguccacagaagaaaucuaaguaauuuuccauuauaacugguaaguaagaaaauguaugagguucuaaauacauuagcaucagucagucaaucaauugggucugauauacuagaaacaaauauauauauauuuuaaaagacaccauuuaugauauucacaaaacuagaaaauacuuauacaucuaaaggacauguaagaucuuuaugaaagaaauuacaaaccuuuauagaaagguauuaaaaaaggccuaaguaaaagaaaagcuauaucauauuuauagaugggaagauucaauauuauaaagauagucucucaauuuauauauaaauguaaugcacauuuaauaaaacuuccagacuuauaauuuuuuuuguagacuugaaaggugauacugaaacucaagugaaagaguaaaaggcuaagaauagcuaacaugauuuuuuuuuuuuuugagacagagucucgcucugucacccagguuggagugcaguggugugaucuuggcucacugcaagcucugccucccggguucacgccauucuccugccucagccucucaaguagcugggacuacaggcgcccgccaccacgcccagcuaauuuuuuguauuuuuaggagagacgggguuucaccguguuagccaggaugguuucgaucuccugaccucgugaucggccagccuugaccucccaaagugcugggauuacaggcgugagccacugugcccggcccaugauuuucaagaacaaaguagggggacuuaacuuucagauaacaaaacuuauaaaauuguaauuaagaaaguguggaacugguacaaggguagccacauagacccguagaagagaagagagauccagacacaagcccugcauuuaugagagagaugucauuacaaauaccuggagaaaaauucacucaacguggcuuggaaucuucuauuuguauggaaaagauaaaauuaguucaugccauacauaaaaauaaguucuacauugauuggagcucuccaugugaaaaucaaacauuuaaaacuuuucaaagaaaauacaggguaauaucuuuguaacuuuguagacaguaaauuuuuuuuuuuuuuuugagacaggguguugcucugucgcccaggcuggagugcaguggcaugauuuuggcucacugcaaccucugccuccuggguucaagugauucucaugccucagccuccugaguagcugggauuacaggugcacaucaccaugcccagcuaauuuuuuuguauuuuuuaguagagacgggguuuugccauguuggacaggcuuguagauaguaaaagauuucuuaaagaaaccccuaaaaaacauaaaccacaaaggaaaaauauuggcaaauuugacuaaauuaacauaagcaaucuaucagacauuauuaucaaaguguaaagaccagcuccaaacugugaauagacuguugcaacauauauaaaacaauaacuuuagaaauuaauuuucaaaacccacccaaaccacaaucccauagaaaaacaggcaaaggacccaauguuuccagaagaggacacaugaauggccaacgcacacguggaaaugugguaggccucccaugaaaucaaauuuaaaacuacugcgaucugcuucacuguuuucauuuggaaaaaauuaaaaagucugacaauuccaaauauagaugaaggcacagagaaacagggaucuucagacacugcuagggaacgugugaagugaacaaugaccuuggagaccucuuaaagaugugugacucccacgacccagcaguccugcuucaauugcauaugcccucaugugggcagagggacacacacaagucuguucacagaagcgagacguaaaauccacaugaaucugacaacaggagaauggauaaaugcaagcaaacugcacagcaguucagauacaugagguagcuauuuucuuuacaugccuauuucucaaaaaaaaaaaaaaaaagcaagcuguuaggugauguggacaguauaauacuguucguacaaaauuaaaagacguaaaucccgcagucuaucuuguuuaugaauauauacguauauaauaguugaaaagggucgguggaaaugcugaacaccaaauucccagggaugcucccuuuggcaagugguggaggguaaugagauugggaauaggaauacaggggguuucaaugcuacuguugaucuucucuuagggaaaagccaaacacaacuuguguguuuguucuggugaccuagagcagaggaaucaugcuuacuuuggcuugugugucaggaguuuuggaguuuggacuuggugugccuugucagcuuggguaugcaggagccauguucccugauccccagguacuuccuccacuugcacagguccuggggucaggucagggacauccaucuccuagccugcuggcauccgugacuguugugauccuugguuuaccccaagggacagggacgggcaaggacuuuuucagacucuagauuccugagauuguaggccugguugccuuucagggggaaaggggcacauuuguuuuuuuuauuuuucccuccugcuuaaguuccaagagcacagcauagaccuugcuuuuggacaucuguguaccccauuuaagggacucguucgaguguccgucaaugcacagauuggaggcagaagcugagggagcugugaggggccucaacacagucucuaugaaguggaaaacuucugggaccccaguggcuuccaucuuguccugguugagcuuccuacaucauggcugggagaccuguggaagugcuuggguuguguccaagcccauuguccccauggccauuggcucugggcucugcugugaguccgaugguggcagggggagcagaugaacuuggggcagcaaggauggucaaaagaggccaguuccugcuggcauagcacucucuucucugugccugacaagccauacucacuucaacugugagggcguuuucucuugccuguuugucaccuacauuuuuugaaacuugucuaguggccuuccuugaggagggagcugccgucccuggcugcauugaggggucugcuugguggccuggccuccugggauggcaggcuguccccagacugacuccaccuaugaggcagagugaguggagggagacacaguuucccacaaacucugggaaaccucuggcaagucucugaccucagccucuucauguguaaaaugggaucugugucuuacaauuccuuccaguucuaaaugggauguagaguauugugcuuaucucaaacuggggccuuugggcuacagcuggcccuuugacauguauuguuugguuugcacauuuaaaaaaauggaaugaguugcugauuucacauaaaauggauauuuuaccuucuuuugaaaagugggaagcucuggcucccacacaauacuugcugcugagacacgggugucugcccaugccuuugaggcugucuggccauuuuguuuguggaaaugcugaccuggaagauauuucaguaaaagcacagguuccggagccacccagaccuggagccaauguauugaccucucuaagauucaguuuccuuaccucuaaaugcuacuuguuacaugcugucccccagggugcuguaggaggaucacauauacuuauccagguaagguguuuagcacugugccuggcuguuucuuauaaucguugucauuauuauaaugcauguaacaaguugucccaaauuggaaugggauuugaagucuggcagcacaugaagguagaugaccagauucccauuccgacagugggaucugagacaugguuuaaugugcaugggaggguuguuuguugggaaggaguuuuauggcagaagguggcugucccagcagagcuuaucucuugugggggucuagguaaaaaugacagucaucaggggucuggacaaggagguugagcaggagagcaugaggggucauguucuugagucaccagaggcucugccuggguggggccuagagccacagcaauguaggcauuguggcagaggccucaauaguggccacuggcgauggggcugggacaucuggccacucacacuuaaaagcacaguugccuuccacguccccugcucugcuucuuccacagaaacacaaagcccucagaguaccccuucgcaggccccugacuucugcaucccucauacaccaaaauucagauauacucuaggauucuugggacacacaggcugccaugagccuuguccagaagccagauccaagaccaagggcuugcuuuguagcagagaggauguggauuagacagaggaaagcauuuucucacagugagguaguugaacauugaaauaccuuuccgugggugauggcacaagccaaaugcccucuuugugccucucuucccauugacuacuaaagugagggcugaaucauauggaaaaagagcccagagcuucucagauggcagauccuguuaaaccccaacucucauucacucucacuuuuuuauuuccuuuuuuuuuuuuuuuuugagagagagacagggucucacucuguugcccaggcuggagugcaguggugugaucaugacucacuguagccuugaacucguaggcucaaagauccucucaucucagccucccaaguagcugggacuacaggcaugugccacuaugccuggcuaauuaaauauauauguauauauuuguagacacaggguuuugcuauguugcccagguuggucuuaaacuccuggucucaagugaucuuccugccuuggccucccaaagugcugggauuauaggugugagccaccgugcccagccauucucacuuuuuucauuuaaaaaaucugucccagugucauuuugcaucacuaggaggggcuucuugacuggguuaguuuuccuaggaaaguuuggcuaggaguagggugcugacagacacaagcagauggacuuucuggguucugcugcuauaccuggcauugaauagcgucuccacggaggacuaaaccaggggggacuggcuugagacugagguuucacugaaagcaagagcuucugcuagugaguuuucuuuagcuucagcacaggcugcuggagcuggagcaggucugaaguagcuccucuggcagauguucaagacuagagucuccccaguuuggaaggaugagcaucaaccagccccugugugcugcgucuccaggagcgagcccuugcugauuucugcuuauaaugcuuugggcaggggguuagggggugcugcugucuuccccuuaucaggguggcugagauggggcuggccuaucuggagugggugcugggaaacucuaggaucucccugguugugccuuugcauggaaaugucauugcaucugauggggaaugagggacuuuaaagagaaaacaucuuagaugaccagguaauugggaggaccuuuuggaaauucuugcccgcuuugcaggaauuugaggugcucauuugguuccaagucaccuugaucucccugaugauguuuggaacgaaucacacuaccuuuuaaaucucugggcucaaagcaggcaacuuguccacuguuguagguggaugcaguucuccagagguuccuuuggcuuuaaucagugcuccuuuaagacaauccuugagacaccucuggaagcaaggagaucaccacgagcuuccuggaccaguauggucccuuuggcuuggugccuaaaccagacguaccccaacuccugcccccaucccagcauaagcucuuggcaauaaaugccagacuuccccugcccuagccuccacccagccugcauucacuccuuuuccuggcuuuagcccagcucuuccccucaauugugacauaucuaauguagcuccugucccaggcuguucccuccucacccccaggccuaccugagguucaugucccccuucauggccagacugaagacauuggacagguucccuccaggugagcagccacagaccaagauggccagugccucaauguucuucagccggaagaccuugcccagcacaaaggccgugaggggcaugaugccauacugugccaccagggcgauggccagcccuuuaggcuuccauaagugagccuugaucuugcugaacuccauggugcagcccagcgagagcaugaugaagaacaacaugaacaccaggaugacgcucagugccaggucuguggggcgcuugccaaaguuggguggcagggugaaguugaauggggcagacgcguugugggccuccauccuccugugaggcaguggaagaccacuccuuguucuccggcugacuccguuucuugugcaguucuugcuggaugccuucuuuaaucaccucucaggacagagaguuucuggacaaaagcucugggcaaauagaa

SEQ ID NO: 192367 - RNA, 7749 nt, Homo sapiens
ggcuuauguuucccuuuguucuguggccucagcuacaaaccauugauaaagcaugguauaaaccaucuagacagaaauggccauggaaacuacuguuucuucugaugguaagucauucauaaaguuugguucuaugcauaauuugguauccagaguaguccacuggauaaugugaagucucuuaauuuuuguuuuguuuucauuuuuuuuguuuguuuguuuguuuugagauggagucucacucugucgcccaggcuggagugcaguggcgcgaucucagcugacugcaagcucugccuccuggguucacaccauucuccucccucagccuccugaguagcugggacugcaggugcccgccaccacgccuggcugauuuuuuuguauuuuuaguagaaacgggguuucaccauguuagccaggauggucucgaucuccugaccucgugauccgcccuccucggccucccaaagugcugguauuacaggcgugagccaccgcgcccggcguguuuucauuuuuaaagauaugagugacuugagcauggauguagguagggugaccaaccauuccaguuugguugagacugaggggauugcugggugcagcacuuucaguuuuaaaaccaggacaguccugggaaaaucaggaugagguagucaccucaauugccaguaaggaauagauaaaguaguagaagaugaagaugcaguugagaauagggaaaauuaauagaaacaguccucaaguaggugggagagaugaucuggaaccaugaggggcuaaugagacuagagagguaguaagguagagaagagguggauauaggcagauucagauggugaaaggcccagaaaccauuuuaucuuugaauuuggcguguguguguguguguguguguaucauauuccagagaaagaaauccacuuuauauuaugacauuguggcuuuacacacacuuacaccccacauauuuggcacugugugugcaagguugcuaaggaucuucuagggaugccuucugauauuucuguucuauuuccucaaggaaaaagacugcaggcuauagccagcugaauuacuuccaugacucuaaugggacagauauuagugacagacagauaggaaaacagugcauuagggcauuggaauaagagggaagauggguagagagcggucuugaugaauuugaaauagcuguggggaaaggaagaguuuaucaaacaugcagaagagggcuguuggcucaccugauaguccgcugacauuagaggacauggauuuacggugguaccacuucacaguauccaugguagaaugaugguacuucaggagcuuuggucucuguaaguccuaggaaugaagacaaugagucugguuuuaaagauuuuuuuaaaguuauucuccuguuauugccugcucucaugcugagcuccaagaaaaagaauaauaugacacagguugguguagcuuaucaguccuuuccacaacauuauaucuuugauuaguucuucccauuuucaauccucccauccacaacaacugucacuccauaguaaguagaaaacauaucaagagagauauagagagcaaaucuggcaguuagaauuucaucccaauucagagaucuuuguucuuggaaguuuugccuaugaacuuugcuuuucucuuccaugcuacuugcaccuuguggaauaaggugccuaacuugcagcagugaaaacugcccagaugaauccagccucuuuaagcaaguuaauggcaaggauaauguucagcuugaaacaaguuuuccccaucuuccagcauccacauagccagucuaggacaagaaaaggaaaaaaaccuuaaauacuuuauauuagaaaggaaagguacuugguuaacuaauucuacugugauugagagacaaugagaauggauuuucagcugcuggcacuauacauaaaugaggaaaacucagaagauugaggaggugcaaaugcaauauccaggagaauaaagaaaagagcaauauggcauaggaaguuuugaaauaucuacuggauuuuauaucucuauuccuuaggcuggggauccaggacaagccauuucaguuuugauuucuauauucucuuuuuaagccuuucacaaacacauugguuuugggauuuuuuuuuuuucagagcagcauuaguagcuuugauguaggaguggaggaaguaugugaagaauuaaugcaguuccugcccaccccccauuccccgacaaucucugucacauuuaggacucucuagagucaaagauuuuggcauacagugcuugaagggaugaaacugguagcagagcugaauggauuggaagacaagaacauuaagagaaaugggggaugaugaaagaaaaguauuuggguuuucuuuggguuugagaaacagguauagcagaaguaagggggagagcugggagaacuaaaauuguugguaaauugauuaggauauaugaaauuuuuuguguguugacaagguauacauuaugacuaugagugggugggcugaauuacacugaagaugaauugaagagguuaaaaaaaacuuuaaaaaacccugucuuguuuucagauggguuuucuauauacuugcuaauauuacuuuaaguugaggguaggaauuuugguggagaauaauuuuaucagucagaggccagagccuuugaauuuuguccaagugugauaagggugguugaagagacaucuaaaaauaguguagucagauauugcaggauaaaugauuugguguucauguugugggcuguggagaacaggaacucugguccuuguggugcaugugacuucugaggauggaguuucucaagaggaagccuuuaggcaagcaguaaauucuauuaaagcucagguucaauacgguaaguagauguagggagcuuucugugaagagguacaggauggaguugguucucucucucucuccuuuugucuuuaaaggaagacuccagaaagcacaagggaagguauaagaagagaauauaaggaaacuugaaucagggcaaagaaagcauugauuagaaauggauucaaaauccaggagaugauugguguugggucaggcauguucauuuuuauaucuucuguguaaguccucuuagauuagcuugauuuaagugcuuuuccuuuuuguucuuauaagaaauagcaccuaccuucaucaauauguugaucacagucagaggugaaauuaaguuuuugggccugaugcacguacaagaugaggggcccacuuuaagaaaaauaauaccaaguuacaauugcagaaaauaaguaugaaaaugaggauuuauuuagcauaagaaagaagcugcaacaaauuauaaauauuaaaagguugaaaacaccauaaacaucacaaaauuuaauccccucaguauuacauuaaucaacuuccuaacucacuuuuaugauaccuuuucccuauaguuuuuaaauugcuuauuuaauuaccucccuuaagagaauuauuuuguuauaauuucuacggcaagaacugaaaggcauuugccuuucccuaguauguuuaauaaaaauucauuuuguauuauuaauaguuuagaaaagaaaauucagcuucacagcuuguuauugguaaugagauaaauaauuaaauuuacuauugucaaauuuuagaaaaccucuauuaagucuuuuauguaugcgauguaauauuucaggguguuugagauuuuucuuguauagugacuaauuuugauuacucauaauuauaugacuuucauaaaguccauugcugagccccuuacagggucuuuauagaggucuguacagugaggaucccugaagcauaaacuuugucugguuuugaucauauuauauuauaauuaucuguuuuuuguuuguuucuacacaugcucagugcuuacuagccucacuuuugacagucauuugagacuaugaugaaauauauggauacucuccucagcaaaaaaagucaugaaauacauaaaauauugaauacaauauuacugaccuccuaaagcuuauucuugcuccugccacaguuucugcacuaaauugauaauuuauuuaaugcucuguauuuugauuuucuuucucuaauaucuagcacaauguccugcacuuuguaugcuccaaacacauaaagacuuguuuaauaaauagaaaaagaaauggauaaguguugccagccagacuguaugacaggugcagaaauuccccacuuucaaaaacuguugguaaauauauuugagcaaacacucagacucuucccuggcgauccuaaaauacuagacucuacaaugguuuuugcccuaauaagaaaagaguuccuuuucggaagaccuuuaaacugcauagauucucauuuucucuucugaaagcauuucguuuugucuuugggacucuccuguagcuaacuggagagaacaacauuauucucuccauacccuuaaaugaugucaguguuucaugaauuuucuuuucuaaaaauuauacuacaauaugaacacauuuuaguagcauucacuuauaauccaagacauuuugcaaucccuccuccguuuuuccauuuuucauuguacauagagcuauaugaggcauuacagaggauacuaaaaugaacgaaaaucauaaacccugcagucaagaaucuuucagucuaaugaaguuaugaguaaagaugaauacaaugaggaauaguaaauaacuuugagauaaagaaacuaaaguauaucauaagacugaugcaacuugacacagaauugugauuauuuuugaugucuccaguuuugauagucaaaggagacacuaucaauagauauugcaagggcaacaggcauaaacuaauauuaucuuggacaauuugauauauagagucacccuacucuuaaguuucuuuacuuuugcuuuuacuuuuuauuauggacauuccauacugccuguaaagacugagauaacuauuuaaguacccaucuuccaacuucaacuauuaucaccacguggccaauguugucuccucuauacccccuaaauccccacccucauuuacuaaaagcaaauccaaagcauuuucuugauucaucaaccaguuuuucacuacuucauucuuuuucucuccugauuccuuacuuaucaccuuuccaacccaucuuuuuauuuuuacuuccagcacugcaguucugaucuaacucugccaggacacagauccacagggucagcccugcauccugagcagcuuagagggagaagccagaccagcagugccucacaccuuguccucuucugcucuggacagauggcuccauaacgacagcuucauaauggcaguggaugggacccucguguacaucagagucacucuucugcugcucuggcuugggguauuuuugucuauuuccggcuacugucaggcugggcccucccagcauuucacuuccccggaaguggugauccccuugaaggugaucagcaggggcagaagugcaaaggcuccuggauggcucuccuauagucugcgguuugggggccagaaacacguuguucauaugagggucaagaagcucuuaguuucuagacaccucccaguguucaccuacacagaugaccgugcacuccuggaggaucagcucuucaucccagaugacuguuacuaucaugguuacguggaggcagccccugagucucugguuguguucagugcuuguuuugggggcuuucgaggaguauuaaaaauaaguggccucacuuaugaaauugaacccaucaggcacucugccacauuugaacaccugguuuauaagauaaacaguaaugagacacaauucccagcuaugagauguggcuuaacagagaaggaaguagcacgccaacaguuggaauuugaagaggcugagaacucagcucuggaaccaaaaucugcuggugacugguggacucaugcaugguuucuggagcuaguuguuguggugaaccaugauuucuucauuuacucucaaagcaacaucucaaaggugcaagaggauguauuucuuguugucaacauaguggauuccauguauaagcaguuagguacuuacauaauuuugauuggaauugaaauuuggaaucaaggaaauguuuucccaaugacaagcauagaacagguccugaacgauuucucucaauggaaacaaaucagucuuucccagcuacagcaugaugcugcacauauguucauaaaaaauucacuuauaaguauacuuggccuagccuauguugcaggaauaugucguccaccuauugauuguggaguugauaauuuucaaggagauaccuggucucuuuuugccaacacuguggcccaugaguuaggucauacguuagguaugcagcaugaugaagaauucuguuuuuguggggaaagagguugcaucaugaauacuuuuagagugccagcagagaaauucaccaauugcaguuacgcugauuuuaugaagaccaccuuaaaccagggaucaugucugcauaauccuccaagauugggggaaaucuuuaugcuaaagcgcugugggaauggugugguugaaagagaagagcagugugacuguggauccguacagcagugugaacaagacgccuguugucuguugaacugcacucuaaggccuggggcugccugugcuuuugggcuuuguugcaaagacugcaaguucaugccaucaggggaacucuguagacaagaggucaaugaaugugaccuuccagaauggugcaauggaacaucucaucaguguccagaagauagauaugugcaggacgggauccccuguagugacagugccuacugcuaucaaaagagguguaauaaccaugaccagcauugcagggagauuuuugguaaagaugcaaaaagugcaucucagaauugcuauaaagaaaucaauucucagggaaaccguuuuggucacugugguauaaauggcacaacauaccuaaaaugucauaucucugaugucuuuugugggagaguucaaugugagaaugugagagacauuccucuucuccaagaucauuuuacuuugcagcacacucauaucaauggugucaccugcugggguauugacuaucauuuaaggaugaacauaucugacauuggugaagugaaagaugguacuguguguggcccaggaaagaucugcauccauaagaagugugucagucugucugucuugucacaugucugccuuccugagaccugcaauaugaaggggaucugcaauaacaaacaucacugccacuguggcuaugggugguccccacccuacugccagcacagaggcuaugggggcaguauugacaguggcccagcaucugcaaagagaggaguuuuuuugccgcugauugugauuccuucuuugucuguuuugacuuuccuguuuacugucgggcuucuuauguaucuacgacaauguucuggucccaaagaaacuaaggcucauucaucagguuaagaaaaugucucuaacuuaauauuccaugcauuaguacacuuuagucucuuggcaguagaaacauuaguacaucccugaaacugagcacauuucugaccauuuccagaaagcugcaaagaucuucccuuacauuaguaccacaaacauugucauuaaguucaaguuauucuuaacauguuucuaucuauuguuuauuguuuuaagcagcaaauaaagcuacauccuucccucccuuua

SEQ ID NO: 192368 - RNA, 16428 nt, Homo sapiens
gaaagagaaccuguaaacgcucucggaauuauggcggcgguggauauccgagguauacuguauugcuauauuuugucucuugauugucuguggaccaguuugggauguuauagcucgcgguuucaagguuuagguuccuuugugugaagucucaagcuuuuuugagugguuuuuguggacaacccaaggcugugaucuagcgaaacguugacgaguuuuuuuuuuuuucugaguucuuggagcgucucuuggaagcgucggagagaagggguuggaagaagcucuggguuuugagcuuucagagcuggaguuuuguucuacacacguaucucugcaacaacauuagggcuauucuauuggagugaaggaauggcguuuaggcagagaagggaaugggguaauaagccaacuugauuugauucaucucuugggacuuggcaugguggcugccuaauucuuuagaccgcgccacacgggucccugagcaugaaucccagauauuuucuuuuuuuuugagucgauaauacuuuacaucgaacguccagcaauuauuaugggcaggggucguauuuuuuucacagcugaacugcagaaguacucaaauauugaaucagucagugaauaaauguauggagaugucaccccuuaacugcugcuugaucuuggggagcauguagaguuguuuuuguguauauaguacuugauuuuuaaagggagauguuugagaugccuuuuuuuaauauuaacuggauuggggucuaacacauuuauuacaaauauucucauuuauacuuaucuggcgaucugcagcacuucuggaucaugauuuuacauacgugucuuucauuauuuauuucaucacuugcugaugguuagaaugcuguuagaaugcuugggcuaugucaacauguugccuugcuacagaauaaaaaagagaaauauuuaguuuauaaaauguuuuacuuauaauucagauuguuaggaucauggcaaagacucuaaaauaagaguguguuugguguguuaaaggaacagcaaggaggucaguguggcuggaggguagugagagaggaugugggaaggagaugaagucagaaagguguugaaagcuaugauaaggucuuuggcuuuuccucugaguaaaacgcagagccauuggagggguuuccaucagaggaaugaugugaucugacuuuuuuuuaggacuacauuggcugcugggaacaguguaggagggcaaggguagaauuaggaaaaccaguuaggaggccauuucugaaaauguuauuuccuggccuguuguguauuugguuauugcaugauccaguuaugaugaacuaucuaaauggucuauacuaauuauuugguuauuaacgcacuucaucugucuccuccuuuauuuuauagcacacaaaguacauuuuaccuuuauauaauuuuucucgguugagucacuuggcucaaaacugccugucaccuugaauuaggucugacuucuuugaagaugccugagguaaugacaguauaagagagauugaaguuuuucaaccaguauuguauaggcauuuugauguucaugauuuacaccuagugguguucaguacagucagugguaugaagcaucaugaaagccaauagccaauacaagcucauuuauuaaaaguaucuagcucuaucaugucuuuuuaaaagcuaugauuuaauucuacgcuaaauaugaaaccguguggcuguaguuaagggaacucuacuuccuguuuaucccuuagcuuuuacaucauuaucaucucaucuacaauaauagcuuccuaacuucucuaucccuaauugagagaucucaaacugguagcuauagauguguucucuugggcauacauguuauuugaaaauuuugaauuccuugccagcauuaaggauuuccaauaaaaaaaaaaguccuuucuaaauuuuaaaucuuaucacuucuucaccuaaugaaauuauucucuaaagauauaauauacuuuauauuuuuacaccucuguauauacauucucucugcuuggaauuacuuugcccuuuucucuguguaaguuuuuauuuauucuuuaacauaccgugcuaaaacccaccuucucuccacaugaaaaaugauuuucguuuccccagguccucuguagucucguaacacauuucuucaugucuuuuuuuuuugagacggagucucgcucugucgcccaggcuggagugcaguggcgcgaucucagcucacugcaaccuccgccucuuggguccaagugauucuccugccacagccucccgaguagcuaggauuacagguguccaccaccaugcccggcuaauuuuuuguuuuguuuuuuuucuuuuuuugagacggaguuucacucuuguugcucaggcuggaguccaauggugugaucucgucucaccacaaucuccgagaccuucugggugcaagcgauucuccugucucagucucccaaguagcugggauuaugggcaugcacaaacacgccaggcuaauuuuguauuuuuaguagagacgggguuucuccauguuggucaggcuggucucaaacucccaaccucaggugauccaccuaccucagcccccuaaagugcuggcauuacaggcugagccaccgcacccggccagaauuuuuuguauuuuuaguagagacaggguuucaccaugucuuuaucauaagacuuaaucauguuauugcuuucuugcauaaucucuucuguuacaucaugagaguguguugguuaggaucuaugucauccuuauauucauagugccuacuacauuugauguauaauaaauguuuguuggauuggauucuuucuauuuuucuaauccuuuaucauuuuguuuucuuucccauagacaaucugcugggaauuucuuggguugacagcucuuggaucccuauuuugaacagugguaguguccuggauuacuuuucagaaagaaguaauccuuuuuaugacagaacauguaauaaugaaguggucaaaaugcagaggcuaacauuagaacacuugaaguaaguuauuuuaagaagguggcacuuuuuccaaauacaaguuuugcaaugaacaguucuuucaaacuguggaucaugaagugcagaguagaacuuuuagaagaaaaacuggaguuuuguuuggguuuaugcaaauuugacaugcaggguaacuauuaguauucacuuuuaacagaggucuuuucuguauaacuucauaauguuuaauuacaauauaacagguuuagauuuggaucugaugagugauuuuggcaaugcuacuguuauucucaaccaggcaacuauaauuauugucucuuuuauaucuaguuuauauuacaaaaguauuugaaacaacuguugauauaauuuuccuguuagcuacauauugaggaggagcuuauaaaauuaaauaucuguuauauuuuaaauggcuuuuguuauggggcaaauacagcuauugagacaacuuauuguugcuuuuaaacauaaucugucagguaaaaaaauuuguugggaugaggauaaaguuuuugauguuuucuaguuugguaauauauauaguugugucuucauguuuauuuuuauauuuuguauguauucguagauuuggucaggaagcaucauggcauuuugauugccuuuuugaaacggacacucuuugguguacuuuccugacugaaaauacuuagauuuaaauuuauaauacauuguuguagagaaauuuuguuguuuagaaacaagucuuacuuuaucuauaugccaccugucugggaaaacagccaauuuuacucaacagccagauuauaacaccaaacauaggcaguuuuaauccuauuuaaaguguugcugcauuuuuauauaauaauuugaaugucuuauaaaauuauuuguagggcguuuauagaucuuuggaugucuguguucuguuuucagucagaugguuggaaucgaguacauccuuuugcaugcucaagagcccauucuuuucaucauucggaagcaacagcggcaguccccugcccaagguaaaauguguaaacuuuaggcauuguuuucuuuuuaaaauaccauaauuuauuuacuuccugaccuaacuuguuuuuuugauugguuucuguuuggggggucuccaagaccacauacauguucaguacuaugcuggaggacucaccagacuuagcauaugguuguacuuacagcuaagauuuguuaugacaacacaguaaggguacgcagccagauuaguacuggaaaaagacaugucagguggggucuguaggaauccaugugcaaguuucuuaugcuuucccucuugcuugugaagggccacagagugugcccuccauccagcagugaaaugcagcugcauucaauaugucugcucagggaaguccauauaagacucugagccagggauuuuuauagaggguugguugcuuggacauccucugcccaccagauuuuuagauuuuccaaaagaaaucuggugucuacuauaaucacauuguuuguacaaauugucugcaaaggcugguacaaccagccuaacuaucauauaggaaauguuucaaaagccaaguuccacuaguuguauacuuggauaccaggacucuuggagcaugcccaaggacaacucuucaagcacuaacagucagagcgacucacugcaucaaagcuaccucuuucugugagcacaguugguauaccgacugaacgucaagcaucccaaguaauuuuguuuuguuuuuugaccucugaacuuuuuauuggccuccugcuccucaaaggguacccugcuucugcuggcuuaaugucucagaauuuugauguuguuggucucagacaccacucugccauccacuaccuggcggguggggucuuuuggaugguuugcauggaguugcugcuguccagggcgucaccaagauugaaguccuggcugucuuccagcaggcggcgguagguggugaucucagccuacagcuugaccuugauguucagcagggccuuguacuccugggccuggugcugccucucugccccggccugugccagcuccaacuccagguacagcaggauccuguugagcugcuccaucugcaggguauagcaggccuccaccucccucaggcuguucuccaagcuggccuucagauuucucaucgaguccaggucagucuccaaggacuggaccguaccucucagcuccgugagcgucaccuuagcaaccccaaccuuggcagacugcauagugaccacugugguguucuccucaaucugcugagaccaguacuugucuagcuccucucaguucuucugagccagcucuucguauuaggaugucuccugugaucuuggcgagguccugagauuuggggguaucuaccuucaucgucaacccagagcuggcagucugggcuuguaggccuuuacuuccucuucacgguucuucaugaagagcagcuccuccuugagagccucaaucucuguagcugaagccgagugacacuggugucauugaccuugcagagcccauggauguugcucuccacagacugauacauggccagcucugucucauacuugacucuaucagcagcaagaugggcauugucgaucugcagaacaaugugggcauuguccacaguacuugagaagaucugagcccucagguccucgauggucuugaaguaauggccccaaucucugaccuggggucccuucuuauccaggugcuccuggauuuugcucucuagccucugguucucggucuccaggcuccucacucuguccagguaggaggucaggcauugaaccaggguagguucaggcuuugcauggucuccuccucguucuggaugccucccauuccugcuagaacccuggccaucccauggccaggcuccuguaccccaagcugcccuggaaaccgguggagcgggacacggagaucugggaaccagagccuccggugccuguauagacgcuggccgugcugcugacuggcugggugccgcagcugggcgccuggauggagcccagggaccaguaguuggagaagguggagugaguggugaaacucaugcugucuggggaggagagugagaggacaggacucaggcuuugcugaugaccacaauuaacuuuuuuuuucacaucaguccacugaguuaauucuuuuacaaaaugcaugguagaucuggucauaucaaauuaauagaggaucaguugaaaauccucagugaugcauucaacuaaaagccuugcguggguuauacuaccuacugaaagcuugguuuagaaacaacacugaagaguguagaguccagauuugguuuugaaucaaagagcuagacaccuuuuccagcgaugaccagaaauugaagacauuagaaucaaggcaagaccauggauaaagucauacugaagagaagauucaagauaggggagccagauggguguuauucuagcuacaucucucaauuggauacccucauuaagacauuuauggacaaucuuuaacuuggcauuguuuucagagaaugacuugauaaagaaguugugauucuggaauccaaaaucaguuacaaaaucaaagaucuagagucccugcccagaguaaaagagaaccuuagaaccaaggcaaaccagcgacaagacaagauuuccauagugagaggauucaagguguaaaaauuacacaagacggcaguagccucacuagcagcuaucuuauuccuuaggacccagcacuggggcacaaaagcaagcucauugcauuugauaucuuuacacuggaccccccagucugucuugcuccaaggucuuacucccuuaaguaagguugacugacaacaguauuggcaucuuuugggaacucguuagaaaugcacuaucccuacugaauaagaaucuaauuuuaacaagguccccagguaauucagaugcacauuaaaauuugagaagcacugcuggagggcaacagugggcauacuuuuucugaaaagggccagugacuaaauacuugggguuugugggccucguagucucugugacaaugcucaauuauugccagagcagccauagauaauauguaaaugauuggauguggcuguuuucuaguacagcuuuaccaaaacaguaauugcuaaacccugccuuaugggaaaaugucagauuuuauuucuuuuuaugagaaucuguuuagcaguuuguguccauagcuguauuuauaaaccuuuuuucccacuguuuuaguuaucccacuagcugauuacuauaucauugcuggagugaucuaucaggcaccagacuugggaucaguuauaaacucuagagugguaagugucuucacauucuuuaagcacuaaagaaaacuuuuaauuagcuaccuugcuuccaguaaucaaacuagagcuccucugccuuguguaaguugcuauaaaguauugacuauuagaaugucuugaacuuugguuacugugagccaagucggugcucaaaguauauuucauagucucaauuauauaguaauuuagguucugaaaaauagguucugucuuugcauauguaauauuuugugaguauuuacuuuggaaaguuuggucgaccuaaugauaaauuuagaguuuauuuuccuuuuacaagcuuacugcagugcaugguauucagucagcuuuugaugaagcuaugucauacugucgauaucauccuuccaaaggguauugguggcacuucaaagaucaugaagagcaagguaaguagaacauccauacccuccuaaaacacuuuuugauccucugagaaugaagcuguuuucuuuaggaaaauggcuguugaucuuuucuaaguguguuucacuuuuucaugggaugauggcuuuguugcagcugagauucauguaacuagaugugguaauaauagcuuucacauaggaacagaugcaaguucacucuguuaguuaacugguagucuuuguuaaggugauucaagguuuuaaaauauuuggggccaggugugguggcucacuccuguaaucccagcacuuuggaaugccaaggcagguggaucaccugagccuaggaguucaagaucagcuugggcaacauagugaaaccuggucucuacaaaaaaaaaaaaaaaaaaaaaaaaaaaaaaggaacauaggagagacagugguguggaaugagcagagaugauauuccuuacuuaccugacuguugaguuaucuugguaucuggaacucuuuauuccuccagucuucaaagcagaggagaugagagagauugcuuuuuagagcccuauccccagauggccagucuguuuucugaucuuugcaucucaucaccucuuguggcuccagguccuccaaguuuccauguaaucugcuacugucuucaucauauuuuacuguucgacuaccuccagaaaugugccuguaacagcauacuuguauucuccauuuccuuuucugagaaauagcaagucagaauaaauuacugagggaaacagcauuuguauagaauucagaccuguaucuucuuaauaguagguauaagcaggaacauuugaugaaggaaaguuugccuuuguugacuaaaauuggcccaauggcucuuuuccccuacgauaaccaaguguucggaguaacacuuaucuggaauccuuugcuuagagacaguuucccaauacaccucccucccaagggcaaaucccacaugcgauuaacuucagaauuucucuuucagguucuuuucuuuuuugucuucauaauuuucuguuuuauuauuuuuuuuuagugaauuacagucuuaauaauugaauaugguagcuugaguuugugaaaccugcauuuccauuuguugcuaguagguuuugugagaaaagaccauuuaauacacuuaaaauaacaaagguaauuucaagccaauaauuuggauugugugauuuagguaauuaugaaaaacuuuagcuuuaaaacucuuacgguugugcgugcuuauauaccaaaacugaaguaucuuuaaaagacauauguaucagcuuaaauguuagaauuuaacuucaguuaagagggagaguuaacaacacuucuguauaugugcuguguuuaccuuauuuugggaauuaucuuugguauagcagccauuaaaaauaaugaaguuuggguauauucaugguggauaaagauuuguaaaauaugagacaccaaacuaaguaggcaauguuuugauuuggacuucguauuuuaauagauaaagucagaccuaaagccaaaaggaaagaagaaccaagcucuauuuuucagagacaacguguggaugcuuuacuuuuagaccucagacaaaaauuuccacccaaauuugugcagguaaugagaauaugugugguuaaucuugauuugacacuucuuuauggcauauauauuaauuuuuaauugagaacuguuucagaugugaccuaaaaguacaauuuuccucauuaguuaaaaaaugaucucuguaucaaaggaaagguuucgaaagacuuaauggaagaaauggguaaauggaauggaauuaacacuguuuuguguuucuuacugaaacuucacaaacuaugaggacugcauguagauaauauucucauucaaaagguugcugaaagugucacaggugguaacaaaacuagaauaugaaacucaugcucuuuuuacucuacaugccaccuuccagccugauguaguagauaucugaacaaccuaaaugauagaauaguuaacacuuguguaacaaaaagaacagaacaucugagguagaguguuuggcauaauaaacagaggagacaggagugaugaauagagauacccuguguugggguuuuaaguuauaugaauuccacugugugauuuggaggggcagggagauuucuaacagcaauagcaaauccaccugccauucuacuaaaugagcuuuuggagucuaguagauauggaauggaauagaugaauaugcuguucucauggcuagucucaauucuucuggaccuuuacaauguacauacaagaucauauacccuguuuuuguuaggagcucuuuaagggauuuucaagggaaauuuuaaacuaaaugacauuuuucacaugagaugacuuuagaacaagccuccccuuuucucuucccugacucugcuguagugagagauaggugcuauuggaauugugauguaguggugaagagagcagaggacacaagauggaacucaggacaggaaagccaguuuagaggaaucucaucaacugcacuugaagauggaacauagucuguugaauaaauaaauaaaugaauuauagcuguaguagggugaugagugaccucuacagaauguaagagguuagguguaguugaccauucauuuggugaguacauaguguaugcuagguaggccaggggaagacaccuagacaugugcuguccaguaugguaaccacgaggcacaugugacuauuagcauuugaaacacagcuagcccagauugaguugugauguaagugcaguauacauacuggauuucagacuuguaugaaaaagaauguauguaaaauaucucaguaguuuaaaaauauugauuauauguugaaauaauauuuuagguauauuugguuaaauaaaauacauguuucuuuuuaaaaaugugacaagaaaauuuaaaauuacauguauagcuugcauuuguggcucacauuucuuuugaacagucgugaucuagaaaacgguaauagaacaugcaaaaccagaaacaugaguuagugaacauauguucagaaaccagaagaauccucugaagguuuacucuguguuuguggaggggaagaguaauggaagaugagacuuaaaaaauggauuaaggucaguugagaaggauuuuguaugcuaugcaaaggagcugggauuuaauccuggaggccuauguuucuucucuauuuuaaacuuacaacccauuaccacucccauaaacauaacaggccuccagaugcauucagaguuauuuuaaguuuuaaaccaauagcuaucauaaccaaaggcagaccaaaccaggagaaauuuuguauaauguuuuucaaguauauacucuaggaguguauucucacuaaaaacuccucuaucucaucuucaagugacuaguugagaauuauugcugauggugauaaggacccauuggguauuuaaaaguaguugcaagggagugguguagucaguuuuguguuuuaggaaugcaacuaguaacaguaugggggggaugcuuaggaaaucacaugugaaguuuggagucagggcacuuaaauuguggaaaacuugaauucuguggccauaggauagagaggagacagauucaggagguauuucgaguuaggauugcuuuaauuuggugguuggauuuggagagauuggacaaagggugauucugugguuuuaggccuagaauuagacuagguauuauuaacuaaaauucagaauacagggaaagaaacagauuuugguugaaauaacaguuguuagggguuugguuuucauugaccgaccuaaagaacauucgguaguuugcuguuguauuugaguccugagguacuccagugaaagacaacuuuuuuuuccccgccccuggcuagggaugcugccuugauucuuguuugcuguccuguccuggugagcuaggcuagacguuauagaaagcucaaagacucucuugauucuuaaaauaaaaacucuuuacuuuauagaaaaguaugguaauuuuaaaaacaugaaagcagagagaauaauuaaaaaugaaacccccucuacccuuuagccugccucaacaguuaucaaaauggccaagcuuguuuuaucucuucuuccccuacuuccucccaauuauuauuauuauuauuauuauuauuauuauuauuauuauuauuauuauuauuuuugagacggagucucacucugucgcccaggcuggagugcaguggcacgaucucagcucacugcaagcuccaccucccagguucacgccauucucgugccucagccuccugaguagcugggacuacaggcaccugccaccacgcccggcuaauuuuuuguauuuuuuaguagagaugggguuucaccgcguuagccaggauaguuucaaucuccugaccucgugaucugcccaucucggccucccaaagugcugggauuauaggcaugagccaccgcgcccggccccucccaauuauuuuuaagcagacugcagauuucauaucauuucagugaguuuuuuaccuuuuucuuuuaaagguuuagccacauucauacuuauaucaucauauuccugagccauuucuuuuaccauccaagggccaaaaaccaacucccaaagauagaguauauccagcucuguguaacauaacuaggagaaagauggcuuucucuagaacuauuaauaaucuuuuugcuuuuccuaacaaaaauuuuuccagccucagaucuagagaagaaaauaaucuacugcaagucucccagaacuucuuuuagcucauaugaacuccucuuuacccauugcauccuccagaacuaccuguaguucggauaaggauacagcagguauuccuacuaaucaauuuuaucgagcaguugggcuugugguacccagggauguugccccuguaaggggauguucaggagaauauuggagaaguccugucugcuucuuugaagcuccuuuuuccauauuuuaauucuuguuacugcuggaaguugcacuaauacugaugugaugagaguuucaguccuuggagccuuuuaugaggacugucuuuuuauugcugguuuuagaagcugcuagaauaccauaggauauuacuucaacuaggauuaucuaaaccaaagccaccugauuaaauuugcuccaagaagcacucuuguuauauauccccaucucagaccguguucuacuagucuagcaggacuuacuagaaaagauuagacaguguauuauguuggguaaauaaugacauuauuccaauguccaaauauaguucaguguccaauauaguuuaaauguaguucagugcugacaguagaaaaaucccccuuuucaaauuuuuuacucuccucaauguuccucccuauguuuccucuccuauuuuaaagaaaaacaauuuauucccucaaaauuacuuuggacauguuaaguauugauauuuucacaagauaaugugauauguggcuuuguuggggguucucaugaugacucccguauuuggggauugcuagcaggacucagaggacucagcauguaguuguacucagcuaagauuuauugcuauaauauagcaaggauguauauagccagaucauaagggaaaaggacacagcagagucuggaagaaucuaugugcaggcuuucuuauacuuucuccuucccuuaagagguuacacagagugcacucuucucucaacagugaaaaugcagcaacauaugugugauauuucugcccagggagauccauuagagaccugguacccaagguguguuuuuggaguugggggagcucuucauguagguauccucuaucuagcacauaccaaaauuucacaaccucugaagaaagcagguauucagccuaaauugcauuguuuguacagucuaggcacagugagccacuauuaccagggaauggugggaacccuccaaaaauccaaguuucuagacacuaaccaagggccaaccuugcaagcaggccuuucuaaguauagcagccucaggccuucugugguaaccuuuuuauugcacaguggauaauaaugugaagcucaguuuuggucuuguuaaguguaaagauucccaggacuugcaguuggaguaggauaguuggcaguugucagcaugaaccuggaacauguaauaucagaaaauuuuguaguuagaagugggaauagguaagaaggccuagggagggcauguaaauccagaaagauucagcacacagauggaggcauuagaagugaagagacuguuuuuucuucuaagaugauauggaaguaauaagguauuuuaaauauauauguguauauguauauaaaguuauaauaaguuugaagguagaugguaaggaaguuggugguguuggcauccugguuuuguuguuguuguuuuuaaacaugggagacagugucaucggaugagggguagaagaagacaagaaugucguagagcauuuaacuuggggaauggggcaaaggagaugacagagcuuaaucaagugaaagaauugcuugcagagugaaggaccugaccuuguuucuaaccucuaaugcucuuaucuuuuuuuccuauagauugguuuuuaauaauagacucaucagaaaucucuuuucccuccaaauuucccaugccuaccaacuuuaaaagucaugguucauccauacuucauucucccuucccauaagucauaaccccuaaggaaauaagacucugggguauugaaagacuuauuauuucuucccauuggauucuacugaacugcuuuuuauaaagcauuguagccuggguguggagguggaagucuuuguuaaauguucaaguguuuuuaugguugguugacuaucuuguucuaguuuuugauuugugucuuuucuggaauggggaauaagaaguagaaaaugauaaauuuacuuuauaguacauacauaguagcuuuucuucacaaagucauuugaaauguaauuuggaugaagcuuucauuuuauuaauaugacaucaggaagaagaaauuuugccaaguugaccuguuuucuucuuuuuccucuuccucucccucccuuuuuucuaaaaaauuauagcuaaagccuggagaaaagccuguuccagguaugguucauguaauauucuuauuacgcuugaaauaaggucaaacagcuuguaaaucaaucacaaguauagcaugugaaaugagcuguggucauuuuguccuucuagagcuggggcugggucucauuggaagaagaauugucuugggucacacauaaaauaacacuaaugauggcugaugagcugaaaaaaaaaaaaaagucucauaauguuuuaaggaaguuuacagauuuguguugggccacauucaaagccauccugggccucaugcugcccgugggcgguggguugaacagucuuguucuagagucucccauuguaguuuuuuacucuuaaucuuugagagcugcugaacugucagcagguggugccauugugguagugauugugguagugaaaagaugaauugggagggaaaaaguagguauugaggaggugugaggaagccacugugauucgagguuucuucaucaaaucuguauuuuuacacaaugauguuuucuguuacauuauugaaaacagguauugaaccaucaugguacuggguuagaauaauuauauaucuuguuuuuacauacugucuuacuuaaaugcuauguaguuuugucuaguaucauuaauuuccuugaguuuucagguuguuagguuuguaacuggguucuuguauacaucugccuggggaaacagcuagaucuagaacuugagauaagcaguuaaaaaugaauuugaaaaugugagccauucauauuaaccauuuaucucauuccccccacccauaucucccucccaaaaaaucuacuuuugauaucuaguggaucaaacaaagaaagaggcagaaccuauaccagaaacuguaaaaccugaggagaaggagaccacaaagaauguacaacagacagugagugcuaaaggccccccugaaaaacggaugagacuucagugaguacuggacaaaagagaagccuggaagacuccucaugcuaguuaucauaccucaguacuguggcucuugagcuuugaaguacuuuauuguaaccuucuuauuuguauggaaugcgcuuauuuuuugaaaggauauuaggccggaugugguggcucacgccuguaaucccagcacuuugggaggccauggcggguggaucacuugaggucagaaguucaagaccagccugaccaauauggugaaaccccgucucuacuaaaaauacaaaaauuagccgggcgugguggcgggcgcccauagucccagcuacucgggaggcugagacaggagacuugcuugaacccgggagguggagguugcccugagcugauuaucaugcuguugcacuccagcuugggcgacagagcgagacuuugucucaaaaaagaagaaaagauauuauucccaucaugauuucuugugaauauuuguuauaugucuucuguaaccuuuccucucccggacuugagcaaccuacacacucacauguuuacugguagauauguuuaaaagcaaaauaaagguauuuguaua

SEQ ID NO: 192369 - RNA, 16428 nt, Homo sapiens
uauacaaauaccuuuauuuugcuuuuaaacauaucuaccaguaaacaugugaguguguagguugcucaaguccgggagaggaaagguuacagaagacauauaacaaauauucacaagaaaucaugaugggaauaauaucuuuucuucuuuuuugagacaaagucucgcucugucgcccaagcuggagugcaacagcaugauaaucagcucagggcaaccuccaccucccggguucaagcaagucuccugucucagccucccgaguagcugggacuaugggcgcccgccaccacgcccggcuaauuuuuguauuuuuaguagagacgggguuucaccauauuggucaggcuggucuugaacuucugaccucaagugauccacccgccauggccucccaaagugcugggauuacaggcgugagccaccacauccggccuaauauccuuucaaaaaauaagcgcauuccauacaaauaagaagguuacaauaaaguacuucaaagcucaagagccacaguacugagguaugauaacuagcaugaggagucuuccaggcuucucuuuuguccaguacucacugaagucucauccguuuuucaggggggccuuuagcacucacugucuguuguacauucuuuguggucuccuucuccucagguuuuacaguuucugguauagguucugccucuuucuuuguuugauccacuagauaucaaaaguagauuuuuugggagggagauauggguggggggaaugagauaaaugguuaauaugaauggcucacauuuucaaauucauuuuuaacugcuuaucucaaguucuagaucuagcuguuuccccaggcagauguauacaagaacccaguuacaaaccuaacaaccugaaaacucaaggaaauuaaugauacuagacaaaacuacauagcauuuaaguaagacaguauguaaaaacaagauauauaauuauucuaacccaguaccaugaugguucaauaccuguuuucaauaauguaacagaaaacaucauuguguaaaaauacagauuugaugaagaaaccucgaaucacaguggcuuccucacaccuccucaauaccuacuuuuucccucccaauucaucuuuucacuaccacaaucacuaccacaauggcaccaccugcugacaguucagcagcucucaaagauuaagaguaaaaaacuacaaugggagacucuagaacaagacuguucaacccaccgcccacgggcagcaugaggcccaggauggcuuugaauguggcccaacacaaaucuguaaacuuccuuaaaacauuaugagacuuuuuuuuuuuuuucagcucaucagccaucauuaguguuauuuuaugugugacccaagacaauucuucuuccaaugagacccagccccagcucuagaaggacaaaaugaccacagcucauuucacaugcuauacuugugauugauuuacaagcuguuugaccuuauuucaagcguaauaagaauauuacaugaaccauaccuggaacaggcuuuucuccaggcuuuagcuauaauuuuuuagaaaaaagggagggagaggaagaggaaaaagaagaaaacaggucaacuuggcaaaauuucuucuuccugaugucauauuaauaaaaugaaagcuucauccaaauuacauuucaaaugacuuugugaagaaaagcuacuauguauguacuauaaaguaaauuuaucauuuucuacuucuuauuccccauuccagaaaagacacaaaucaaaaacuagaacaagauagucaaccaaccauaaaaacacuugaacauuuaacaaagacuuccaccuccacacccaggcuacaaugcuuuauaaaaagcaguucaguagaauccaaugggaagaaauaauaagucuuucaauaccccagagucuuauuuccuuagggguuaugacuuaugggaagggagaaugaaguauggaugaaccaugacuuuuaaaguugguaggcaugggaaauuuggagggaaaagagauuucugaugagucuauuauuaaaaaccaaucuauaggaaaaaaagauaagagcauuagagguuagaaacaaggucagguccuucacucugcaagcaauucuuucacuugauuaagcucugucaucuccuuugccccauuccccaaguuaaaugcucuacgacauucuugucuucuucuaccccucauccgaugacacugucucccauguuuaaaaacaacaacaacaaaaccaggaugccaacaccaccaacuuccuuaccaucuaccuucaaacuuauuauaacuuuauauacauauacacauauauauuuaaaauaccuuauuacuuccauaucaucuuagaagaaaaaacagucucuucacuucuaaugccuccaucugugugcugaaucuuucuggauuuacaugcccucccuaggccuucuuaccuauucccacuucuaacuacaaaauuuucugauauuacauguuccagguucaugcugacaacugccaacuauccuacuccaacugcaaguccugggaaucuuuacacuuaacaagaccaaaacugagcuucacauuauuauccacugugcaauaaaaagguuaccacagaaggccugaggcugcuauacuuagaaaggccugcuugcaagguuggcccuugguuagugucuagaaacuuggauuuuuggaggguucccaccauucccugguaauaguggcucacugugccuagacuguacaaacaaugcaauuuaggcugaauaccugcuuucuucagagguugugaaauuuugguaugugcuagauagaggauaccuacaugaagagcucccccaacuccaaaaacacaccuuggguaccaggucucuaauggaucucccugggcagaaauaucacacauauguugcugcauuuucacuguugagagaagagugcacucuguguaaccucuuaagggaaggagaaaguauaagaaagccugcacauagauucuuccagacucugcuguguccuuuucccuuaugaucuggcuauauacauccuugcuauauuauagcaauaaaucuuagcugaguacaacuacaugcugaguccucugaguccugcuagcaauccccaaauacgggagucaucaugagaacccccaacaaagccacauaucacauuaucuugugaaaauaucaauacuuaacauguccaaaguaauuuugagggaauaaauuguuuuucuuuaaaauaggagaggaaacauagggaggaacauugaggagaguaaaaaauuugaaaagggggauuuuucuacugucagcacugaacuacauuuaaacuauauuggacacugaacuauauuuggacauuggaauaaugucauuauuuacccaacauaauacacugucuaaucuuuucuaguaaguccugcuagacuaguagaacacggucugagauggggauauauaacaagagugcuucuuggagcaaauuuaaucagguggcuuugguuuagauaauccuaguugaaguaauauccuaugguauucuagcagcuucuaaaaccagcaauaaaaagacaguccucauaaaaggcuccaaggacugaaacucucaucacaucaguauuagugcaacuuccagcaguaacaagaauuaaaauauggaaaaaggagcuucaaagaagcagacaggacuucuccaauauucuccugaacauccccuuacaggggcaacaucccuggguaccacaagcccaacugcucgauaaaauugauuaguaggaauaccugcuguauccuuauccgaacuacagguaguucuggaggaugcaauggguaaagaggaguucauaugagcuaaaagaaguucugggagacuugcaguagauuauuuucuucucuagaucugaggcuggaaaaauuuuuguuaggaaaagcaaaaagauuauuaauaguucuagagaaagccaucuuucuccuaguuauguuacacagagcuggauauacucuaucuuugggaguugguuuuuggcccuuggaugguaaaagaaauggcucaggaauaugaugauauaaguaugaauguggcuaaaccuuuaaaagaaaaagguaaaaaacucacugaaaugauaugaaaucugcagucugcuuaaaaauaauugggaggggccgggcgcgguggcucaugccuauaaucccagcacuuugggaggccgagaugggcagaucacgaggucaggagauugaaacuauccuggcuaacgcggugaaaccccaucucuacuaaaaaauacaaaaaauuagccgggcgugguggcaggugccuguagucccagcuacucaggaggcugaggcacgagaauggcgugaaccugggagguggagcuugcagugagcugagaucgugccacugcacuccagccugggcgacagagugagacuccgucucaaaaauaauaauaauaauaauaauaauaauaauaauaauaauaauaauaauaauaauugggaggaaguaggggaagaagagauaaaacaagcuuggccauuuugauaacuguugaggcaggcuaaaggguagaggggguuucauuuuuaauuauucucucugcuuucauguuuuuaaaauuaccauacuuuucuauaaaguaaagaguuuuuauuuuaagaaucaagagagucuuugagcuuucuauaacgucuagccuagcucaccaggacaggacagcaaacaagaaucaaggcagcaucccuagccaggggcggggaaaaaaaaguugucuuucacuggaguaccucaggacucaaauacaacagcaaacuaccgaauguucuuuaggucggucaaugaaaaccaaaccccuaacaacuguuauuucaaccaaaaucuguuucuuucccuguauucugaauuuuaguuaauaauaccuagucuaauucuaggccuaaaaccacagaaucacccuuuguccaaucucuccaaauccaaccaccaaauuaaagcaauccuaacucgaaauaccuccugaaucugucuccucucuauccuauggccacagaauucaaguuuuccacaauuuaagugcccugacuccaaacuucacaugugauuuccuaagcaucccccccauacuguuacuaguugcauuccuaaaacacaaaacugacuacaccacucccuugcaacuacuuuuaaauacccaauggguccuuaucaccaucagcaauaauucucaacuagucacuugaagaugagauagaggaguuuuuagugagaauacacuccuagaguauauacuugaaaaacauuauacaaaauuucuccugguuuggucugccuuugguuaugauagcuauugguuuaaaacuuaaaauaacucugaaugcaucuggaggccuguuauguuuaugggagugguaauggguuguaaguuuaaaauagagaagaaacauaggccuccaggauuaaaucccagcuccuuugcauagcauacaaaauccuucucaacugaccuuaauccauuuuuuaagucucaucuuccauuacucuuccccuccacaaacacagaguaaaccuucagaggauucuucugguuucugaacauauguucacuaacucauguuucugguuuugcauguucuauuaccguuuucuagaucacgacuguucaaaagaaaugugagccacaaaugcaagcuauacauguaauuuuaaauuuucuugucacauuuuuaaaaagaaacauguauuuuauuuaaccaaauauaccuaaaauauuauuucaacauauaaucaauauuuuuaaacuacugagauauuuuacauacauucuuuuucauacaagucugaaauccaguauguauacugcacuuacaucacaacucaaucugggcuagcuguguuucaaaugcuaauagucacaugugccucgugguuaccauacuggacagcacaugucuaggugucuuccccuggccuaccuagcauacacuauguacucaccaaaugaauggucaacuacaccuaaccucuuacauucuguagaggucacucaucacccuacuacagcuauaauucauuuauuuauuuauucaacagacuauguuccaucuucaagugcaguugaugagauuccucuaaacuggcuuuccuguccugaguuccaucuuguguccucugcucucuucaccacuacaucacaauuccaauagcaccuaucucucacuacagcagagucagggaagagaaaaggggaggcuuguucuaaagucaucucaugugaaaaaugucauuuaguuuaaaauuucccuugaaaaucccuuaaagagcuccuaacaaaaacaggguauaugaucuuguauguacauuguaaagguccagaagaauugagacuagccaugagaacagcauauucaucuauuccauuccauaucuacuagacuccaaaagcucauuuaguagaauggcagguggauuugcuauugcuguuagaaaucucccugccccuccaaaucacacaguggaauucauauaacuuaaaaccccaacacaggguaucucuauucaucacuccugucuccucuguuuauuaugccaaacacucuaccucagauguucuguucuuuuuguuacacaaguguuaacuauucuaucauuuagguuguucagauaucuacuacaucaggcuggaagguggcauguagaguaaaaagagcaugaguuucauauucuaguuuuguuaccaccugugacacuuucagcaaccuuuugaaugagaauauuaucuacaugcaguccucauaguuugugaaguuucaguaagaaacacaaaacaguguuaauuccauuccauuuacccauuucuuccauuaagucuuucgaaaccuuuccuuugauacagagaucauuuuuuaacuaaugaggaaaauuguacuuuuaggucacaucugaaacaguucucaauuaaaaauuaauauauaugccauaaagaagugucaaaucaagauuaaccacacauauucucauuaccugcacaaauuuggguggaaauuuuugucugaggucuaaaaguaaagcauccacacguugucucugaaaaauagagcuugguucuucuuuccuuuuggcuuuaggucugacuuuaucuauuaaaauacgaaguccaaaucaaaacauugccuacuuaguuuggugucucauauuuuacaaaucuuuauccaccaugaauauacccaaacuucauuauuuuuaauggcugcuauaccaaagauaauucccaaaauaagguaaacacagcacauauacagaaguguuguuaacucucccucuuaacugaaguuaaauucuaacauuuaagcugauacauaugucuuuuaaagauacuucaguuuugguauauaagcacgcacaaccguaagaguuuuaaagcuaaaguuuuucauaauuaccuaaaucacacaauccaaauuauuggcuugaaauuaccuuuguuauuuuaaguguauuaaauggucuuuucucacaaaaccuacuagcaacaaauggaaaugcagguuucacaaacucaagcuaccauauucaauuauuaagacuguaauucacuaaaaaaaaauaauaaaacagaaaauuaugaagacaaaaaagaaaagaaccugaaagagaaauucugaaguuaaucgcaugugggauuugcccuugggagggagguguauugggaaacugucucuaagcaaaggauuccagauaaguguuacuccgaacacuugguuaucguaggggaaaagagccauugggccaauuuuagucaacaaaggcaaacuuuccuucaucaaauguuccugcuuauaccuacuauuaagaagauacaggucugaauucuauacaaaugcuguuucccucaguaauuuauucugacuugcuauuucucagaaaaggaaauggagaauacaaguaugcuguuacaggcacauuucuggagguagucgaacaguaaaauaugaugaagacaguagcagauuacauggaaacuuggaggaccuggagccacaagaggugaugagaugcaaagaucagaaaacagacuggccaucuggggauagggcucuaaaaagcaaucucucucaucuccucugcuuugaagacuggaggaauaaagaguuccagauaccaagauaacucaacagucagguaaguaaggaauaucaucucugcucauuccacaccacugucucuccuauguuccuuuuuuuuuuuuuuuuuuuuuuuuuuuuuuguagagaccagguuucacuauguugcccaagcugaucuugaacuccuaggcucaggugauccaccugccuuggcauuccaaagugcugggauuacaggagugagccaccacaccuggccccaaauauuuuaaaaccuugaaucaccuuaacaaagacuaccaguuaacuaacagagugaacuugcaucuguuccuaugugaaagcuauuauuaccacaucuaguuacaugaaucucagcugcaacaaagccaucaucccaugaaaaagugaaacacacuuagaaaagaucaacagccauuuuccuaaagaaaacagcuucauucucagaggaucaaaaaguguuuuaggaggguauggauguucuacuuaccuugcucuucaugaucuuugaagugccaccaauacccuuuggaaggaugauaucgacaguaugacauagcuucaucaaaagcugacugaauaccaugcacugcaguaagcuuguaaaaggaaaauaaacucuaaauuuaucauuaggucgaccaaacuuuccaaaguaaauacucacaaaauauuacauaugcaaagacagaaccuauuuuucagaaccuaaauuacuauauaauugagacuaugaaauauacuuugagcaccgacuuggcucacaguaaccaaaguucaagacauucuaauagucaauacuuuauagcaacuuacacaaggcagaggagcucuaguuugauuacuggaagcaagguagcuaauuaaaaguuuucuuuagugcuuaaagaaugugaagacacuuaccacucuagaguuuauaacugaucccaagucuggugccugauagaucacuccagcaaugauauaguaaucagcuagugggauaacuaaaacagugggaaaaaagguuuauaaauacagcuauggacacaaacugcuaaacagauucucauaaaaagaaauaaaaucugacauuuucccauaaggcaggguuuagcaauuacuguuuugguaaagcuguacuagaaaacagccacauccaaucauuuacauauuaucuauggcugcucuggcaauaauugagcauugucacagagacuacgaggcccacaaaccccaaguauuuagucacuggcccuuuucagaaaaaguaugcccacuguugcccuccagcagugcuucucaaauuuuaaugugcaucugaauuaccuggggaccuuguuaaaauuagauucuuauucaguagggauagugcauuucuaacgaguucccaaaagaugccaauacuguugucagucaaccuuacuuaagggaguaagaccuuggagcaagacagacugggggguccaguguaaagauaucaaaugcaaugagcuugcuuuugugccccagugcuggguccuaaggaauaagauagcugcuagugaggcuacugccgucuuguguaauuuuuacaccuugaauccucucacuauggaaaucuugucuugucgcugguuugccuugguucuaagguucucuuuuacucugggcagggacucuagaucuuugauuuuguaacugauuuuggauuccagaaucacaacuucuuuaucaagucauucucugaaaacaaugccaaguuaaagauuguccauaaaugucuuaaugaggguauccaauugagagauguagcuagaauaacacccaucuggcuccccuaucuugaaucuucucuucaguaugacuuuauccauggucuugccuugauucuaaugucuucaauuucuggucaucgcuggaaaaggugucuagcucuuugauucaaaaccaaaucuggacucuacacucuucaguguuguuucuaaaccaagcuuucaguagguaguauaacccacgcaaggcuuuuaguugaaugcaucacugaggauuuucaacugauccucuauuaauuugauaugaccagaucuaccaugcauuuuguaaaagaauuaacucaguggacugaugugaaaaaaaaaguuaauuguggucaucagcaaagccugaguccuguccucucacucuccuccccagacagcaugaguuucaccacucacuccaccuucuccaacuacuggucccugggcuccauccaggcgcccagcugcggcacccagccagucagcagcacggccagcgucuauacaggcaccggaggcucugguucccagaucuccgugucccgcuccaccgguuuccagggcagcuugggguacaggagccuggccaugggauggccaggguucuagcaggaaugggaggcauccagaacgaggaggagaccaugcaaagccugaaccuacccugguucaaugccugaccuccuaccuggacagagugaggagccuggagaccgagaaccagaggcuagagagcaaaauccaggagcaccuggauaagaagggaccccaggucagagauuggggccauuacuucaagaccaucgaggaccugagggcucagaucuucucaaguacuguggacaaugcccacauuguucugcagaucgacaaugcccaucuugcugcugauagagucaaguaugagacagagcuggccauguaucagucuguggagagcaacauccaugggcucugcaaggucaaugacaccagugucacucggcuucagcuacagagauugaggcucucaaggaggagcugcucuucaugaagaaccgugaagaggaaguaaaggccuacaagcccagacugccagcucuggguugacgaugaagguagauacccccaaaucucaggaccucgccaagaucacaggagacauccuaauacgaagagcuggcucagaagaacugagaggagcuagacaaguacuggucucagcagauugaggagaacaccacaguggucacuaugcagucugccaagguugggguugcuaaggugacgcucacggagcugagagguacgguccaguccuuggagacugaccuggacucgaugagaaaucugaaggccagcuuggagaacagccugagggagguggaggccugcuauacccugcagauggagcagcucaacaggauccugcuguaccuggaguuggagcuggcacaggccggggcagagaggcagcaccaggcccaggaguacaaggcccugcugaacaucaaggucaagcuguaggcugagaucaccaccuaccgccgccugcuggaagacagccaggacuucaaucuuggugacgcccuggacagcagcaacuccaugcaaaccauccaaaagaccccacccgccagguaguggauggcagaguggugucugagaccaacaacaucaaaauucugagacauuaagccagcagaagcaggguacccuuugaggagcaggaggccaauaaaaaguucagaggucaaaaaacaaaacaaaauuacuugggaugcuugacguucagucgguauaccaacugugcucacagaaagagguagcuuugaugcagugagucgcucugacuguuagugcuugaagaguuguccuugggcaugcuccaagaguccugguauccaaguauacaacuaguggaacuuggcuuuugaaacauuuccuauaugauaguuaggcugguuguaccagccuuugcagacaauuuguacaaacaaugugauuauaguagacaccagauuucuuuuggaaaaucuaaaaaucuggugggcagaggauguccaagcaaccaacccucuauaaaaaucccuggcucagagucuuauauggacuucccugagcagacauauugaaugcagcugcauuucacugcuggauggagggcacacucuguggcccuucacaagcaagagggaaagcauaagaaacuugcacauggauuccuacagaccccaccugacaugucuuuuuccaguacuaaucuggcugcguacccuuacuguguugucauaacaaaucuuagcuguaaguacaaccauaugcuaagucuggugaguccuccagcauaguacugaacauguauguggucuuggagaccccccaaacagaaaccaaucaaaaaaacaaguuaggucaggaaguaaauaaauuaugguauuuuaaaaagaaaacaaugccuaaaguuuacacauuuuaccuugggcaggggacugccgcuguugcuuccgaaugaugaaaagaaugggcucuugagcaugcaaaaggauguacucgauuccaaccaucugacugaaaacagaacacagacauccaaagaucuauaaacgcccuacaaauaauuuuauaagacauucaaauuauuauauaaaaaugcagcaacacuuuaaauaggauuaaaacugccuauguuugguguuauaaucuggcuguugaguaaaauuggcuguuuucccagacagguggcauauagauaaaguaagacuuguuucuaaacaacaaaauuucucuacaacaauguauuauaaauuuaaaucuaaguauuuucagucaggaaaguacaccaaagaguguccguuucaaaaaggcaaucaaaaugccaugaugcuuccugaccaaaucuacgaauacauacaaaauauaaaaauaaacaugaagacacaacuauauauauuaccaaacuagaaaacaucaaaaacuuuauccucaucccaacaaauuuuuuuaccugacagauuauguuuaaaagcaacaauaaguugucucaauagcuguauuugccccauaacaaaagccauuuaaaauauaacagauauuuaauuuuauaagcuccuccucaauauguagcuaacaggaaaauuauaucaacaguuguuucaaauacuuuuguaauauaaacuagauauaaaagagacaauaauuauaguugccugguugagaauaacaguagcauugccaaaaucacucaucagauccaaaucuaaaccuguuauauuguaauuaaacauuaugaaguuauacagaaaagaccucuguuaaaagugaauacuaauaguuacccugcaugucaaauuugcauaaacccaaacaaaacuccaguuuuucuucuaaaaguucuacucugcacuucaugauccacaguuugaaagaacuguucauugcaaaacuuguauuuggaaaaagugccaccuucuuaaaauaacuuacuucaaguguucuaauguuagccucugcauuuugaccacuucauuauuacauguucugucauaaaaaggauuacuucuuucugaaaaguaauccaggacacuaccacuguucaaaauagggauccaagagcugucaacccaagaaauucccagcagauugucuaugggaaagaaaacaaaaugauaaaggauuagaaaaauagaaagaauccaauccaacaaacauuuauuauacaucaaauguaguaggcacuaugaauauaaggaugacauagauccuaaccaacacacucucaugauguaacagaagagauuaugcaagaaagcaauaacaugauuaagucuuaugauaaagacauggugaaacccugucucuacuaaaaauacaaaaaauucuggccgggugcgguggcucagccuguaaugccagcacuuuagggggcugagguagguggaucaccugagguugggaguuugagaccagccugaccaacauggagaaaccccgucucuacuaaaaauacaaaauuagccuggcguguuugugcaugcccauaaucccagcuacuugggagacugagacaggagaaucgcuugcacccagaaggucucggagauuguggugagacgagaucacaccauuggacuccagccugagcaacaagagugaaacuccgucucaaaaaaagaaaaaaaacaaaacaaaaaauuagccgggcauggugguggacaccuguaauccuagcuacucgggaggcuguggcaggagaaucacuuggacccaagaggcggagguugcagugagcugagaucgcgccacugcacuccagccugggcgacagagcgagacuccgucucaaaaaaaaaagacaugaagaaauguguuacgagacuacagaggaccuggggaaacgaaaaucauuuuucauguggagagaagguggguuuuagcacgguauguuaaagaauaaauaaaaacuuacacagagaaaagggcaaaguaauuccaagcagagagaauguauauacagagguguaaaaauauaaaguauauuauaucuuuagagaauaauuucauuaggugaagaagugauaagauuuaaaauuuagaaaggacuuuuuuuuuuauuggaaauccuuaaugcuggcaaggaauucaaaauuuucaaauaacauguaugcccaagagaacacaucuauagcuaccaguuugagaucucucaauuagggauagagaaguuaggaagcuauuauuguagaugagaugauaaugauguaaaagcuaagggauaaacaggaaguagaguucccuuaacuacagccacacgguuucauauuuagcguagaauuaaaucauagcuuuuaaaaagacaugauagagcuagauacuuuuaauaaaugagcuuguauuggcuauuggcuuucaugaugcuucauaccacugacuguacugaacaccacuagguguaaaucaugaacaucaaaaugccuauacaauacugguugaaaaacuucaaucucucuuauacugucauuaccucaggcaucuucaaagaagucagaccuaauucaaggugacaggcaguuuugagccaagugacucaaccgagaaaaauuauauaaagguaaaauguacuuugugugcuauaaaauaaaggaggagacagaugaagugcguuaauaaccaaauaauuaguauagaccauuuagauaguucaucauaacuggaucaugcaauaaccaaauacacaacaggccaggaaauaacauuuucagaaauggccuccuaacugguuuuccuaauucuacccuugcccuccuacacuguucccagcagccaauguaguccuaaaaaaaagucagaucacaucauuccucugauggaaaccccuccaauggcucugcguuuuacucagaggaaaagccaaagaccuuaucauagcuuucaacaccuuucugacuucaucuccuucccacauccucucucacuacccuccagccacacugaccuccuugcuguuccuuuaacacaccaaacacacucuuauuuuagagucuuugccaugauccuaacaaucugaauuauaaguaaaacauuuuauaaacuaaauauuucucuuuuuuauucuguagcaaggcaacauguugacauagcccaagcauucuaacagcauucuaaccaucagcaagugaugaaauaaauaaugaaagacacguauguaaaaucaugauccagaagugcugcagaucgccagauaaguauaaaugagaauauuuguaauaaauguguuagaccccaauccaguuaauauuaaaaaaaggcaucucaaacaucucccuuuaaaaaucaaguacuauauacacaaaaacaacucuacaugcuccccaagaucaagcagcaguuaaggggugacaucuccauacauuuauucacugacugauucaauauuugaguacuucugcaguucagcugugaaaaaaauacgaccccugcccauaauaauugcuggacguucgauguaaaguauuaucgacucaaaaaaaaagaaaauaucugggauucaugcucagggacccguguggcgcggucuaaagaauuaggcagccaccaugccaagucccaagagaugaaucaaaucaaguuggcuuauuaccccauucccuucucugccuaaacgccauuccuucacuccaauagaauagcccuaauguuguugcagagauacguguguagaacaaaacuccagcucugaaagcucaaaacccagagcuucuuccaaccccuucucuccgacgcuuccaagagacgcuccaagaacucagaaaaaaaaaaaaacucgucaacguuucgcuagaucacagccuuggguuguccacaaaaaccacucaaaaaagcuugagacuucacacaaaggaaccuaaaccuugaaaccgcgagcuauaacaucccaaacugguccacagacaaucaagagacaaaauauagcaauacaguauaccucggauauccaccgccgccauaauuccgagagcguuuacagguucucuuuc

SEQ ID NO: 192370 - RNA, 33318 nt, Homo sapiens
augagaucgucccuauugacgucgacagacagaagccgcguccagugagaaggaaagaacggccgcuauagcccuaucggcugcuacaacaccaaaacgcauccaccuaacuggcugacgcuacaccuuggucuuuccggguccuugcacgcuucgcuccaacuccugcagagcugagccggaggggaauccggaagggacacgcugaacagguaagacugugcugccuggggugccuacuggcaucgauucgagggcugccgcgcucccgcugcagagcucggggugggagacaggcgcggcgaggaaggccagggaaaggggcggggaggggcggggaggagugagcacguggaacgccggcgccaccgggccuagguggcagcugggccggcgcgcuccgcccguucuggggcgcguggggcccuccggccggaucagugcugcaaccguaaacacgcagggagggcaccccgagugucgccgcugagggcguuucucuaagcgcuucucugagaccugcugcugaaggccccacccgacaccuggcgggggcugggcugcgggccuuggggcgguguccccugugaauguucaggucagcauaacagguuaggugugguugaagcuuacgaaguggccggcucugugcugccggcuucacaggcgcuaacauuugccagcgcuaugauguccuugucagacgcagaaaggggugcaguuugguuguccgucgggguagcgcacaacuagcaagugauggggccuggguuuggcccucgccuccacucugaguugugaguuagcgagaaagccacgccucgugggcuccccgggggcuucagaaaccaugacgccuuucaccaugguguucuacaggcauugucuugugacuccagcagcgcagccagaagcaaagaaaacugaggggacggcuuccuagaggaaacaauuccaaagucccaaacucugauuuuaaauaacgauggaaauuagagucgcggugguguucuuuuuuuuuuuuuuuuuuuuuuuuuuuugaggcggagucucgcugucgcccaggcuggagugcaguggcacgaucucgacucacugcagccuccgcccccgggguucacgccauucuccugccucagcuucccgcguagcuggggcuacaggcgaccaccaccucgcccggcuaauuuuuuguauuuuuaguagagacgggguuucaccguguuagccaggauggucucgaucuccugaccucgugauccgcccgccucggccucccaaagugcugggauuacaggcgugagccaccgcgcccggccugaggugguguucuguggguaaccaggccuggggguccuaccaacagagguggaaucccuguuccaccauuuaacuuacgcugggugugguaccuaguccuguaagccuguuuccucauuuguaaaauaggauugaaaauaccaacucagggugggcguuaguacaaagcuugcgccugaaguauuucuuaaauaaguguuaagagaaaauuuuguuguuuuuuaagucagcugucuaaaauguuguuuuacagugaacaacuccuaacugcugggauuauaggcaugcaccaccacacccggcuaauuuuuaaauuauuuguuaagauggggcggaggggugucucacuauguugcccaggcuggucuugaacuccugggcucaagcuauccucccaccucagccucccaaagugcugggauuagaggcgugagccaccgcccuggccuguagaagcuacuuuguauucagcuuuacagaccaguggcguuagcguuuugcacauuacagcccgcuagucuacagaauccccccacuuuuuuuuuuuuuuuuuuuuuuugauacggaauuucacuauuguugcccaggcuggagcacaguggcgcgaucucggcucaccgcaaccuccgccucccagguuuaagggauucuccugcuucagccucccgaguagcugagacuacgggcgcacgccaccgcgcccggcuaacuuuuuguauuuuaguagagacagguuuucaccauguuggccaggauggucucacauaucugccgaccucgugauccgcccgccucggccucccaaagugcugggauuacaggcaugagccaccgcgcccggccagucuacagacucuuacaaaauuccccuguuguuggauaucuaggauguuucucacuuuaacuauuacagcaugguguaguaaacauccuuuauauauauauauauauauauauauauauauaguucacauacccuaaaauuaacuuuuuuaaaaggguucaauccaguggguuuuuuuauuauuauauuggcaagauugugcaaccaucaccacugucuaauucuggaacauucucauccacccaagaagcaaccccgcggccccagggugccccagucucagagccccgguuguugggcuccaguccaggcccccuaaccaugugcuaaacaagauggugaggcucagccuggaaaccagaacagccccgaggcccccaaacuggagagccccaaggggagauggagccccucccccauucugaguuuuggccccgugcuaaggcuggaccgacccccugugcugucaagccuaccucccaggggaggcgaggccagccccgaugugugcgggcugccaucccccacacuuggcuccggggcuggucgguguugggcgucccagcacugcgggcggcacggacgcccggggcugcucccuacuggguguagcgcaccccgccccccaccccgcccggccuccucugggccugcgccuugggccuauugaggccaggccuggaauggugcccuggaagcaggaaagagccuguaauuccggaagcugcgggcucccaaaccagacaccauuuuggagaccggugcaaaaaugugugccgcuuuuguguggaaaacugcuagacugugagagagagccgaccuccucaugcaugaaccuuuauagagggugguccacauauucugugcacuacauacacauacgcugggcacauacuggcucucuguguuaaaucucagauuugcugccgcgcgugguggcucacgccugucaucccaacgcugcgccaaggcaggaggaucgcuggaggccagaaauucgagaccagccugggcggcaacaaagcgagaccccgucucuacaaaaauauuuuuuauuuuuauuuuauuuuuccgucaagcuguucuuuauuucaggaagagggcaggggagggggcucagucuuucuuggcagcggcuuuccucauggcagccaguaccuugcucagcuccucccgcuuccucuuggcacggaugugcguccccacccuuuucuugaugaacuugagggcccauuucuccuugaagaccuucagugacuccauggcgcgcagcucguacgaagcgaagccacacaccucccggaucaugucccgcuacaaacuuggugcguuugcucagacgcccgcggcggcggcugugccugggcuugcucacguucuuggucaccuuguggcccuuguugaggcccacggccauaagguagcgcagagccauggcugcugcucuccauggcggccguggcggaaggccaaaaauauuuuuuaaauuagccugguguuguggcucgugccuguaauuccggcuacuccgagguugaggcaggaggacggcuugagccggggagauggagguugccgggagcggagaucgcgccacugcacuucagccaaaagggggguaggagggaauaaguaaauaaaauuaaauaaauaaagugguaucucacugugguuuugauuugcaucuaccuaaggacuaaugauguuggguaucuuuucaugugccaguuggcuauuuguguagcuuuuucuuuuuuuuuuuugagacggaguuuuuuuuguuuguuuuugagacggaguuucgcucuugucgcccaggcugcaaugcaguggcaccaucucggcucacugcagccuccaccucccggguucaagcgauuguucuggcucagccucccaaauagcugggaccacaggcgcccgccaccacaccgagcugauuuuuguauuuuuaguagagacggggcuucgccauguuuaucaggcugggcuugaacugcuguccucaagugauccgccagucccagccucccaaagugcugggauuacaggcgugagccacuguguccggcccuaaauaaugucuuucgaugcacggaaguuuucaauuuugaugaagcccaauuuauguguguauguguguguguauauauauauauguagugugugugaguuuugggugucauauuugagaaaucauugccuaaucaagaucaugaugauuuauaccuuuguuuccuucaaagaguuuuauaguuuuagaucgagauccauuuugguucauuuuugucccauaugguaugaaguaaggauccaaauucauucuuuugcaguuugauauucaaaugucccagcaguugaaaagacacuucuuucuuucauugaauggucuuggcaccuagaugaaaaccaguugaccauagauaggcauauggguuuauuucuggucucaaugcuacuccauugaucuauauuucuauccauaugccaguaacacagugucuugauuacuguagcuguguaaugaauuuugaaauugcgaggugcgagucaucccaacuuuguucuuuuucaagaugauuuuggguauucugggucccuugcauaauaugaauuuaggaucugcuuuuccauugcuaaaaaaauggcauuuggaauuuugauagggauugcauucaaucuguaauuucuuucaacaguguuuuauaguuuucuguguacacgccauauauuaauuuuguuaaauauauuccuaaguacuuuuucucuuuuuuuuuuuuuuuuuuguaacugagccugagcaggaccagaggagugcuuuauucuuuuugaugccauuguaaauguaacuuuucuuucauauucaggcuguucauugccugaaccaguguauagaaauacaacugguuuuucuauauugaucuuguauccugcaaccuugcugaauucauuugugagguccaguagauuuuugguggauucuuuaggauuuucuguauauaagaucauguuugguugccuuuucuuugucuugccuaauugccugucuaaaacuuccacuacaauguugaacagauguauugagaaccaacaucuuugucuuauuccugaccauagagggaaaacuuugucuuuggccacuaaguaugauguuagguguggguauuuuguagaugcuccuuaucagguugaggaaacuaccuucuguuucuaguauguugaauguuuuuuuaaucaugagaggauguugcauuuuguccagugcuuuuucuguguaucaauugagaaaaucaugugagguuuuccccaucuauuaguaugguauauugauugauuuucauauguugaaccaaccuuauauuucugagauaaaucgcgcuuggucuugguauauaauucuuuuuauaugcuccuggauuuugcuugcuagcauuuuguuaaggauuuuugugucucuguauucauaacccauacugaccuauauuuuuccuucuuuuuuuuuuuuuuuugagagauggagucuugcucuguugcccaggcgggagugcaguggcaugaucucggcucacugcaaccucugccucccagguucaagcgauucuccugccucagcuucccaaguagcugagacuacaggugugcaccaccacgccuaacuaauuuuuuguauuuugguagagaugagguuucacucuauguuggccaggcuggucuugaacuccugaccucaggcgaucugccugccuuggccucccaaagugcugggcuuacaggcgugagccacugcacccggccuugaccuauauuuuucuuccuauaucuuugucugauuuugguaacaagguaauacuggccuuauaaaaugauucggaaaaauguaguaaauaucuuggaaucauuuuuguaggagcaguucccagaaggaaggcauguacauuuguaaguuacuugauaaauauuuuccagucauuuuccaaaaaaccaaauuguguuuauuugugauuaacauugccuuugcagaauaguagucucuuagaaauuauaauucuuaaugccuugagguacuuaaaaguuucucugaaagacaaaggcaagcccaaccuucugcaacacaccugauuuuaacaucuagagcagcuccaaaggugcuagaugcagcauguuaccagcaaauuguuuucgagugcuuccuacauagaacagguuuucucagcuuuagcacuguuuugggccagguaacucuuuuguuguuguuuuugagauggagucuugcuauguugcccacacuggucucaaacucuggacucaagccauccucccaccucagccucccaagcaguuggaacugcaagugugagccaucacacccagcugaauaauuuuuuuuucuuucuuucuuucuuucuuuuuuuuaauguuguuuguuugagacgggaucuugcuauguugcgcaggcuggucuugaacuccuaggcucaagcaauccuccugccucggcuucccgagcagcugggauuauaggcaucagccacugcacccagcccuggauaauucuugcugaagaauguguggaagcugcccugcgcauuguagggugguuagcagcaucccuggcuuuuacccacuaggcgcuaguagcagccuaccccuccuucucccgagcugugacaaacaaaaaugucuccagacauugccagauguccccuggugggcaaaauaauccuuaagaagcacugaucuacaaacugugaugcauacuggguuuuauauuauuacuagauaaaauugucucuaauggccaggugcgguaaucccagcacuuugggaggccgagaugggcagaucacaaggucaggaguucgagaccagccuggccauuauggugaaaccacaucucuacuaaaaauacaaaaaugagccaggcaugguggcaugcgccuguagccccagcuauucgggaggcugaggcagaagaaucgcuugaacccaggaggcagagguugcagugagccgagauugugccauugcacuccagccugggugacagagcaagacuccaucucaaaaaaaaaaaaaaaagucucuaauucucacuguauaccauuaccacuuuggugccauuugucccaguccaugucaccauauccuguuuacuuucaaaucugucucuuuaggcucaauuucucucuguauucucagacccguauuucccauugccugcaucuugagauugauuuguucaaaaucagacuuacucuccucuccccaaaguguucuuccuuuauucuuagucucccugcucaugacucuaccaguuauucacuuaaccuuucucaacuccucucuccaccucucccaugaaauuugcugccuaaaucuaaauccaggcuccgcuaucccaaguaccauguccauaauguguaagcgaguucaucucaccuggcuugccacugcaguucuuacuugucaccccaugccgcugccuuucaggugcccuuucuuagcagcucuaaucaugucacuccucgcacacccagaguccucaugaucaugcccugucugccucugcaggcucaucccccccauuucuugaacuucaggcucuggccauaccaaacagccugcaggccccccgcccccacugccuuacguggcauuuucuuuuuuuuuuuuuugagacggagucucgcucuguugcucaaggcuggagugcaauggcgcuaucucggcucacggcaaccuccaccucccggguucaagcgauucuccugccucagccucccaaguaguggggauugcaggcgcccacuaccaugccuggcuaauuuuuguauuuuuaguagagacgggguuucuccauguuggucaggcuggucucaaacucccaaccucaggugauccacccgucucggccucccaaagugcugggauuacaggugugagccacugcacccggccuaauuuuuguauuuuuaguagaguugggguuucgucauguuggucaggcuggucucaaacugcugaccucaggugaucugcccaccucagucugccaaagugcugggauuacaggcgugaaccaccacgccgggcuugccugacauuuucauucuucagacugcacuuaucucccucccccaccuccagcccaggcauguggagcagucacucccuucucucccaccacaccuggagagaccugggucuucauccuuauccugugcugcagggguuggucugugcaucugucucccauauuaaacaaucggugccuccaagccagguagcacagcuuauuaucucugcccacuccccagugccucacauggagugggcgcuuuguaaauguguguggaguaguaaguggaaauaacccagagcagaaagaagcuaccugggacuuaaauguaaaguagccacagguuuuguuuugcuuugcuucaguucagcaaaaauuuacuaagcaccaacuaggucauggaugcuaggaauagaaaaaagaacaaaguaggauguuugccuuacagaauucaccucacguccaguaugagaugggaguaugaacaaacagucaugcagagugaugagugcaaacauggacuauaaagcggccauagagaaugaacuguguuuguguuuagagaagacacacuccccaccccugaacaggcuucuuaaaaguacuagaaagguacugucuuuguccuagccuuuaaacucuuacuguauuuggaaggcuucuauuaguaugugacuuuuuaaaugauuuuuuuuuuugagacggaguuucacccuuuugcccaggcuggagugcgguggugcaaucucagcucacugcaaccuccgccaccuggguucaaacgauucuccugccucagccucccaaguaaccgggauuacaggcaccagccaccacacccagugaacuguuguacuuuuaguagagacgggguuucaccacguuggccaggcugaucucaaacuccugaccucaggugauccacccgcaucggccucccaaaguguugggauuacaggcgugagccaccacauccggccuuuaaaaugauuuuugcuugaccuugcuaacuauauuacuugagguuggcaggcucccuuaccagauugcagugccuguaugaguuaggggugaacacaugcucucccuggcccaaauuggcauucgccagugauuuuaucaucggcugcguccugcugauugugcagcccccuauugagaauaauggugugagugggacacaguccugccuccugugggugaucugaagucuuugacucaccaguucguguguucuuugcuguauucaugcauuguuacauaauucaacaaauuagaaucauuucauauacagaauaugcacucuaaagaaauuuugaccuuuuuauagaguugguaauaauaauaaucuuuaugucaguagaguuuauuuuuccuaucagucuuuuucucuuuuugagauggggucucacucuauugcccaggcuggucucaaacucugggcucaagagauccucccacuucagccucccaaaagugcugggauuacaggcaugagcuacugcacgcagccauuuuccuaccagucuuaacacuggccacacgugcuucccuuccugugcgcagucccuuucagcuuguaacuuaacuauuaauaaauacaacuguauucuuuagcugggguauaagauaacugauccauagggaaacccacacaugguguucaggagccauuguuuaggacaaugaauaagauaaaaguuuuggagccgggcuugguggcccacgccuguaaucccagcacuuugggaggacgaggcagguagaucacuugaagccaggaguucuugagcagccuggccaacauggugaaaccccaucucuacuaaaaauacaaaaauuagcugggugugguggcaggugccuguagucccagcuacucgggaggcugaggcaggagaaucgcuugaacccgagaggcagagguugcagugagcugagauggcgccacugcacuccagccugggcaacagagcgagacuccaucucaaaaaaaaaaaaaaaauacacacacauuugggcugcaggggcagggauauugcuuucagagaagagagguauagacaggcaaaagagcagaucggggguuagagagaaaucaugaacucacuuuugaaccuguugggucuguggagauagacacgaagcagcauaggaacuuggugcucaguagcgauauuaggguuggagcugcaucugcauugguagaugaggugguguuaagucugaaaagaaaaggaucuaggacagaacaauggaaagcacauacagggugugugacccaggagaaaugagcaaaggauuuauuuagcaagaagaaaaccaagagaaagauauuacagaagccaaaggaagaauguagccuccuggugccacauguugcaggaauaagggcuaaaaagagaccacucacuuuggcaaguagguaaucaauagcaagagcauuuuaguagaaaggcgaggagagaggaagcucaacugcaguggguugaggaauaucgggagaugaagacauugaauucguagauguagaccauucuuucagaauaugcccauuuuuuuggauuagaaauggaacacuuacaaaugaaaaaccugggcauguuuuuaaaagcugagauaaggagaaggagacauuaacauaugggggaacagauagaugucugcaguuccugggaaggaaugaaaucaacagccaggugggaugggucucccuugaaaaggagcagugauaccuguuguccaagacaaggaagaagacaauuaguaaaggcagguauuuguggagcagaagggagugaaguuagggguuucaugccuggcaauuuuucuuuucuuuuuuuuuuuuuuuuuuuugagauggugucuugcucugucgcccaggcuagagugcaguuuacagugagcacaaucucagcucacuguaaacuccaccucccggguucaagcgauucuccugacucagccuccugaguagcugggauuacaggugcacguuacaacucccggcuaauuuuuguauuuuuaguagagaugggguuucaccauguuggucaggcuggucucgaacuccugaccucgugauccgccugccucggccucccaaagugcugggauuacaggcaugagccaccgcgccuggccgaccuggcaacguuucugugggguaggaaacuauguggucgacuaaggguaacaggaaggaagugggaaggauguugggggagugcuggaggcagcccuucccagguaaggcuugcuguggcaaaucugaugauaacccagggugggccagccuuuugcuggugcugagcaugaagcagcugccaagaagcaaacagaaaagcccaugcccacacacagagauguauggauuuuuuuguuuuucucuuuuaggaacagaaaugaauaaaagucgcuggcagaguagaagacgacaugggagaagaagccaccagcagaacccuugguucagacuccgugauucugaagacaggcaagugugccgcucuggggagccacuuuugcccagugugcuucuggcauuguacacauggcaugucacacgaucacagguguggagaucaccugggggcucgucccaaugcagguucugauucuguaggucugaggggucuugaggagagccugccuuccuaacgugcucccagggcaugucgcuuuggugggucagcccaccucacugaguagugaggagagaggaccacucucuguucuuuccuaagugaccacgaccucuggccagagcauucgccauaaagcuagagguagacguuaucugaaacaacuggaaaaccguuucuccauuuuguagacuuuuuaugcaaauaccuuuguggaaaccaaauuuuauuaauucagccuaagucucggacaaggauauacacucaugcuucgcuuaacaaggaggaaugcauucugaggaauauguuguuaggcagucgugucaugcaaacaucauagcacauacguaacacaaaccuacaugguacagccagccacacacaccuaagcuauaugguguagccaauugcuccgaggcugcaaaccuguacagcaugugacuacugaaugcuagaggcagucaguacacagugguauuuguguaucucaacauagaaaagauacaguaaaaauaggguauauaagauuuuuuuuuaaaugguauaccuauguaugacacuccugugaacagagcuugcgggacuggaagucagugagugagugaugagugaacacaaaggcuuaggacauuacuguaugcuaguguagacuuuaaaacccuguacaccaggcuacauuacauuuauuuauuuauuuaagagaugaggucucacucuguugcucaggcuggucucaaacuccugagcucaagugauccuucugccucagccucccaaagugcugggauuacagacuugaaccaccacccaggccaaggcuacauuaaauguauuuuuaaaauaaaguuggcugggccgggugugguggcugacgccuguaaucccagcacuuugggagaccaaggcagccggaucacuugaggucaggaguuugagaccagucuggccaacacggcgaaacuccgucucuacuaaaaauauaaaaauuaucugggugugguggcacacaccuuuacuacauccuucagccuauaauucccucagaagcuacuuguggauuuacaaaucaaguguuuuagccgcagcucuaucccaguguuacugaacuaaucaccucugucccccaaaccccaguuucucugucuguaagauuguguagucaaguaaaauuuaaacucuuugugcuacugaauccaauaaagaaugaaauucaccuagccuuguaacugcuguugugcugacaaaugagcccagcugguaaaauucuuauuggcagagauuucuauuuuuccuuuuaaucuggaaaauuccacaagaccucacaaaaugcgcgagugagaagauaagaagagggaaucacugugacaucuguccucuuuuaaagaaagaaaaaagaaugaaaaaccaaaaccuugcccuauuuuguuguauuugcaagaggggaucagugcuucucaaguaaucagaaaggucagagaucagaggugaaggcugcagaacugcccgaauggacucccugcccccgucagaauggcuggaacucaaguccugggcugcaaguuaacacagcugugugucaacaggucugacucccgggcagcacagcccgcucacgauuccggccacggugaugacgagucuccgucaaccucgucuggcacagcugggaccuccucugugccagguaaggccacuugcggggugggaauccuggcccuugcacacagggaaggcugagacccguuccuggcuuggaaggaauuccaggagcaaauugaaacacucagggaaggagcugggugcgucaggaaugguggucaugaggcaaaccgccucccccaggacugagcacaguccaggauguugccugacaaggcagcucauccccgcccucagaaaagacaggcagccacgagguggggggacaggccacugggcgcccaacucagguggucaguucacagugguugaaauuggugcauuuaauuuuuuugucuaaagagcuaccuggguuuuacuuugacccugaaaagaaacgcuacuuccgcuugcucccuggacauaacaacugcaacccccugacgaaagagagcauccggcagaaggagauggagagcaagagacugcggcugcuccaggaagaagacagacggaaaaaggugggcuccucaccccuucgcccccuguccucuccgcuccugccagcaccuguccauccacuguugaaaagggugccaauuagaugccccugcgacacuuagcagaggcacuucaggggguguggcccuagcuuuucccugacaggaagaagacaagaauaagaacagccaagagcccccuucuuccauccccguuuucuuguucgauaaguuguuuuuuuuuuuuuuuuugaggcggaaucucacucuguugcccaggcuggaguacaguggcaugaucucagcucagugcaaccuccaccucccagauucaagcaauucuccugccucagccuccugaguagcugggacuacaggcacgugccaccaugcccagcuaauuuuuuuauuuuuaguagagacaggguuucaccauguuggccagguuggucuugaacuccugacuucaagugaucugccugccucagccucccaaagugcugggauuacaggcgugagccaccacacccagccuucuucagcaguucuaacauuuugucauuccugaaggaaucuugggaggcagugugauauaauuuuaguaacuguuuuuugggguuuuuuugagacagggucccacucuguugcccaggcuggagugcaguggcgccaucucggcucacugcaaccucugccucccagguucaagugauccuccugccucagccucccaaguagcugggauuacaggaaccugccaccaugcccagcuaauuuuuguauuuuuuuuauagagauggaguuucaccauguuggccaggcuggucucgaacuccuggccucaaguaauccgcccaccuuggccucccaaagugugggauuagaggugugagccaccaugcccaucccagcugucuauuuuaaauagaagaccaggaugcaugguuuggaauacaggccaucuugucuguuugcaauacagaccaacaggucuagacgcuaacauauuuuguugucaagguaggcaauggaauguaaaguuccagcccugggucaccacggguggaauggagaguggugcagaccuguuugcagucccauugcugcacucacgcaccugguggcuucguccccccggguguauguggauggggagcgugggcagaguugacgagcagacuuucccacucacacuuucuucugcugggccuuuccucuugccgaggaagggagacuuggaaaggacaccgucagauuuuuaugcauauaauuucugccaauuuagugccuguuuccuucauuacauccuauggaacuaaaaacauucuccaucauccccuaacaaauaaaucuucauugaauuguucucuuuuuuguaauaaauauagauugccaggaugggauuuaaugcaucuuccaugcuacgaaaaagccagcuggguuuucucaacgucaccaauuacugccaguaagacaaugccucuuuguuauguuuucuucaugaauguucuuuuccuguuucuuauuuucaugguauaagaauccagucuggauagaccauguggcuaccccgugaagcaccugcacaguugaggggcuccaguucacacccugccuucugcugcuuaaacccacccugagaaagcuguucucucuagagcgaaggcgggggacucuugcaggaggauagggagagaggauggggacguaggcagagaugucuauucucuguuacucguaagucauucuaguagaagcuccuacaacuucauucccaugacauuucugcauccuucuuucccuucuaaugaguugucaccaacaauggggcauuaaguggauguguguguacuaaaccuuaucaaaguacuuaugauggcugauacaauucuaacuaaaacccugugaaauaggccgauacuuucccccauuuccugaagaagagacugaggcucagaguggagugauuugcucaagguaaagcuagaaguggggaacugucugacuccaacaccugagcgcccagcgcugcgucuccugcccccacuguacaugcucaagugaagaaccugcauuugaggcagcuuccuggggcacagcccucggaccuuggagcagggccccuucagggaaggccagaaacaccguagguaucaggcagggcaggccccuccuguuuuccuccuucugagacagaaaguuaaaaaucuaguuagaucuguuccucacccugcgaaacaagaggcggccguauccuggggcucuucccggcagccguauccuggggcucuucccagcagcggagugcccuccagaccauuguuucaucucccgcacuuucgucaucucaggggaaggagcuguacugaaugaugcagacacaacucccucuaacucccacucuuugacucugcaaaugggccacccacuucuucauuuucaucuuccugagcguucuguggggaaacucaaauucggauaaucugggaucuugcucagcuccauugcugagaaguacuguggagcaggcugacgaggagagaugggcgucagcggggcagggaaggccagagacccccgaaucuucuucauggaugucagcuucagcauccaugcccccacccucuguuucugcaguuuagcccacgagcugcgucucagcugcauggagaggaaaaagguccagauucgaagcauggaucccuccgccuuggcaagcgaccgauuuaaccucauacuggugagugggagggggacaccugccuaggguguggcugccacccucuggacacuuuguggcuuagcguugccagucaucaaaccuggcucuggagaagccaacugcaaugaaaguagguggcaucuucuugguuguacgauuuuaaccugccugcuggcuacccgcugggagacgcugagcuggcaggcaggcuguggggcgaccaucaucaccccccacuucagcuccgucguuuaacgucagagucuggacccagccacaccuugacuacugaacuuuacacaauaacuucuccuuggcuguguuguauaugcaauuaaaaaggcucacaguggaccuggggacaucugcuucuuccugaacuggggcaggacuugguggcuaaaccugcagcccagugugccuuuggucacuagaggguaggacuccuugcuugccgccccuggcuucaguggcaccucccaucaacacaccuccauuacaucauuugcagggggugaaaggccuucucugguuuggguuggacccaagcuggaagccaaggucagccgcuuaaacccaggggccagggaaagguuggcagagagcuagaaggaccacugcaaacaaaggucccugaccuuucgauggaccacguaagagcagggccugcccggcaagcccuauccuuccuggaggcugagggaaagccagggagagugagaggaggauacagaggcaggagcaucuggacucggucaucugcuggugggacuggaggccgaugcuagagauugacccuggagguugauacugcauccuccugccccaggagaccgccacagcagggcccuuccauguaagggguguuggggaccgggcccacauucucccauguggcuuuucucuccaugugugcuuggggguaugguuugacugaaugaguagaaucgucucuugugguugguuccccucagcagccccuucccugggguaaaguggguggggacggugggggucauugguguguggggucuggugaugcacaggccacuguucacaagccuggacaucucgacccucaugcuuccucucuccugacccaggcuuuacgugugguaggucgucuccaucacccaaaguuaccgugacucuggcuggccggugugaccgcagggccagaaaguggcuuggcaccuggagagcaguuuuucagaucugagucuagucucaaugauucuucugggaacauaacuucuuccugaguaaacuuacaacguugguacaguuucaccaaaaccaacguccaaacucgugugugggucuguauuuauuaauauauacaaaacacauaaauauguggaguuuuugcuuugaaauagcaauuaaccacaucauguuuuaaaaugagaaaagaaaagcuuaaaauagcccacaucuggcacagugguucaugccuguaaucccagcauuuugggaggccucagcaggugguucacuugagcccaaaaguuugagaccagccuaggcaacguggguaaaccccgucucuacaaaaaaauauaaauuagcugggcaugguggugugugcauauagucccagcuacucgggaggcuauggugggaguaucacuugauccugggaaaucaaagaugcagugagccaugauugugccaccacacuccagccugggcaaccaaucaagacucugucucaagagaaaaaaauagggccaggugugguggcucacaccuguaaucccagcacuuugggaggcugagaugggaggaucacuugaggucaggaguucgagaccagccugaccaacauugugaaaccacaucucuacuaaaaauacaaaaaucagcugggugugguggugcgcaccuguagucccagcuacucaggaggcugaggugggagaauagcuugaaccugggagucggagauuucagcaagcugagguggugccacuguacuucagccugggcgacagaguaagacucccucucaaaaaaauuagcccacauccugagcgaggcauggugccucacaccuguaaucccagcacuuuggguggcugaggcagaaggaucacuugaggccagaaguucaagaccagccuggacaacauagcgagaccguaucucuacaaaaaaauauaaaaguagccaggcacagugguucaugccuguaguccuagcugcucaggaggcugaggagagaagaucacuugagcccaggaguucaggguuaucauaagccaugaucaugcuacugcacuccagccugggugacaacagugagaccccaccucuuaaaaaaaaauagccuacauuugaaugcagucuuuuucuauugcacguuuuauucaaugcaauuuuuuuuucauggugguaaaaaaaaaaaaaaauagugccuauguaauaggaacuagcauuuuuccuauugcgccacagccuucgugauggcacaugacacauuccucuggguggaugcuagggcucucccaaacccacuucugagugagguccucaugcagaccucagacuuucuggccauguccccucacugccauucucauccuuccucuugaauuguuagaucagacacgugcuggcuuugcccagacauggcugcacuaaguuggggaaagugaggucaucuccacucucgcucauggagaggaacucucaccuagugaaaaugcacagagcaugggggccaggagagacgggcaggucccucuuaggcaguccaccaggcgcagccugggacgucacccacugcccccuucccuucuccaggcagauaccaacagugaccggcucuucacagugaacgauguuaaaguuggaggcuccaaguaugguaucaucaaccugcaaagucugaagaccccuacgcucaagguguucaugcacgaaaaccucuacuucaccaaccggaagguacguugcccaucccuguagccucucugcacacuugacccuggggguaguuggccaaauucaggguagaggagagcaacuggggaagagggcagagcauacuuaccucauuuuuccauaagacuugauuuuuuacuugagccuaggaguuucagaccaaccugggcagcauaacaugcauggugaaaccuugucucuacaaaaaaaaaaaaaaaaaauuauuugagugugguggcgcgcaccuguagucccagcugcuugggggcucggggggaggugaggugggaagaucaccugagcccaggagaucaaggcugcagugagccaugaucgugccacugcacuccaaccuggguaacagagcgagacccugucucaaaaaaauggauuuaugguugcugagaacccauagggaaagaaaaggacuccaggaguuucuugucuuggaaaagaaagugaaaugagaugguugggguagguugaagcagcgcuuguuuaacugguccucaggaccgucccuccagggguccaggaguugaucuggaagggcccacaccagggcacagaguuccuuggaaaugggcgacagugacuguggccugcaugggagggguccugcccugugugucagagugaugcgucauccagccaggccgcagccagcacugaggcuuaaacaaauaagaggagcuugcugucuagggagcaaccuuuaaguugcaguggggugauggcggcauccgugagaagcugugacuugcuauucaguugaagcauaagcugcaagauggauacagguugaaaauggcuucugggugaagugagauacaccuucagaguucggcuuaucuccugccauuguagaaaauucagcccugcccagaggguaugccagauagaccagaugucucccugugggucuguugaaggacucaggcuugagguuacuuccuguccugcuuaagccccacccucagaaugcuuguuccagcccauuugaagaggagcaggacgugaagagagaagucacacgucuguguccccacauguuauuccacaggaaagcauauuacuguagaauaacuuuccaucucgcugugugcuuccucaccaggugaauucggugugcugggccucgcugaaucacuuggauucccacauucuguauccuuuggcagaggaagagguuuggugggcaggccacacccugacguuggaccuggguaucugugggcuucaugacauggcaucuuagugaccagaggacuagacccuugugcacuuacaucucacgcuuuagaaaaaaaagcagcguaccuggauagaacacaaggaugcccguggagcacagagaagcagcugaggucccaucauggcuguuucucaaggugacauugaugucacuguguggcagacacugucugggccuucacaugcaugugguggagacagaaugggaacucaggcagucugacuccaaggccggcucacucugccacuguggcgugugacgggaggcucuggguucacuacacagacccaguauuccugccggagggcuggugugguagcagaggaacaaggcagaaaggagcagcacagccuuggggaggaagcccagcuccuccugaggccagggaggaaaacaguggucaggagagcaggguccuccuaggggaagcugagggcaaggucagagaggggguuccuuuggcaguggacaugggucugugggcucugggccucaggucccugcuggcaacagcuuuuuagagcacucaucacacuagucucugccuucccggagagcaagcagagccacuuugcugagagcacgguaguacagugucguggucccuggccucugggacccuugggggcuguugauauggcacaagacuugacucacccaaaaccacauguuaaugacucuuguccuugguucauucucuuauuaaauguguucuggaaacaaugugacuacucauuguaccucacaccuacuuccugaguuguggugagauuaacauuaguuaacuccugugaaggcaccuagcaguuucuggacaucauugguccucgacaaaugauaacugaaucaggaucuuuuuuguaaauuuuauuuguuucacagcacuguauuucaaaggaguuuuuuuggauuuuaauuuuuuucagagaaaggggucuugcccugucacccaggcuggagugcagugguacaaucauagcucacuccagccuagaacuccugggcucaagugauccuccugccuuagccucccaagucacugggacuguagguaugcaccaccacacccagcuuacauuucaaagggucauagagccuaaauacauuagcgaccugauuauaaauuuauauaaggcaucaaacuauguguguucucuaaauugcaaauuuuauguggcuuucauuugaugggguucuguaggccaaugggacugaccacauguuacuaugaugaucuaaccagagggcuaaagaggccaagcucugcagaaagcaaaaacaagaaccucacucacauuuccagucuuaaaacagcaugguauucucguuucugugggcuaaggagaggaaaaaaaaauccauguaauuggacuuaaagggauggauggucuguuguagcuucaucaguggcucgcccucugguggccauuucugguagccuucgggcuuuugugcugaagauuuuuugugcugcuucagaaguucagguaacuuuuucccuuuagaaaaaugguacuuuguucagaccugcacucugcauuuuuccugcaagaguggugggaaguuagauggaauucuuucuacacuuauugggcccuuaguuaaccuguggccugucaaaggauuaaaucuuagccuggcuccguaaguacucaaaguuugaguauaaauaagcugagauucagcaacaguaacuaacaugcacaucccacuuucuucacuuccuugccuuccaaacccagaagcaaaauaaguuuauuugguggugguguucucauuuacaguuucagcaccugguauauccuggagauacuuaauuuggagcuuacuacccagagcgguaugucacauacacaucacauacucagauagucaagaaugucaccuggccaggcaugguggcucccaccgguaaucucagcauuuugggaggccaaaguugggggauugcuugaggccaggaguuugagaccagccugggcaauacagaaagaccucucuacaaaaaaaauaauaauaaaauucuauuagcugagcaucauggugcaugccuuuaguuccagguacucaggaagcugaggcaggaggaucauuugagccccagaguucaaagcugcagugagcugugaucacacuacugcacuccagccugggugaaagagagagacccugucucuuaaaaaagagaaaagugacugggcacaguggcucauucccauaaucccagcacuuugggaggcugaggcaggcggaucacuugaggucaggaguucaagaccagccuggccaacauggugaaaccccaucucuacuaaaaauacaaaaauuagccaggugugguggcacgcacccguaaucccagcuauucgggaaguugaggcaggugaauugcuugaaaacccgggagacagagguugcagugagccaagauugcgccacugcacuccagccugagcgaaagagcaagacuccaucucaaaaaauguauauaaaaauaaaauguuuaagaagauuuuuaaaaguuacaugauugcuuuucagauauuuacauuuuccagugaggaauauguguggucauucagacaacaccuaucgaguauaugcaguugcaaggagauagagacaggcagcuccacaaguccucaguguaggaggaaagcugcaugcaggagggauugcagccaccuuccuggagggagacccaugagggcaggaagaggccagggaccccuaauaggaggaguugggagaaagcuugguauguuuggcagcaguuugauauucaugaugucucuggcuagggagcagggccuuucaagacugaaugcucgcucagggcugugggaggucccaggggguugugauuguggagucauuuuugaaaaugauuccuuugguggcauuguugggggauagacggacgagagcaaguccucagacagaagcugcugcaagacuaagggcgguggugagggcgugaaacgagguaucaggaguggagggaagggcaccaagaggcaggugcaggcucuagcccgggcaucuugugauaggagaaggccaggauagaccucccagagagugguggguugaggccaaggaguguguaguagaaauugggcuacauggccauagggcagaacuggaauguuuccaucagauuuagaaaccagaggcucauugaagacugaugagaacauuucucugggaaggugagggucaggccuggauuucaguggaggaaaggcaagggaaugagaauaaauacaggcuccucuggaacaaaguuuggcuaugaggggaaaaggagaggaaccgcgucagucaaaagacacacacguaggcaaggguauaaaggggcaggucagagagggaacuccaacgacuaugcucaugugaacagagacacccacauguagucagggaaaugcaaauuuaaauaacagugagguaucaccugguacccauucagauaagcagaaauuuuaagggcugguagugagauauuccaugcaaugccauuucuguauguuuuuuuuuaaacaaaagcugcuuuguguuauuuauugacaaauauauguaguggaaauacagcauggcuuagaagaacuuacaccaauuugagaagagcaguucucucugaguagaggagaagggagaauuggacuagggagggaucagagagggcuuuuugggcuuuuuaauaguauuuuauuuuugagacauggucuuacucugucacccaggcuggagugcggucacaugaucacagcucaccgcagccuugacuuccaaggcucaagcaauccucccaccucagccucccaaggagcugguacuacaggcacacaccaccacgcccagcuaguuuuuguauuuuuuguagagacaagguuuugcuguguuucccaggcuggucucgaacuccuggacucgagugauccuccugccucagcuucccaaagugcugggauuacauaggcaggagccaccacacccagcuuuuaacuauaucugauuuguuuuucccuuuaaaaaacaucugaagcuggccagucacgauggcucaccccuauaaucccagcacuuugggaggccgaggcgggcggaucacgugaggucggguguucgagacgagucugaccaacuuggagaaaccccgucucuacuaaaaauacaaaauuacccgggcgugguggcacaugccuguaaucccagcuacucaggaagccgaggcaggagaaucgcuugaaccugggaggcagagguugcgguaagccgagaucgcgccauugcaccccagccugggcaacaagagcgaaacuccgucucaaaaacaaacaaacaaaaaaaaaacaucugaagguaaaugugggcaguguaaacgcauguugaaucuggacgguggggguuacucuggccuagguugugugccguaugacuuucugaaggguaaauguccaugccuccucccagaggggagccuugugccuaacuguccuuaacagcuuuuuccaggcuaugccucaugggacucgcagagacuccaggcugugccacccugcucccagcaucacuguucgucaauagucacccagguacaggguucuccuccuuuaaagaaaucuguccucugucucccgagagcuguguggggguggcuuagagagaaguauggggccgcugcagaggcacugugggaggauucccuaagccugucccaggguuaguaccagaagcauguguuuuuuuuacagcaucugccccuuuuuacccaucuugggccauuucagucauuucagcagccagagcagacuuaacacgcauguaaaccagcgugagcucagaacagauucggacgcccgugcacaucauucagaaaacaccucugaagguccaaagcaccucaggugcuaucagggauacuuaacagucugccuacguuaaggcaauuugacuccuccuuccugacagcauucuggauauuacauuucagucuaucagaaaauuaggaucaauaagaccagggugagaggccucuuaagagugugggcuucaggcagaccuggcacgaaucccagcucugccccuugccaacuugaauggaauguugaaccucucuaaaguggacagggccuucucaguccacauccguggagaauuaggugagaucaugcacauuuagcccagugccugguauuucauugcacagcaagcuuaugaggcaggagugugucuuaccaccauuuuacagauaaggaaacugaggcagacaguuucagaauuugucuuacaaaaguaauuuuuaguguuggaggucaggcucacaguacccuuuggggagguaguaauugggaaagggaugugagggaggccucugggguacuggauuguuuuaugucuugucuugucuuuuuuuuuuuuuuuuuuuugagacggaguuuugcucuuauugcccaggcuggagugcaauggcacgaucucagcucaccacaaccuccgccucccagguucaagcaaugcuccugccucagccucccaaguagcugagaucacaggcgcacaccaccacgcccggcuaauuuuuguauuuuuaguagagacgggauuucaccauguugguuaggcuggucucgaacuccugaccucgugauccaccugccucggccucccaaagugcugggauuacaggugugagccacaaugcccggccuuuuuuuuuuuuuuuuuuuuuuuuugagauggaguuucacucuuguugcccaggcuggagugcaaugacacgaucucaguucaccgcaaccuccgccucuggggcucaagcgauucuccugccucagccucccaaguagccaggauuacaggcauguaccaccacacccggcugauuuuuguauuuuuaguagagaugggauucuccauguuggucaggcuggucucgaacucccgaccucaggugauccacccgcuucggccuccuaaagugcugggauuacaggcgugagccaccacgccuggcauggauuguuuuauuucuuaaccugggugguggguacauggcuauauuuaguuugugauaacucacugaacuguauccuuacaaucuguacguucuaucaaugcaaaaguuuauuuuaaaaaauauuuuuucgaagcacaguggcucaugccuguaaucucaacacuuugggaggccaaggcaggauaaucguuugagcccaggaguucaagaccagccugagcaacauagcaagacuccaaucucuacaaaaaauaaauaauuagccaugugugguggcucacaccugugaucccagcuacuugggaggcugagaugggaggauuccuugagccugggagguugaggaugcauugagccaugaucacgccacugcacuccagacugggcaaaagaacaagacccugucuuaaaaaaaaaaaaaaaaaaaaaaaauauauauauauauauauauauauauauauaguuuauuuauuuauuuauuuguguguguguguguguguguguguguguguguguguguguguguguauauacacacacacuugccugagaucacauagcugguaggugaucgaggaucggagccaccuuaccuccaacaguauacuaccucccugauaucaguacuauucguacuguaaacacgacuacugggaacguuaacaaagaugcauuuucggaauaaccacuugugagccaggcaucccagcugagucucucuugcaaccacaaaacccagaauggggccaaagguauagacccucugagcagcuaugggcauauuuggauguuuuccgaacccaguggucccuggccugccuagaaggcagccacacuuuacauucuccuauccccuuagcaggaauagaccggccuggcaugcucugcaguuuccggaucccuggugccugguccugugccuggucccugaauauccaagcaaauaacugcuucaguacaggugagccuggcuccccaggugcccagagaagaggccuuaacaggccuuaaaaccccauguaguugucccucuccccagacuacaugugacauaaucuuaccagcccaucucugucuccgccaggcuugucucggcggguccuguugaccaacguggugacgggacaccggcaguccuuugggaccaacagugaugucuuggcccagcaguuugcucucaugguugguuggauugggacaggcagaauauaaaaguuugccccauguagaaauuuggccagauugaaauuggacuccucugugugccaucuaguacucuuugacaggggagaaagagcaucagaaaggaucaguggguuccuuuguaagggugucugagccgagugaaaguugguugauccagaaaggcuggccugaguugcucuacacaaccucucauggaaagguauugugagcaguucuuggguacuuggauuuacccaguaggacaaaccauuuuuaaaauguauaagccaaacaccaauucuucacagcucccagguuauauauuuuauauguuuaaaaaaucaggccagguacaguggcuaaugaauggcuguaaucccaacacuuugggaggccaagauggguggaucacaaggucaggaguucaaaaccagccuagccaagauggugaaaccccuucucuacuaaaaauacgaaaguuagccaggcauagugcugggcgccuguaaucccagcugcucgagagacugaggagaauugccugaacccgggaggcggagguugcagugagccaagaucacaccacugcacuccagccugggcaacagagcaagacucugucucaaaaaaaaaaaaaaauuguggucauuacuauauuucacagacuuuucucuagaaaaugccgucuucccuuaaaagugaaugaacccacuaaccugcuuuugguggagauggaaugcuaucucugggacuucagagagaaaggccaaacgggacagugcagggggguggggggcagcuccuaggaccuccgugcuacccaugaggaggacacauggggucugguucuucuagccacuaacaaggaaucauccucccuuccaacuccauugagacccaaacccugaccagcacgugucuaaucacaccgucugacccagaggcuggaagagggguuguaucaggaggaccugcccugcccagccucagagggaugucaugauagccaggcacugagcagucccucuuuccacaggcuccucugcuguuuaauggcugccgcucuggggaaaucuuugccauugaucugcguuguggaaaucaaggcaagggauggaaggccacccgccuguuucaugauucagcagugaccucugugcggauccuccaagaugagcaauaccugauggcuucagacauggcuggaaagguaggggaucauggacuuucucaggccacagggucucguggcccagugcccugccaggugaaaggguucugcugaagagguccucacaccaagaccccaggcaggggaauuucgcugaagaccaagugauuuguaggcccugcauggggacugcuucguugaccauaugagccuaaucugacguaaacaaaagugaaaaggauucucugguuauguccuuuuuuuuuuuuuuuuuuuuuuuuuugagauggagucuugcucugucgcccgggcuggagugcagugguacuaucuuggcuuacugcaaccucugucucucagguucaagcgauucuccugccucagccuccugaguagcugggauuacagguacccgccacugcgcccggcuaauuuuuguauuuuuaguagagaugggguuucaccauguuggucaggcuggucucgaacuccugaccucaugaucugcccaccuuggccucccauagugcugggauuacaggcaugagccaccgugcccggccugguuacaugcuuuugaugaacaacaaggcucaagaauucgagauggagaucuucaugaccugcacaggccacuggagaccaccuugccuuccuggcuuugcacuuggggaccaccaugguacccccuggccccucccugauggccccuggugcuuuuuccacagaucaagcugugggaccugaggaccacgaagugcguaaggcaguacgaaggccacgugaaugaguacgccuaccugccccugcaugugcacgaggaagaaggaauccugguggcagguacuugaggaaggaaggggaaguuccaccccaucaaauacugucucucaggggcgaucccagcaacuucagcagcagagggaaaaguuaccccaaaacagaacugaaucaaggggaguguggacagcuggguggggagacuaggagggaaguagaauuagauuauauuaguaaucaggaguguaaauaaauguccaccagguggacagccucaucccaugucagugggcaaacgucacuucagaaacaggcagguggggagguccuggggagccuggguuuggaguuugaguggauuucaucaggccagcauuauuccaccacgcaacuaucuuauccaaaaacuugggcucccuguugucucuacucacauuuccaccagaggaugcugagaaaagaaguuauggucauuguaaagauucuuggccccggcccggcgcgguggcucacgcccguaaucccaacacuuugggaggccaaggaggguggaucacgaggucaggagauugagaccauccuggccaacauggugaaaccccaucucuacuaaaauacaaaaauuaacugggcaugguggcaccugccuguaaucucucagcuacucggaagucagaagcaggagaauugcuuggaccaggaagucggagguugcagugagccgauaucacgccacugcacuccagccuggcaacagagcgagacuccgucucaaaauaaauaaauaaauaaaaaagauuuguggccccuuuacuaccaucccuguggcuccaugaucugcagauuaggagcagcuaucuggccacuaagcccccuggaagggaguuaccaguugauuacagaugaugguggcuauagcguaaucagacagugugcaggcucaaugcuuucacacugaaauaguagcugcugacacugcagaauguguucucagucuucaagaauugucaccucuacugguauuccuauagaaagggcuuauaccccauggaacauuuuuguggcuaggaagcauuacuuuguuaggacauucauagacuuauuuacuauucucaucaacaccaggacuucgccuccuuuuuaagucgauuuuucaccuguuuuuaucacagaagagcucuugugagcuggaugauagagagagcucagccuugcugagaggcagaugcagguaguuaccagcugcaguaauaaacugcagccgggauucagcuucagccaagauagcacuucuggucuuagagccacacaagugaucagaaucacaaaugugaaauccaugacugcccaaggccuguccucuucuccugcugaaggucuccaguaguguauaucauguuucugggcugcuguaacccaugcuguugugugucacaguccucagaacuggagcccugaagacuuaaaccgguccuaggaacugaagcauuaaaccagaaagagcuguggggagaguugucaaccuagcccauccccaggauguaaugacuuugacagaucuuuuacuauaacaugaaaagaucaggccaggugugguagcuauaauuccagcacuuagggagcuugaggccaggaguuuaagaccagcuggggcaacacagcaagacccuaucucaaaaaaaaaaaaaauuaggcauggcggcacacacuuguagucccaguuaacucaggaggcugaggcagaaggauggcuugggcccaggaguucaaggcugcagugagcccugaucacaccacugcacuccagcccgggcgacagagcaagacccugucccuaaaaaaugggggaaaucaguugcaugucaccuagaccaggugggccacacucgcacuugaacguuccgugacaucaagagcagcagaauacccagacauuagccaggaugucuccgagccauucauggcaucacacagccaaccagggcaucuugucauuguucuagcacaacagggcgacuuggguuauccguagaaauacuguccguuaaugaguuuguguuuuggcucacaugaaaucacagcccugaggaaucuugggaagccauguccacauguagguaaguuuuccuuugcauucucucacuagccugccaugugucucuccucuuuccuagugggccaggacugcuacacgagaaucuggagccuccacgaugcccgccuacugagaaccauacccuccccguacccugccuccaaggccgacauucccaguguggccuucucgucgcggcuggggggcucccggggcgcgccggggcugcucauggcugucgggcaggaccuuuacuguuacuccuacagcuaauucugcagggcacagcccagagccauguggauuugacuuacgggaguaaagcguaacuuuuuacugcaucuaaugaggguguuuuaagugacacucaguguacacagaucccauccucuggcugcuaggagagaagugcugaauguuccguguggagaugcucaggaaaguuauuugaguuaaauugcuggcugagagagcuuggaaguccuuuucauaaaagguaccucuuuccuuuucuuauugaauucuuagaacuuaguuaacccucccugccuuuucuuaacaaaaaggacuuuucuaaggacugaagauuggcaaaaacgaaaagcuucuuccuccaagagcccauugaagaagcccagugaugagacggugagaugguuugaguccucggugccuggguagcaggaagaaagaccugcauccugcaucuguacuuggggaagccagcggagaggacggggagguuacuucucuaaguuucugcagaaauauugaaggcuggaguuuggaauccuuaaacuuggccuucucaaacucagcagcagaucuccgggauucugcuguuauuauccaaaggcguuggaaggaaagauggaucuucuuacaugcuagaaguuuuaaacgguccuuaacaugccuuuguucaagcaccuuccagaauguaagguucagcagcucugguuucuauuacggugacuugaaugucagauucaagggcccggcgucaaaggaaauugguuuugacuuuuuguaaucuaggagcgacaguucgugagauguuuauucaguguuaaagagccuguuuuucuaccaaacaauaaaaccaagagaagaauca

SEQ ID NO: 192371 - RNA, 62856 nt, Homo sapiens
uuacaacaugaugccauuuauuuacaugauucugaaagaauaugaguccccaggaucaaauauauacauuuuuaauauuugaaauauuuacauaauggaaccacaucaggguucgaggguaagaacaguguuuucaaauguccucuccagguguguuuaaaaaaaaaaaaaauccaguaauccaaagcucacauuaugcuuuuucuaacaggccaaucuuuaccuuucuuuuaaauaaguacucagacaugggaacaguugcaucuaauuugugugaaaagcuguuuaaaacuucuuacguuuucagguaauuuuacucccuggugaaauucugaucuacaacgaagaaagccccaggaauuucucuaagcacaucaucaguacauuuuuaaacacuaaugagccaagguaaaacaagauauaaaccuucuacaagacaaaaaugaaaacaaauaguuagugguugguaacugccuugaaugauuuaccuuuauccuuaaauaacauguaaacuuacaaauugccgagcagaauaccuaucauguuuguaaaacucucacugucugucaauuugccuaauuuuauuucauuuuuuuguuuuguuuuaaaggggguuuucacuuacacuuuuugguaugaugaauuuuuuguuaaauaaacagauacaauagaauuaaacuaaggaccaauuagugcaaaaaugcauuaaauacagcucuccaggauuuuuaggauaugccucauuucugagcaauaaaauuaaaaggaaaaaucacuaugauccacauuccuuuaaaagagaagcugaagcagccaucuuauuaauaagaaaaccccauccaguuagcaaaccacauugcucacgacacgagaacaccaugcucugggaaacuaauaaccuaauuauaacagacauuucagguuggaacaguaccacuuuuccuuuacaauucuauucuuuaguugggaaauguuuuaaggaccccaccaaagcaaauuagggaaaagaaagacuuuuacacauacauucacaaacacauucauacagaaauacaguaggaauggauugucugcuaauuuuugcauuccaauuuuaaacuccaugccuucacaagggcuugccauuucugaucaaaagagagugggggugguaauaguuuaugacugguguuuucaauuaaaauuguucauguugguuccuauacaguacauuucaauauuaagugcaauucugcaaaauaauuggggagucguuuuaauauuuacaagaaacaaaucagcagaacaagauuauaucagauaggcuguguacaguagcugcggcuuauaaaacauaccaguaauuuguaccuggugaguauaaagagaaccaaggauucagaugacuuuacaaccaagggaguacacagggcaacaacaaauuagaggaccaaaaaauucacauuuucuacaaaaaaaaaaaauuacagaucucacaaugucuucaaagacaaagaaaaauucaaaguccuuaaaaggguggcaaagaagaaaucugaaauggaacucuaaauauaaaaaguuuuacuucacaagaccaauuuucuuggcuucuguuucauauaucaauaaucuccacauuuugacuauaaaaacuucugcuucuucaucaaguaccuaaagaggaaacaaaacagcaacacauguaagagaagcaaucaucaacaucugccaaaaacaguggccaguauaaaaaaguuuuucauccacugacaauaagcacuuauuacuuaaaugcuaguuaagauuuuaagguuguuuuaguggccgggugugguggcucacgccuguaaucccagcauuuugggaggccgaagcgagcggaucacaaggucaggagaucaagaccauccugacuaacauggugaaaccccaucucuacuaaaaauacaaaaaacuagcugggcauggcagcgugcgccuguauucccagcugcuggggaggcugaggcaggagaaugacgugaacccaggaggcggagcuugccaagaucgcgccacugcacuccagccugagcaacagagcaagacuccaucucaaaaaagaaaaacaaaaaaaacaaaaaaguuuuaagguuguuuugaggggauacaugagauucuguauuguuauuacauaguuguauauuuaguucuucuuaaauuacuacguucuuuauaauacguauuuguuuuccuuaggaaguaguuuugcuuucaguaaaaugacuuaaagaaaauuuguccagugugagaaauguauuauuaauaaauaguaaauggaccgggcacaguggcucacaccuauaaucccagcacuuugggaggcugaggcagguggaucaccagaggucaagaguucaagaccagccuggccaacaugacgaaaccccaucucuacuaaaaauacaaaaauuagcugggcaugguggccggcaccuguaaucccagcuacucgggaggcugagguaggagaaucgcuugaaccugggaggcggagguugcagugagccaagaucaugccacugcacuccagccuggucaacaagagcaaaacuccgucucuaaauaaauaaauaaauaguaaauguaaauuaacaacgacaacaaaaaaaaaucauucaaaauuccauggcuuacuaaacacaaagaguaccauauuuuugugauccaccuuuuauucuuuuauuuuaccuuuacagauacugcaauuauacaugucugacaaaacuacuucccaaggaaaccauacgcuuuucauaaagaacacaguaauuuaagaagaacuaaauaauauacaauuacauaauaacaauacagaauuucauuuaucuccaaaaacacaaccucacaaacuuuuuuuuuuuuuuucuggagacaggaucucucuugucacccagccuggaguacaguggcaugaucauggugcacuacagccuugaccucccaggcucaagugauacucccacaucagccucaccaguagcuaggacuacaggugugcaccacuacuccuggcuacauuuuugugcuuuuuaguagagacagggucucacuauguugcccaggcuggucucaaacuccugggcucaagcaaucugcgcaccuuggccuuccaaagugcugggauuacagguuugagcugcugugcacagcccaaccguaccaucuuaacuagcauuuauuguguaugugacacuaaagugaacauuaaaugagaauauaaguauuuaguacaguguccagaauacaguaaacacaauaagcaaauacaaucaucacggggcacacaugacuacugaguaacaagucuucuuccagugguggaugaggaaauugucuuccucucuacuuaugaguuauaggguccuuguguccccaucacuauuccugccaucaucccauacacacaucugccccucuacauuauggcugcuaugaggugaaauggccuacucugcucccuucugaagggggcagcuaugacugugcuccagaaauguggucuaguguugccaggucuucauagaggaaguuugggguaggaauuuagaguacucaaucucuagucagacuacauugguucaaauucucuagucaggcuacauagguucaaauugcacugcugccucuuacuagcgauagguccuugguuggguuacuuaaccugagccucaguucccucaccucuaaaguggaggcgauguagcuacacaccauagcaguagguacuaagugggaauuaaaagaguugguauguaguuaagugcucugacaacugacugguauauaacaagugcuuaauaaauaccugggaagagacugggcacaguggcucacgccuguaaucccagcacuuugggaggccuagguaggcagaucaccugaggucaggaguuugagaccagccgggccaacauggugaaacccgucaauacuaaaaauacaaaaauuagccaggcgugcgggugggcaccuguaaucccaacuacuugggaggcugaagcaggagaauugcuugaacccaagaaguggagguuacagugagccaagaucgcgccacugucacuccauauagccugggaaacagagcaagacucugucucaaaaaaaaaaaaaaaaaaaaaaaaaaaaaaaaaagaaaagaagaaagaaauuaaaagaaagaaauuucugucacuuucucaaugauagcaauaauuaauuaaagaacuuuugaucagauuucuaugagccagauuugacuuuaguugaagaacucuguuguaacacuaauucacaucugagucacacuucagagagauguaggcacaaaaugcaaccaaacuucauuuaauuuacauaaaaugaaaaagguauaauauaaagaagucagacuuuuguuaagagugaaacaguacucaggcuaaaaauucagucuccucauuuauucaagaaauauuuacaaggccccaugagcuuuuuagcagagcuguuugacaacacuagcucaacugguuuccucucauucuaaucaacgagccacaaaaucauaaacaguggucuaaauacacuucaaauaucaauauauuacaacagaucaaaaaaucuaaaauuaacacugacaugaaaucuuuacuauguaugauaggaacucugcugaggccaaacgcuagaacacaguuuuauuuaaaaaaugucuucacucaggccuaacuacgacacccucuacuccaagaaaaacggggcuggaagcuucaggaaaguucagaauucagccccaaggacugaaaucuauucacauuucuccuuuccucugaggcaaugaaguuuucacaaauguuuuaucagguguucuaaaugacagcugcaucaagcuagcuaggcagcagaaaaggaauguuaucuggcuuuagacaccauaaaaugccuggacacaaagcagcuagaccucacaauccuucuuuuugacuauaaaccccacgaugucccucccugacaucucugguggcaguuccaagugcaaguacucccagucaucuaccauuucauaucaugcuugaugauuuuuccuuccuuacucaucuucccauugcugucuucccgcucugcccuuuggaccgcuauuccauuuuauacuacacaucaacaacuaaauuagguuuuuccucuuaacagaaacccuccucuaucuccuagagccccggcacuucucaggcagucucucacucucaaugucuuaaucuccacaggaaugacuugugggucuucacuguuucuuucuugguaaaaaaaaaaacaacuccauggacguucaugagcucucaccaccuuauccacuguaagagcagcuaucuggcaaguaucuagucuuuccccccacuuaaaugagugcucuggcaacuauuuccaguauuucucuccaaucugacucccaauacccaggaauuucccauagucauacuaugcaccuugccaucgucugggcugaccuaucacauauagacuugaacuuucuacacucugaccauaaccucuccuuucaguuguuuuauuacaauucgccuuccacaacuucacuggaaccacuaguccuuaauucauucaaaccaccagcucuauucagauacuauuuucuucucuuccuaacuuggagaucauaguucaaucucuugcucaaccuuuaccaucaauuuucuucuccuuuccuugucucacaaaaucacaguguuaacuacaugcuaccacugacuguaaucccaaauuaaaugcaacggggauuugauguuuacugucaauacaacagguguuuggauaccuguccaaaaagcagcacauauguacaaucuuguggccauaaaaaacgaaauaguguccuuuacagggacauggauggagcuggaggccacuauccuuagcaaacuaacacaggaacagaaaaccaaauacaguauguuuucacuuauaagcgggagcuaaaugaugaaaaaacaugaacgaagagaggggaacaacacacaauggggccuaucguagggcagagggugggaggagggagaggaucaggaaaaauaacuaaugaguacuaggcuuaacaccugggugaugaaauaaucuguucaacaaacccccaugacacaaguuuaccuauguaacaaaccugcacauguauccgacuuaaaacacacacacacacacacacacacacacacacacacguaucaguuccuguaguaauccuugugaugcuuaaccuaacugcuaucaaugccaucagauguucuaucuccucuaccuccauuauccuuucuacauaucuaauucaaacaaguacaucaagguuccaguaccuguauaccuaucucucugcuacuacaggucauuuguucuacuuuuaugcuucuagcacauugugcugggcauagggaaaacaugaauggaacugguggaaaagaaugaagccuuauuuauuuauuuagagauggggucucacucugucaccaggcuggagugcaauggcaugaucucggcucacugcaaccuccaccucacagguucaagugauucuccugccucagacuccccgaguagcugggacuauaggcacacgccaccacgcacagcuaauuuuuguauuuuucauagagacgggguuucaccaugcuggccaggauggucucgaucucuugaccuugugauccacccgccucagccucccaaguacugggauuacucaaguuuuaauucaggccuaaaaaagauucuggaacaaagacaggcaggaagugaaucaaauucaaaagugaguuuauauagauguuaauuaaaauauuaauaauagugcauuucuggccaggugugguggcugaugccuguaaucucaacacuuugggaggcugaggcaggaggaucacuuaagccuaggaauuuaagacuacccugggcaacguggugagaccccaucuauauuuuaagacaaaaaaaaccaaaaacuuuuuuuaaauuaaaagaaauaaaaauagugaauuucuaacuuaccauggcaacaucaucuaaaaugcucuggggugaacuaugagccauaaccuaaaagagaaaaauaauugucacauuaaaaauaaauaaaaaauuaacaauacagucaagaaauuuuaagguaugaauccucaaauucauacaggaacuucuugcggcuaaggaaccauucuauaaauguuuuaauuuucagaauaucauucuucaacgaaagaggcaccaaaaccuggaauauuaaucuccauaguggucuguagucuaauuuuaagucaaaucucacacaaguuuuaaugccacaauaauuacaaguuagagaagacagaguaaauuuacuguucauaauaucaaaagagcacuacuggcaaaaaaauaccauagcuauaccuuuauagaaauaugguguuucuacuauguuaacuguuuuauuaaaguuaagacuauguuuucaggagacaaugggaagauauaccuuagugguuaagagcauggguuucagaggcuagacucaguauaaaacauagccaagacacaaucucuccuuaaacuucaauuucuucauguauaaaauggguauaacauucaugacagacagauucuaaguguuagguuaaaagaaguuuuucuuuuuucuuuuuuuuuauuuugagacagagucucacucuugucacacaggcuuggagugcaauggcgcaaucacagcucacuucaaccuccgccucccggguucaagugauucuccugccucagccucccgaguagcugggauuacaggugccugccacccagcgcacccaauuuuugacuuuuuaguagaggcgggguuuuaccauauuggccgggcuggucucaaacucgugaccacaaguguucugccccauuggccucccaaagugcgggaauuacaaggcgugggccacugucuuguuaacauuuuauagaacuuuaucuucggcuggugugauggcucacgccuuguaauccccgcacuuugggaggccaacuugggcagaucacuugaggucaggaguucaagaccagccuggccaacauggugaaaccccaucuccacuaaaaauacaaaaaauuagccugguguaaaccaaacaccacauguucucacucauaagugguagcugaacaaugagaacacauggacacagggaggggaacaucacacagcugggccugucggcggguggggagcuaggggagggagagcauuaggagaaauaccuaauguagaugacagguugauggguguagcaaaccaccauggcacauguacuccuauguaacaaaccugcacguuaugcauauguauccuagaauuuaaaguauaauuuaaaacaaaaaaagaaaaaaaaaauuagcagggugugguggcauaugccuauaguuccggcuucucaggauacuaaggcaggaagaucagucuaggcugggcguucaaagcugcagugagccaugauugcgccacugcacuccagccuguaggacaaagcaaaacuccgacucaaaagaaaaaacaaaaacaaaaaacaaaaaacaaaacaaaacaaaacaaacaaaacuaacacaauaccugccgagaacacagccugucagucaauaaacacugaucguuacuacgauaugaaaggaacuauuuugauccuauccaaaggaugggugacugacaaaggaguugggaaaagauauuggcuacguccaaaaaaucucaacauaauuauuccaaccaagacaagaagaagauggcacagcauucucaggggcagaaagacagcacacaauuggcaguaaccagcaauuccauccuccucgaccacugaaauaaaaacauguggugugaggagucugaaguuggauggaaagguucauuaaagcagacauaaaucugcauccacugcagugaauaaaaaaaaacacaccaaaaauaaaaauaacuuuaaaaaagcagauauaaaucacuuaacugaaccuaaaccaucauggaacuugacucuguaaaauuucugcucuuuuaagaagugucuaauauuuuaauauauaaaauaaaugcuggcauggaagagaauagaagacuaaccuuagaacaaacaaaaucaacuaauguagcuucuucuucaccuauauauucuaugauuuucuuauuaauccauggucuaauucgacguuccaucaguaucugcaaaacaaaccacgguuacugaauuaaagaauuguaacuugcuauaacaguuauuaaagcuucaugauuuuuccugagacuaaaauauaauguuauuucacaaguugaacuaagacagauauguaucaagauacaaucaucugcuuuuaguaagucuucaaguagcacaaaaaaaauuuccauuauuacuaauuucuugaccauggcauugaguuggugucaagaugaucaucccuacuuauuugucauuaauagaaucaaaugagguuuuuuuuucuucaaaugaauuuguauggcauauuccaacuguucccaauaauaugaugaaauauaauuuccuacucacagaauccacaauagaccaauccaggggauaagcgaagagcucagguuuggcuguagggauuuucucaaugagacucuuaauguguuuacgcuuuucuucaguguuuacagugccuuugguugcauuuuuaucaucuucaccauaauccaagggaaccaguuuccuuuuucgggguacgucaucacugucuucauccucaaauuuguuaaagacacuaucuacagguaguuucuuucucuucacagaauuaggcugaccaggacuauuggaagcaccuacaguaaaaacacucucuuagcaagaugacuuaauuuccaaauguuucauuuuauaacccaccaucccucaaaagcaaugcaaaauauacuuccacaaaucuuagagaaagaucccaacuguaaaaaauaacucacuacucacaagugcuagaaaauuaaacuuuucacuucuucucagaacucgaggcagcugcagauauaggagcacuaguaaaacuaugaaaacaaucgugagcuagaaaggcauuuuuuaguaaucuucuaucuaccuaaccaagcacaaauauaaauuuuuuucuuuaaagcacaauacagguauuugcaggggugaagggaagaaaauaaagaaggaaggaaaugcuaacguacccaguuuaagacuuaguccuauuuuuggccuaugcuccucagguugcuguugaucuggugaguuuucaugaggaauaauaauaccacagggagacucauccccaggaguguuagguguugcauugccacuggcagaggaaacagauggagcagagcugaugggccucagaguagguuucagacaaggcuuuugcucuggcuccucuuccucuuccauggguucuucucguuuuucuucuuuuucuugcuuuucuucuuccuccucuucugauucuggcucuugcuuuauuuguggcugccugcgccucucagccucuuguuccaucuaaaacccaaacaauaaucugauuaacuacaacucuacaccauucaacuugauuuuuguuuuacauuaccucuuguaaaauaucuuuaugaaaagagaaaaggccagguaugguggcucaugccuguaaucccagcacuuugggaggccgcggugggcagaucaucugaggucaggaguuugagaccagcuuggccaacauggugaaacgcugucuuuacugaaaauacaaaaauuagccaggugugguggugcacgccuguaaucccagcuacucaggaggcugaggcaggagaaucgcuugaaccugggagguggagguugcagugagccuugcagaaucgcacuacagccugggcaacaaagcaagacuccaucucaaaaaaaaagaaaaagaaaaagaaaaaaaaaaggacaugggcaguggcucaauccuggguaacacaggaaaaccccaucucuacaaaaaagcauaaaguauucagucaggcauucugcucaugccuguaagugucccagauacucacgagguagaggccugaggaccacuugcccaggaggcagagggugcagugaacagagauuccgcuacugcacuccagccugggcaacaaagccagacucugucucagggaaaaaaaaaaaaggccgggcacggugguucacuccuguaaucccaggacuuugggaugccaagaugggcggaucacuugaggucaggaguuuaauacuagccuggccaacaugguaaaaccccgucgccacuaaaaauacaaaaauuagucaggagugguggcacgugccuguaaccccagcuacucaggaggcugaggcacgagaaucccuggagccugggaaguggaggcugcagugagccaagaugacaccacugcacuccagccugggcgacacagcgagaccccaucucaaaaaaauaaauaaauaaaaauaaaaauacaaaaauuagccaggcgagguggcacacaccuguaauccguacuacuacucggguaccugaggcaggagaaucgcuugaacccaggagucaggggcucugucgcccaggcuggagugcaguggcgcgaucucggcucacugcaagcuccgccucccggguucacgccauucuccugccucggccucccgaguagcugggacuacaggcgcccaccacuacacccggcuaaucuuuuguauuuuuaauagagacgggguuucaccguguuagccaggaugaucucgaucucccgaccucgugauccgcccgccucggccucccaaagagcugggauuacaggcgugagccaccgcgcccgaccagaugguacaguaucuuacccucuggagcucugcaucuggaucuggaugcccuucugccagaaggcgcugccugauuuccucaagcuccuccuucucucucuuccuaucucguucaucugcuuccauuuccuuuucucuaucacgcaaccuuuucugaagagcacuuccucuguaaaagugaaugauaaaaggcuucauuuaauacuccgaucauugagaaguaaacaugacaucuccaacagcaccucuuuucaacauuacaaccugcaugcuaagagguuaaagaaugucuuaauguucuguaucuacggaacacaccagagugugcucucuacauguaaauguauaacaagcauuaucuugucauuuaucacuauguucccuucauucuuaaagucauucuaauaagugucuaaacaaguaaaauagucacuuucagaaagagagcucacacuuugugccuauuucacaaggaauacccaacaaauaauuuucguuuuccuagauaccaaccuaaaaaaauauaucaaguagcauuaguagcacugagaguucuguauccucaauuuauucacuuguaaaaauuaucucagaaaguaguguagaaucaacagaaagcagagguucucuccuaucuagcaguucauuacuucucagaauguugacguuauacauugccacuuuaugcuucuagccuucaauauuuuacugauuucauggcacuuucuacaaagccaaaucccuggcacccuugagauuuaagcuacuaauuccaauguuuuaauuauuuuggcuauacuguauuaaauuuaacuauauuaaauaucuucacuaugauuguaucaugucagacaaauuagagauaaaauaguaucaagacacugucuacauccccagggaacuuacaguuuggauggaaggaagaacaaaacaagcaauuuuggcauaaugucacaaauacuagaaugagaguaguuugaaaaugccaugggaacaaagaaugagagaaggcaguugucacaacuguuacuucacaauaauguaucaauuuggagauggggugagagacgggaggucaaauugcuagaagaccaaaauuucuagaaaaacccagauaguuacagagauucguuguaacuugcuauaaaaauuggaccuagcacacaggugugguagcccacaccuauaguccaaccuacucaagagacugcagagggaggacugcuugagcccaagaguucaagguuacagugaacuaugaucaugccccugcauuccagccgagguaagacccugucucuaaaagaaucaagaaaaaauuuuaaaaaucagaccuauuuacaacacacaaagaaaaaaauaguauuguuugauauaauacuaucaugggcucccccacugcacaaaagaugcauagaaauguuuauccuuuucugauagcucuuuucucccaacgaaaacaguguauuagcuauagaauuaauaauuacucagaaugugaaaguuuguuuuucuuauuccacuuagugaacaugcauuaucaacugugcagauggaaaaacacagcuaauaaaaaaccaaguaugaauccacagaacaagccuucuuuaccuguaauauuuggggucaucucuaucaucaucauagucuucuaagaauucuuuuagucguuuagcuucuuuggccuuugaggaaauaaggacaauguauaaaauuaacauacaaguaauaaagauuacucuucccuuuuuuguguaaacagauuuuucugacccagacauaaaccaagaguaagagggagacuuauaggaauuucucuucacauaauuuuaagacaaacauggccguuucaauaaaugaaacuaaaguuucuccuggaucccagaauucaaaccauauuuauaaauguauauguauucagcuauuugguuuaaauaaacuuguugggcuagccugggaaacgguguuuuuauuauuuucuauagagaaaauauuuucuaauuuaaguuggagcuaucugugcagcuaucucucuacaguuguacauaaaauguuuuuacuguaaaaugagauauguauaaaauaccacucuaugccauaauaaauauaauaauacuuugguuaaaaaaaagauuuuucuuguccucuuaaauuuuaguuuucauauacuccauauauuaaguauaggucacauuagacauuuuaaauuuuuuaccucuaagaaaagucugaaugaggacgcaucuguaaaaugcaaacuauauauauacgcuacgcuacaauaaauaugcucuuugaauauaaucuucaaaauacaauaccuaagcacaccaacaaaacuggagauuaucuuauuaaacgaaaaaauauggcugggcgugguggcacacgccuguaaucccagcacuuugggaggccaaggcaggcagaucauuugaggacaggaguuugagaccauccuggccaacauggugaaacuccgucucuacuaaaaauacaaaauauuagcuggguguuguggcacacgccuguaaucccagcuacucgggaggcugaggcaggagaaucgcuuaucgcuugaaccugggaggagaagguugcagugagccgagaucacaccccagccuggguggcagagcaacacuccgucuccacaaaaaaaaaaaaaaaguauauacauauauauguauacauguauguauauguguauauguauaugguuuuuaauuccauuuuuaagguagaugauacuauaagaaauaguuuuuaagaaacgcagaaauuuaaaucauguucaucaaucaauuuaaagguaaugccccccaacucuaaaccaauaguaaacaauccaugagauaaaaugaaucucuuaacuuacggaauuucaaaugcaacuauuauaucuaauaacaacaguucaacaauuuuaaaaauaugcagauucuuaaaaauaaguuaauaaauucuugacuuaaauauuacuauaugacaaauuuacuuugaugguauacaaaaagauaacuuuagaugcagcaaaaauuugaagaggaaaaaagauuuugguguacuuaaauuggcucaaaauuacucaaaauacauaaaaauuaaauuauacaugaauagagaagcuugugcauuucaauuauuaaguuacuuguaguuagcaguaaagauacaaucugacuuuuuaccugaaaaaucacuuauuuuagccuagaaucuuaccauuucucuucuucuuucuucuucucuuucagcuucuuucucauauucccggguuuucuuucguucucugauuucccaauucuuaaggcgcuaaaaaaauuaaauuuucaaagcuuuaaaaauuuauacauagcauucuauaaauauugauuaaccuauuaagggauaccaagauuuaagaauaaaggcauuuucucaacuuaccucuugauaagcagcuucuuucucucggaguuuucuuucaaguuuucuucguucguaugcaucuucuucaucuucuucucggucccguuuuuugucuuuuucucuuucucgcucccguucccucucucgcucucucucucgcucccguucucguucucgcucucguucucucucucucucucuuucccgcucucguucccuuucacgaucucugcuuuuuucucuaauguaaacaaaauauuuuacaaaucugucagucuacuuucuguuuucaagaccaaaguaaaggaggacaacauacauuaugaaauaauauaaaaucucacaggccagaaucuagcacuugauuuccauaaaacuauguaaccuccucuacacucaucagaaagacauaaauugcagucccaaauccuaaaaugcauucuaauaccuaaugcuuacugguaugucagaaaacaaauacaaucugaauauaaaauaguuauaaaucauuaaaaugaaugguuaguuaaugcccaucauauacugaaauaauagucaauccccugaugguguaaaacagaaaaaaggaaaacuuaauucccaaaagaaauaugaaggacuaaugaauauguuaagagauaguuuagcuuacuagagaucaaggaguaagugcuggcacauguggaaaacagaauucugacauguugcauggauuaaguuagaacuuuuauaaguaucagcacugaaaguucucaaauauuuaauuaagagugauaaaaucuaaucccaacauuuuaagaagccgagguaggaggccugcuugaggccaggaggcaugguggcacgugccuguaguccugccuacuccagaggcugaugugggaagaucccaugagcccaggacuuggagcuuacagugaccuaugacuguaucacugcacuccagcccgucuccaaaaaaaaaaaaaaaaaaguaauaaaaccaaacugcagauuacauacagcaugauaccaaggaucuaaucaaauaacucuguguguguguguguguguguguguguauuuaauauguauauaugaaauauguucuuuauggauacacuuaugccauaaauauaagagauggauuuuacacauaccaaccucucaaugacuguaucaggaauggacagaaugaaauaauuuuaaugccuacugaagguugagagcucuggguuuccaguucuagcaacuaggugaaaugaccuaaaguggaacucccuccagccauaaucaaguaagaaacugcaacacaguaauguauauuuuuaaacuagccugaagaaaaaggagcuuuuucucucuuccuugcugcuuucuccucuuccuuuguucauguuugcuauaccucauuauucaacagugagaugacucaucaaaauaauucaauauaaggccgggcaugguggcucacgccuguaaucccagcacuuugggaggcugaggcaggcagauuaccugagcucaggaguucgagaccagcugggcaacauagcaaaaccuagacucuacaaaaaaaauacaaaaauuaguccgggacaguggugugugccuguagucccaguuacucgggaggcugaagcagaauugcuuaagccugggaggcaaagguugcaaugagccaacacuguaccacugcacuccaacuugggcaacagagcaaaaacuugucucagaaaaaaaaaaaaaucaauauaauuaaaaaauuuuaaauaaaaaauaaaaccuuccaaagaguaaaauuacuaggagccagagguagagguagauaguaaauuuauagacagaaagauuaagcuauggcagugcagugggcuacaaaaacaaauaaaaaugcuaggggcuaaaaagacguggugcuagagcugaugucucaguauacagaacuucaacaaaaagagcaacuuuaaaaaugcccacggacccaaggagacagcagggagucaugucugcccagaacauugaguggccacuguguuucuauaaaaaguggcuucagacagaaauuaaccagaguugaaaauuauuacuuuuacccauagugagagagagagagagagagagagugugugugugugugugugugugugugugugugugugugugugugugagagagagagagagagagagagagagagagagagagagagagacagacagacagacagacagacaaagaccauguugucucuaaaaaaauucucaggcugggcacagugacucacgcuuauaaucccagcacuuagggaggcugaggcaggcggaucacuugaggccaggaguucaaaaccaggcugauuaacauggcaaaaccccaucucuaccaaaaauacaaaaaauuagcugggcauggugguaugaaccuguaaucccagcuacuugggaggcugaggaaugagaaucacuugaacccaggaggcggagauugcucagccacugcaguccaggcugagugacagagugagaaugucucacacacacacaaaaguucucauuccaugaaugcaaaugguacucuggaggacuacccgauaguuuucuuaaagcuaucaggaaacaguaacuucuguaaagccuuaccuugaucgacugcgauccuuauuacgaucugagcuccuuucucuaucccggucacgaucucucucucgaucccgaucucggucucucucuuuuguccggucacggucccuaucccguucucguucccgcucccguucuuucuccuuuucucguucacguucucuuucccuuucucguucccguucucgccuuucucguucccuuucacgcucccucucucuuucucuccguucuuucucaauuuccugucuuucuuuuuccuuuuugccuuucucuucuuccaguuucuagaaaccaauaaaagcacuuuuagaguuaacucuguagcuccaguauucagauuuuucccggcgcaaagcccaguacugggaacaaaaacaccaaaccacugauacauuaauauuaaauacuugugguuuuaugugacaaauuaaacugaagcaaucacaagacuagaaagauuucgugcaaaaccauauacucuacacagaccaggaaucuccaaucuuggaugcugggagauugugucagguguggcuggccacucaaugacuauguacuaacuaaaaugaccaugaagaauguggugguucgaaauauuuucuaugaauacgaucauugguuaaaacucaacucugugcauuauagauuucuguaaauccacaagauuauuaauacuaauuaaaaccccagacugcacauuaccucaaguugaggguuucaaagggcaagugguauagaagaauaccuauaaugcaacuaaauaaucucugcccucugauuugcccacccuccaaaagaaacacaagcugaauucagccaagaacugccuuaucaucuauggaaacauuuacucccaccauuacaagauggacagcccaccaaauacaaaaaguuugaaaaucacucacuucaagcaaaauauauguaacuguaauaguuuaauuuaaaauauuuaaaagcaacauacuuaugcccauuaugccuguaagacaaugaaaauauauuuacaaugauaaauccauccuuggaaggaacgauugugcauuaacuuacagaugcugugcuaggacauggaucgccaacacuggauuaaccuugccuacaagcuauguuucugggaggaagagcaaguacaugguucacaaauaaaccaaauaacaaagucagaccaaguuuguacccugacaagauuaccaguguaccacacgguuucuacacaaacucagaaaaaaauaccccaaacagguaaaacaaaacaaaacaaaacacauuuaucccuuuuguuucacguuuaguuucaccaaaaugaaauuuuaaacugcaacaauaaaaugugcauuuuucuuuucucagucauguaaugcauuuaaaacaacuuuaaaaagcaaucuuaccugucagauacucuuuuucucuuccucauggaucagagaacuuauagcagguuaugaaaggaaagcuaauguaugagcaauauauucaguugcugugccagucuauaucgaaguagaauacgggcaaagucaaaacugaauacauugaaauuacaaagggaugaaauaagauaugauagaaagaggacagaaacuaacagcuauuaaagggggaaaaaucucauuucugaaacaguuccaaugaauauaaaaauuuauauuguaaaaugaggcuagacuauauaaaacuuaccucaauggcauacacuuauaaagaaauuuguuuauuucugaaauagauacuuacagaauauuuuagcuguuccaauacuaauuuuuccuguagaauuccucaauuuuuaauucuugcuuauuucacugugcuccuuauauucaguuauauaaauaaccauuuguuucagaacucauuucaaaaguuugguucuaaguaaaugaaaaagugagugaaucuaguccauacuaaauguuuccugaaguuuauauaugagauauauauauauauauauauacacacauguauacaaauacagguauacauguaaacauacauguauauuuuuaaagaaagacuggagaagggaaaugaggugagucuaaaauuauguaagaaagucaugaagaggaaaggacagauuaaaaaaucauaaaucuuaccuuauucucucuucagacucauccgugcuguaaauggacgcccccugccacgcugauacccugacagucugugguuauuuaauaaacucauaccaaaacaugcaaagguucacugagcucauuuuuuguuacuggaguuucaaacaacccuuuuagccaaaccacccaauaaaaaacaacuguuuugguuuuucauuuugauuucuuuuuauuuugaaaagacauucugaaaauucaaaacauucccuccagugaaauaauacuaaggcaguaaaaugccuaacagauucccaaacuuuaaagcaaauauauuuuugaauuuuucuuaaaacaugauuuccucauaauuuaccaauaacaugacaggguuuaacaaauaaauaaaaacaaaaaggggguaaaccacacacacaaccauauaccauuuuuaagcuuacucgguccugaauuucaguauuauaccuaaccaaaauuauucaucuaaaaugauuucccauagaccaccuuuucaacucucaaaauuaauuuugggagaauuauguuugugcucuuagacacauuuaauucuugaaaaagcauuguguuugugagcaagggcugggcaucuggauaguaaguguucagcagcacugauucauuggcauuauuugugaacugcagauuuugaaagcaaugggaaaaaguaagaauaaaagagaaaaugaacauuuaacauuucacugaguuaaagaucucucagucuaucaguaagaaccagcaacaccuuauuaucucgaccaucaaaauacauuucaugcaguguuugcauugcaccguucaaaagcaucauuuucaacaccagcgaacauucacagaugcacugucauugagagaagcuucaaauaggcaaaacucgugagugggauuuacuaugcauaaauacccauuuccaagccaguuaccccuuugcauauuuuucugagggggcauccauaaauauaauaaaaaacagaagcucauacuuacauccuauuccuuguuacuuuccaagcugagaguuucaucuugcauuagucaccauaugaucucuaucauaauggugggggucaaugaauagauuagcuuuaugggaauuuacaguucuuccaugcaucuaaaauuugguaagucugguaaccacugaccuacuguuuaaaaucucccccacucaacuuaaaucuauacaaauauaaaauguaaauuuuaaucucagcucuaaagaaaagguauuccuaagaucaaguuaaauaacugcccccagaaauacacuacaguguauguuauccugcugcccccugaaucuaauuuaagucugaccuugauguuuauguugaaaucuaaaaauaaaauuagcuucuauucauauuaaagugagaugacugcagaauagucaguaacugaaaaaacuaagcacaacaugucaaggaccacuuuaauaugguauuggucuucuguuucuuuuuucuaucuaaauaucaauuaaaccuauaaaaaacauuuaaaauuauauucuaauuuaagguugauuuuuuuugucucuuugcuuuggauucuguaaaaagucuagauugguaucaagugaaaagacaagaauacuaccuuaugugugucucugaauuugcugaucucucgagauaucaggucucuuuugucuucuuccauuucuauagcauuuauauccuccuaaaagaaaacgggcacaggagggaaugaauaaagaacacccuacuucaauauaaacaguuaaagguuagauauucuguauaggucucaaagaguaaauaaguaaacagaauauccacaauaacaaaucuaacaaucuaaaguuaaauagugaaaaaucagauagacaagaaugacaaaucaacaaucagcaguaaacacagguauugucaaagccuacaauuuaaacuaaccuuagugaugaguggauaagggaucaguggggccacuggaaaucugcggaaaaucugugaaaaaauccaccaagaaucuuuuuuaaaaaagaaaaacagagcucauacuaaucugcaaagcaaugcccuauacauuuaugacgugaacaauacaguacacuucugugaugcuuucuugauuucaaauuacuugggaauagaagugauuucacucuuuuuacaauaacugaucacacacuacccuccucucuggauacuccaacacccccaagaaauggaaauauagaaggugcucucauaguagcagggcuuucuaaucauaccaacaauauuuacccauaacuccugccacagaggaagaauuuauuaucuccucccaauccacaucaaacaaauauguuauuuuucuccuuucccacuaaugaagaaagaggaagaaugaauucuacaggccucaauuacccuguaccuuacugacccuaccaauuaccauuccuaacagaauacaccuccuuagaaaaguuaugggucgggcacgguggcucacgcggaucacgaggucagcagaucgagaccauccuggcuaacacagugaaacccaucucuauuaaaaauacaaaaaaguagcugggcguggcagcaggcacguguagucccagcuacucaggaggcugaggcaggagaaucgcuugaacccgggaggcagagcuugcagugagcugagaucgcagcugcugcacuccagccugggcaagugagugagacuccgucuuggguggggguaggggcgggaacaaaaaagaaaaguucuaugaccaaacgaggaaacacauaccaaauaauaaaaauguauguaucuggccacaaagaaaacugaauauggccuaaaaaggcacugaaauuuaaaauaauauaaaauguaaccauccauucauaacuaaucauaauauauauaccacguaguacuuuuuuauuacauaaugcaugcauauaaaacacguugagccagcuaugagugauucacacuuguagucccagcacuuuggaaggcugaggcaggcagaucauuugagcucaggaguucaacaccagcuugggcaacauggugaaacccugucucuacaaaaaauacaaaaauuagcuggguaugguagcacaugccuauagucucagcuucucaggaggcuaacacaugaggaucacuuuaggauggguauucaaggcugcagugagccguaauugcgccaccauccuccagucugugugacagagcaagauacugucucaaaaacauaaauaaaacacuuccaauauuugugggauuuuuuuucuuacuuuauagaagggucucgcucuguggcccaggcuagacucaaguucaugggcucaaguaauucuccccucagccucccaaguugcugggacuacaugugucagccaccacuucuggcuucuuccaguauuuuuaaaagaacacuuccuauaauuuaucuaaguuuauccaaaggaaauaaguaugagaaaacuaaaccuuuucuuucaaccuggacaauuagcuuagggccacaaagagguagcaaucaauucacugaggaggaauguuucaaguuguacugcucuuucagaauccuccaguuugauuauucaauaccauuauuguucagggaggggaaugugacauaguuucuuaaggaaaggcagcuaaaaauuaagaguggguggaaaucuucagugaaucagaucugguuucuugcuuagaacagagacagaacaaccauaggcaaacaaaguaaaauaggggccgggcgcaguggcucaugacuguaauccuggcacuuuaggaagcggaggcaggaggauaaccugaacccaggaguuggagaccagccuagaaaacauagugagaccuugucucuguaaaaaaguuuaaaauguggccgggcacgguggcucacgccuguaaucccagcacugugggaggccgaggcgggucgaccacgaggucacgagauugagaccauccuggcuaacacggugaaaccccgucucuacuaaaaaccaaaaaauuagccgggcaugguggcggaugccuguagucccagcuacucaggaggcugaggcaguagaaucgcucgaaccccggaggcggagguuacagugaacugagauugcaccacugcauuccagccugggagacaaagugagccuccaucucaaaaaaaaaaaaaaaaaaaaaagaaaagaaaaaagaaaacugacauguaaucaaaguauaagagugauaucauaaaaaacaaacgguagaaaugauauguuguugucagaacacauacguccuccuucuuuuccuucuucuucuuccuggggugagaaucagauuccugugagggggcauuuagcucacuggaguauucacgaauuaaaacuucaauagccccuuuaaucaucugaucucuccucuuuguuucuucauccaaggcuucuucaucgucauuagugacaguuucuggccuugcauucuuaaacaaaacagcaaauucaggggaaagaaaaaucaagcaagaaaaucaaaaucacucuacaacaagaguuaauaaacauacauguuuucucaaaaacaucucuguaguccuauuaaacacagaauugguuuuguucuuaacaucagaaaagcuucauuuuuuuauuuaacuauuccugagauacuacuucauuuucauuuucuuuuucuuaauagcuaaaaaauucuggucccuaaauuucaggacuagcacacuauacgacacaucugcaaaccauucacaaguuuucagacuguuuugcucaauagguacacaaauaguaacgacucuuuuaaacaguugaaaauucaguuacguaguaaaggcaaaauacaauuuuaaguuaauugugauagcuaccacucagaaaaagcaaaauuguauguagauuaaacaaacaaacaaaaacaucagauugcuaaauauaccaaacugcaagaaucgggaguuuaggggcuguaaugauggcuuauuuccuauuugcuuucuacgagugcuuauaaugcaggaauacauaccacuuauagaaaccauacacuuacaacccuaacaaggaaucaaaguaaguauuuguaggucuuuaucaauaauuuucuggccaggcgcaguggcucacuccuguaaucccagcacuaugggaggccgaggcgggggcggaucaugaggucaggaguucaagaccagccuggccaacauggugaaaccccacucuacuaaaaauacaaaaauuagccgagugcgguggugcaugccuauaauuccagcuccucgggaggcugaggcaggagaaucgcuuaaaaccggaaggcagugguugcagugagcagagauuacgccacugcacuccagccugggcaaaagagcgaaacuccaucucaauaauaauaauuauuauuuucuaagaagucuagauuauucccucuauguggggaaaauuguuggcuucuaaugugcuacaauaguugugcuacaauaguugugcaugccccaaaguuuuuaacgacuuacuugguaaacauauaccgugcacauuuucagauacauacaagaaccaugcucaugugcauacaugccuggcucuuggucauaauuccugcaacucuauucaaggugaguuucaugccuugugccuccuuaacaauguaacuuagcaguaacuuuauaaguugaccacaagcauucugaaagcugucuccaauggauacguauucaacaaacauuuuauuucuuaaauuaauuugcucaacaaauucuuuuuuuuuuuuugaggcggagucuugcucuguugcccaggcuggaaugcaguggcgugaucucagcucacugcaagcucuggccucccaguuucacaccauucuccugccuuagccuccugaguagcugggaccacaggcucccgccaccacacccgacuaauuuuuuuguauuuuuaguagagauggggguuucaccguguuagccaggauggucucgaucuccugaccucaugauccgcccgccucagccucccaaagugcugggauuacaggcgugacgaccacacccaucaacaaauucuuaagagcauacugugagaaagaugcugcacuuagacggaauaaaauccaaauugaaaaacgcucucuucuccucaagcuguaucacuacagaguaacagauggguuaugacacagauaacuuaaauauaaggcauuacauguuauuacaaaacuaaccacuuggcagggcucgguggcucacgccugcaacccagcgcuuugggaggccaaggugggcagaugacgaggucaggaguucgagaccugccuggccagcauggugaaaccccaucuaccaaaaauacaaaaaauuagcugggcauggugacaugugccuguaaucucagcuauucaggaggcugaggcaagagaauugcuugaacccaggagguggagacugcagugagcagagaucaugcugcuccauuccagccugggagacagagcgagacucugucuccacccccaucaaaaacacacacacacacacagacacacacacacacacacacacacacacacaccucgcuccuguaaucccagcauuuugggaggcugaggcgggcggaucacaaggucaggaguucgagaccagccugaccaacauggugaaaccccgucucuacuaaaaaaauacaaaaauuccccagccgcgugcagcggcucacuaagucaggagauggagaccauccuggcuaacauggugaaaccccgucucuacuaaaaacacaaaaaauuagccgggcauggucccagcuacuugggaggccgaggcaggagaauggcuugaacccgggaggcagagauugcagugagccaauaucacgccacugcacuccagccugggcgacagagcaagacuccgucucaaaagacaaaaaaaauccuuauagacccuaaauugauuauuguuuccacuguaaaccaaaauuuaaauaucaauauggcuauuuuacuauuagagauaaagcauuuggaauuaacuaauucacauuuuuagaagaaaaguuuauuaacccaaaaaucuuaacugauugcuaauauuuaaaaaaaaaacaauaacaacaacaacaaaaaaccuaggccggaugcaguggcucacaccuauaaucccagcacuuugggaggccgaggcaggcagaucacaaggucaggagaucgagaccauccuggcuaacacagugaaaccccgucucuaccaaaaauacaaaaaaaauuagccaggcgugguggcgggcaccuguagucccagcuacucgggaggcugaggcaggagaauggcgugaacccgggaggcggagcuugcagugagcugagaucgcgccacugcacuccagccugggcgacagagugagacucugucucaagaaaaaaaaaaaaaaaaaacaaaaccugaucaugguagaugaucagguuagaaagaccacuccacagacuggcaaguuucaucuaaagcucuaucucuggaauaucaacuauacacgauuuucugauuuccuguuuuuuucuuauacuucagaaaccagauggccgggugcgguggcucacaccuauaaccccaacacuuugggaggccgaggcggguggaccaccugagguccagaguuugagaccagccuagccaacauggcgaaacccaucuuuacuaaaaauacaaaaaauuagccaggcgugguggcgggugccuguacucccagcuacucaagagguugaggcaggagaaucgcuugaacccaggaggcggagguugcagugagccgagauuacaccauugcacuccagccugggcgacaagagugagacuucggugggcagagagggagaaaccagaaagcauaaucaguaauacugggaaacaaaaggugaaggauucagccauauaggaagcugacagauuaucuguaauguuuacauggcccaccuaguugguucuuuucagagaaauuaaaauuucaauaguaaagcuaguagcugugaaguuaaacagcucugcugggcucauucuuuggcacugaggucuagaauccaaaguacgaaccuuuuaaaaaauuuaaggaaaugcagaguucuuucuuuugagaaaauguacucagccaggcuaauuuccaaagauguuccccugaagcagcuguccucuauuaaauagguucuuuccagagaauaacuguuuuuccagcacuugucaguguucauucuugaauauaugguuaauaacuaugacuugugacauacaagcagauauauugucuccuauacuauuuuugcuggacagccagaaagcaauaggacaugaacuaaauuagcauggccaccucacauggaauacuuuacuacuagaggucaauaagaaauggaaagaaaaaaaguuacaccugcaaauucugcaaaaucuaaauuaaaauguucagucaaguuguuugacaagacaccuuacacaugcgcaaaauucuucuuaaaauucugaaucuggcugggcacaguggcucaugccuguaaacccagcacuuugggaggccgaagcaggagaacugcuugagcccaggaguucgacaccagccugggcaacaacgcgagaccccaucucauaaaaaaaagaaaauuuuggggggcaggugggagggauaggauuaggagauauaccuaauguuaaaugacgaguuaaugggugcagcacaccaacauggcacauguauauauacguaacaaaccugcacguggugaacauguacccuaaaacuuaauuaaaaaaaaaaaaaggcaagaaaauuuaaaaaaaaauucuggaucaugaaaaauauguugcuccccuagacaaacucauguuuccuuuuuagucaaugagaaauaaggaacuaauuguuuucucuucugccucagaggaaaaugccuaauaaagcaacacaaaggguuuucaaugucucauucuccuauccucuacuuaacagcuuucuaaauuucuccaacuaaucaacgaccaagaauaaaaaacaaucaccaugucauauuuuuauacugaaaaaucauggcggcaguagccacccaucucacccccaccaucuucuccccucccccugcucccucccuccaaucucucacucuccgacuuucaucucucccuacaccccccaccacccuuaaaaaaaaaaucauggcaaaucucuaaucuacuccacuauauaguaauauuugcuuaaguuauuugaaaauuuuuuuuuacaucagauagaaugcuuuuuuaaccuauauuuguugaguaauauugacacuuaaggaaaauaugccauguuuauccuaugacuucaaguaccaccgggcaagaagccaaagggcacucagaaauacacauauaacaguuggaacaauaaaucauauaacugauaucugucaauuguuuuaauuuuuuauuaaaaauaauuuuucugugugauuuuauugcauguaacuucgcuuuuuuuuugagacagagucucacucugucacccaggcuggacugcaguggcgcaaucucagcuaacuguaaccuccgccuccuggguuuuaagugauuuuccugucucagccucccaaguagcugggauuacaggugugcaccaccacauccggcuaauuuuuguauuuuuuuuuuaguagagauggaguuccaccauguuggccaggcugguuucaaacuccugaccucaggugauccuccgaccucggccucccaaaguguugggauuacaggugugagccaccacauccagacacauauugcuuuuccugaagaccaacagaucuaaagugugguuacucuggcuaauguugauuauacaaaaaauguaagcuggacacaguggcuccugccuguaaucccagcacuuuggaaggcugaaguagguggaucacuuaagcccaggaguucaagaccagccuggacaacacagugaaacuucaucucaacaaaaaauauaaaacuuagccaguaugguggugcauaccuguagucccagcugaggcagaaggaucacuggagccugggaauaggagguugcagugagcagagaucacaccaccccacacucgagccugggugacagagcaacacucuguccccaccccaaaaaaagcaagcaagcaagaaaugugaagucacauaauugugcacuuccuuauuuauaaaaauacguaguauagugacuuauuucauucucagaguuuuucaguauaacauuugcaaaugcuacaaauuaaaugaccucacaaacugaagauuaaacacaagaaaacagugaguccuagcaaaucagaacacuuugaagauacugaauccauacuuucaacuaguuaguauacaguuaucacaaggcaaaccugaaaauucuuauuucaaacauuucuguuuuuugagguuuuagugaugugacaggcaguauuacugauuugaaauaaaauauaaauaaaauauaauuuccuuaugaagcagggugaggauaguaagacugacagauaagcgucuauuaacaaauguuaauuccauccuugcuuuaggcaagacacuguccuagaugcuguggagguacaagauuaaagagacacagcccacaaacuuaucacccuuucuaucuguaaucagagauggggguugaaagagaauaugggaaugagauggguuacaaggggcugugaaagagagagauauauaaacaauaucuacuaaaacagcuauaaagaucugcuuuauaugggaacagaggacuuaauucugucugacagaaacuaagggcaggcugauaaagucuguaugaaucaagggacauguuaauuauaaguauggauagaauuucaacagggagcuuggauaggcaacaaagacaugagaugccagcaaagcaaaagggaagacuguggagguacaugcaguaguaugugcaggggagggaagacggaagcuagaaacguggacuggagugagccuugaaugucauccuaaaaauauggacuuuauggccgggcacgguggcucacgccuguaaucccagcacuuugagaggccgagguggguggaucaccugaggucaggagcucaagaccagccuggaagacauggagaaaucccaccucuacuaaaaacauaaaaauuagcugggggugguggcgggugccuaaaaucucagcuacucgguaggccaaagcaggagaaucgcuugaaccugggagguggagguugcagugagccaagauuucgccacugcacuccagucugggcaacaaagcgagacugcaucaaaaaaaaagaggggggguacuuuuuucuguaagaaauccaaaaccauuaaggaugggucucacauaauauaagcaagaguuucauaaaauuauacuuauguuuuagaaauacaggcaaugcugaccggguggaguggcucacacguaaucccagcacuuugggaggcugaggcagacagaucaccuaaggugaggaguucaagaccagccucacuuacauagugaaaauacaaaaaguagccgagccugguggcggacaccuguaaucccagcuacuugggaggcugaggagggagaaucacuugaaccugggagguggagguugcagugagcuaaggucgcaccacugcacuccagccugggcaagagagggaaacuccauuucaaacaaacaaacaaacaaaacccuacauuuggccaggugugguggcucacaccuguaaucccagcacuuugggaggccaaggagaacagauuaccugaagucaggaguucgagaccagccuggccaacaugaugaaaccccaucucuacuaaaaauacaaaaauuugcugaacguggugguggaugccuguaaucccagcuacucaggaggcugaggcaggagaaucaccugaacacgggaggcagagguugcagugagccaagaucgcaccacugcacucuagccugaacgacagagagacucugucucaaaaaaaacaaaaaacaaaugaaccacauucauacacagaaaaaugucuggaagaacauacauccaaaccgccuacaguguugcuuaugaugaugggauuacaggugguauuuaauugauuauuuauacuuugcuucauuuugugaguuuuuuggguuugguuuuuauuuuuuuuuaacaaagaacuuggagggaacaugaaagguauuucuuuuuucuuuuuuggcagcagggagacagaguuucacucuaguugcccaggcuggaguacaauggcuagaucccagcucacugcaaccuccgccucugcaguucaagcgauucuccugccucagccucugaguugcugggauuacaggcacccaccacaacgcuaggcuaauuuuuuguauuuuuaguagagacaggguuucgccacguuggccaggcuggucucgaacuccugaccucaggugaucugcccgccucugccucccaaaguucugggauuacaggcgugagccaccgugcccagcaaaaagcgauuucuauuuugaaagauaauaaaaauuugacgacagcgaaagacucuucugguuuuguuuguguugggggaaggcauuaauaaaucuauuuuggauuuguucagcaugagaugccaaaaaggaacuaagaagagaaaugaaggaaauauauacucaaguuuuagcuauguuucacuuugcugaggagguaauaauguauacauuaaaauacaauauacaacaauguccuuuauuuuagcuucacuuaguagagcuuggauaaagcccccaaccuaaggcaaguaaucagacuuucauucauuuuagagucgguguacuucuaaaagagagggaaacuaauaaaaauuguguagguugaaauauauuuuguacuuacuuacaaagcugccuuaaugaauuagcucuguuuggaauagucuguaccagugcuuucucuggcaaguuaaccuuguccagccucccuuacuacuuucaucccaaccuggaacaagcaaaccaacagucauccacccacuaugggcagauaagacuuaaaauaacuacaaacuauaaaauacccuccuacauuaagccacaagcacauacaugaugaucuuuugaagccccauauuagauucauuuauaaugagaagcacuacacugaaauagcacagucuggccuagaaaagauaacacgacagaaaacauaccccauuagaagcuuucuucuuugcuuuccauucauccagcugugccuuugucuuugcaucaacuuuaacgaguagcuuuuucucuccaauuugcaggucauguaauaaucugagugcacggaggguagauucuggcuccuuguacucacagaauccgaaggcuagcaauggaugaaaacaauuagugaaauaccaauucacuuacaaaagaaaaaaaauuauggaaaaguagaaucacuagaguccaaauguuuuaauacaaagaccacucaauucauaauuccaccccuguccaccaauucccuuugauaaccauuucacuuuuaguauccucaaacaaccaaaggggaaaaaaagggaaaaacagagaggaagaaaaauucaaaucagacaaacugcuacucauuagaagcucuaauaaaauauuuagcagagucaaugaaauucaugauuaaaaggagucaauuggccgggcgcgguggcucaugccuguaaucccagcacuuugggaggccgaggcggguggaucacgaggucaggagaucgagaccauucuggccaacacagugaaaccccgucucuacuaaaaauacaaaaaauuagccgggcgcgguggcgggcgccuguagucccagcuacuugggaggcugaggcaggaguauggcgugaacccaggaggcggagguugcagugagccgagauagcgccacugcaguccggccugggcgaaagagcgagacuccgucucaaaaaaaaaaaaaaaaagaaaggagucaauuauuucauaaauucacccuaucuagacuuccaaacagccacaagaaagaacagacugcaggaacacaaacaaugcacuuuucaauucugagauguuaaauuacagaauuuguauccuaguuaccagucuauuuuacuuacaucuauuuccuuuuauaacuagucaaucucacuauuaagaugacuuuaacagaaauauuaaaacaaaauuaaaucuaagaagagcaaccaacaaauugaaaauaaaaucaaauaaaucuaaauauguauauaaugacaggaaacagaaaaaaacuacugauauuaaaauaguaaauuugacauuucagugugauauaccauaaagacaaacagauaugccccucaaaaaaguaccuuuaggccgggcgcaguggcucaugccuguaaucccagcacucugggaggcagaggcgggcagaucaccugagaucaggaguuccagaccagccuggccaacauggugaaacccucucucuacuaaaaauacaaaaacuagcugggugugguggcacaugccuguagucccagcuacuagggaggcuaaggaaggagaauugcuugaacccgggaggcagaaguugcaguaagcugagauugccccacugcacuccagccugggcaacagacagagacccugucucaaaaaaaaagaaaaguaauuuuaaaugaucauauugcugaugauagugucaauguuguuagugugaaacuguuauaugugcaaugcaagauaaagcaacucaguaauuaauaguuuaucauccccaauggccuugaaacucggggaccucaguguggggaaaaaggagauacaaauauaugacaaaacaggcuaaauaaaaaccuuuuaguccugaaucugaauuaguauacacuggaaaaaccuaaaagcaaacaccaaaccacuguuuuguuuuuuuuuuuuuuuagacggagucucgcgcugucaccaggcuggaguguaguggugcaaucucggcucacugcaaacucugccucccggguugaagcgauucuccugccucagccuccugaguagcucagacuaaaggagcgcaccaccacacucagcuaauuucuguauuuuuaguagagacaggguuucaccauguuggccaggauggucuugaucucuugacccgccugccucagccucccaaagugcugggauuacaagcucgagccaccacacccaucccaaaccacuguuaauaugagugcaccuaguguccagaucgugaucuucaaaacaauuuccccuggagaaauggcugauucuaagucuggggccgaaaaccuauuauacuagaugaccuuagaacaaauugucauaccagauaacaaagcagcugucaaagguguucagggucaugucaaaaccacuggagauguaaagugcagagacaauuuaaguuaagcuuuaauggugauaauaacuacaaugaauccauauuaaauacaauaacacuaaauaugcuucaauuccuaaguucacaauaauucaaaagaaaaaagaaaaucagucacugcuagagaaugcugaggauagcaacucauuguuuuaagaaagcaagccagugcaucuauccugccuauucuguauuaaauaugccucuaugccaggcaugguggcucaagccuguaaucccagcacuuugggagacugaggugggcggaucaccugaagucacguguucaagacuugccuggcaaccagggcaaaaucccgccucuauuaaaaaaaccaaaaaauuagccaggcaugguggugggcgccuguaauccuggcuacucaggaggcugaggcaagagaaccacuugaacccaggaggcggagguugcagcgagcugagauggugccaucgcacuccagucugggcaacaagagcgaaaaacuccaucucaagaacaacaaaaaugccucuaaguuaccaaacaguagaugcaggggcaacuuucuccauagagaagcauucuacuaauauaugaaaaagauuuguuccucaauaaaagaaugacagaauucuucaaaacagacuacugaugaggccgggcgcgguggcucacgucuguaaucccagcacuuugggaggccaaggcgggcagaucacgagaucaggagaucgagacccuccuggccaacacggugaaacccugucucuacuaaaaguacaaaaauuagcuggguggggugguacaugcuuguaauccuagcuacucgggaggcugaggcuggagaaucguuugaaucagggaguuggagauugcagugagccaagauuaugccacugcacuccagccuggcaacauaacaagacucugucucaaaaaaaagaaaaaagacuacugaugaauuacuuccuaaugaauuaaucaaucuaggcacuggcaacacugaugcuauuacacauacaaaaaagacaaucucacauguguucccugauggaagaauacuaccuuuauaguauucuugcuauaaggugcuagaauaaaaacauuaaaaaaaaaaauagcggccaggagcaguggcucgugccuauaaucucaguacuuugggaggcugaggugggcggaucauaagguuagcagcucaggagcagccugaccaacauggagaaaccccgucucuacuaaaaauaaaaaauuagccgggcaugguggcacgugccuguaaucccagcuucucgggaggcuggggcaggagaauugcuugaaccugggagguggaaguugcagugagccaagaucgcaccacugcacuccagccugggcaagaagagcgaaacuccuccaaaaaaauaaaaaacacaaacaaaacaaaacaaaccaccacacagcacacaucaaguacaacuacugaccacuuuacagaaaacacagaggauagauuaauggcaaauuauaguacuggagcugcauucagcaaaacucaacuuaaaaaauacuauugcacaaaugacccaguuucuucaacaaauaaacugcaaggaaaauuagaaauagaauaacuuaaaauauuaagagucuggccaguuagcucaguugguuagaggauggugcuaauaaaaaaaauuaggagacuuaaaacaaauugccaacuaguugcaauguguggacuucauauagaaccugaaucaaaucaacuauuuaaaaaauuaacauuugaggucaggugugguggcuccugccuguaaugccagcauuuuaggaggucaaggcggguggaucaucugaggucaggaguuugagaccagccuggccaacauggugaaaccccgucucuacuaaaaauacaaaaauuagccgggcaugguggcgcacaccuguaaucccagcuacucaggaggcugaagcaggagaacugcuccaacccaggaggcagagguugcagugagccaagaucacgccacugcacuccagccugggugacagagugagacuaggucucaaaaaaaaaaaaaaaaaguuaacaggccaugauugucucuucuucucccuuacuaauuguuccauuuugaucaugcagucauuucuugagacaaaagagacuuuugaaagaacaagaaaccaguuaaauugagcaauuuuaauuuuuuccuuuccucuuacaccuuuuuccuccuucugaucucaauucucagccaauauuuucccaaacugccuuuuaacccuauuucaauaaaaaagaggacaaagagugcuaauaaaauaagucuuacugauaaagacaaugagaguuaagucaugcaaagugauuuaagcacacagguuaguuaaagugauuucagcaaauaaggaaaaaaaugacauaccuugaagcuuuccggaagcaccuuguacucucuuccagcucaaaaccaaaccacauuucuuaaaaagaaaacaaaacaaacagauugcuaccauuuaacaaaauaauuuuuaauguaacuaaaagcaaaauuauauuucuacuagggauaaaaaacauaaaauaaaaaaccagcaacuacauuugcgaaaauuuuugcaauucccacaaacuuaucacaugaaagaaaugaacaacaaaucauuuaaagaaaaauauaaauucuuacugauucuucauuugcagaacauuguuuaccuuuuauuaaaaguuucgcaucacuacuuauccuaacaaaauaaacacguaaaccuaaaugccuaaaauuagaaugguuaaaacaaacuauaauaaauuuaaguaaauauuaugaaucuauaaagaaauguuuugaaacaauauguauguauuuauaaaggauuuuuuuuucuuuugagacggagucucgcucugucacccaggcuggagugcaguggcgugaucuugggucacugcaaccucugccucccagauucaagcgauucuucugccucagccuccuaaguagcugggacuacaugcaggcaccaccacgccuggauaauuguuuuuuguuuuuuuuuuuuuauuuauuuuuaguagagacgggguuucaccauauuagccaggcuggucuugaacuccugaccucgugaucugcccgccucagccucccaaagugcugggauuacaggcacgagccacugcgcccagccaucccauuaacaugggaaaacgcuugauacgguaugcaaaaauaacuugggaaaagaaaaugcagauacacagcaagacucuaacuauaaacaaaaacagcuuucuguaaaaauaaagagaaauauuccaaaaugugaaggagggcagguuaucugaacgguaggacacuauuauacuuuaaaaauaaaagcagcgagguguagcucacgucuauaaucccaacacuuugggaggcugauguggaaggauugcuugagcccaggaguucaagaccagccugggcaacauagggagacacugucucuacaaaaacaaaaaaauuaggcgggcgugguggcacacaccaguggucccagcuacucaggaggaugagacggauggauggcuagagcccaggaaaucgaggcugcagugagcuguaaucaugccacuaugcuccagucugagcaacagaaugagacugucucaaaaaagaaaaauaaaauaaaguuccauccaguuaaaaaaaagacagaaggaggaggguguaggugagaaaucuucagagaacaagagaaaacuaauggaaacuugaaacauggcauuaaaaauaaauauuucaauguaagucuggaagguaaaguuaaggacaaaucccaagaacccgugcaaaauaguaagagauggaaaauaggaaaucaaaaacacauaggucaaaccuggaagcucaacauccaaacagaguuccugaagaaaguaaaaagaauucucaaauagcucaaaauuuucuccugaaaaaaggcuccagaacgaaauggcccaccaaguaagugaccaacacaaugauauaagaaaaauaagaaaaucaaauaaacauucgaagaauuucacauaauuaggaacuaaaaccuccaaucagucaaauccucacuaggagaggcauuccagggaaaaacaguucacacacaaagagcauucagaaugaugcgggacuucugaaaaccaucauuagaugcuauaacacgauaaggcagcaccuucaaugugaggaagauaagcuucaucaccgaauucuauaucccgguaaacuacugaccacaugaaauaaaaagcacuucagauuuagauucagaaaaguuaccaaccacauacccauauauaccauguacaucauauacagaggauguaucaucccaauauaacaggaacuacuaugugucggcacaagcaagauauaggauccaaaccacccaacacagaacagcaauaaggggaauacuagaaaagacagaaaaaaauccaaggauaaaaguagacuuagaggaaccagaacacaugagacgaacaaagggaccugacaggaggagcucuagaaaagaagggaaaagaauccccacacuuugggaagccaagguggguggaucacuugaggucaaaaguucgagaccagucuggccaacaugguaaaaccccaucucuacuaaaaauacaaaaauuagccggacgugguggcgggugccugaaaucccagcuacuugggaggcugaggcagaagaaucacugacccgggaggcggagguugcagugagcugagaucgugccacugcacuccagccugggcaacagagcgagacucugucucaaagauaaaaaauaaaaaauuaaaauaagaaaauggacuaggcaguggcucacgcauguaaucccagcacuuugggaggcugaggcagggagaucacuggaggucaggaguaccagaccagccuggcaaaccuggugaaaccccgucucuacugaaaauacaaaaauuagccaggugugguagcaggcauccauaaucccagcuacucgggaggcuaaggcaggagaauugcuugaaccccggauggcgagguugcagugagcugagaucacgccacugcacuccagccuggauaacagagugagacuccaucucaaauaaaaaaaaaaaaaaagaaagaaagaaaacaaaccaaagaaagaaaauacaaucauagcacauaaccuaguucugcuaaaacuauuuacauaauaauacuuauuaucaaguucgccaucuuguaacaccuguaaggaaguagggaagggagacugaggccuuuaacaguuuaggccucaagcuaccauaacaugucaacagauaauaucaaaauuaugaagaacaguaaaaaggcauauugaaauaggaauaagguauuucacaacacaauguaaaauucuaaauaaacaccaauuguuaaaaaagauguguaagagggccgggcgcgguggcucacgccuguaaucccagcacuuugggaggccaaagcgggcagaucacgaggucaggagaucgagaccauccuggcuaacauggugaaaccuugucucuacuaaaaauacaaaaaauuagccgggcaugguggcgggcgccuguagucccagcuacuugggaagcugaggcaggagaaugucaugaacccaggaggcggagcuugcagugagccaagauggugccacugcacuacagccugggcgacagagcaagacuccaucucaaaaaaaaaaaaaaaaaaaaaaaaaaaagauguguaagaauagaaacucggacaugacacugcugcaguaaauauaaauaaauugguguggaauuaucuuguaaagcugcagauaagcaugcccuaagacucagaaacggcacuucuaugagaauuugugaugagaaucuuuucacauacaccuagggagaaaacauuagcaguaauaacauagcaaaacagagacuuccagaagcagacaggagcaaacacauuucuauacuccaguaccuucugacuuuccugaauuccauuagagcagaguaagugcuaguucucugcagaccucagauuaggccuuguggcuacagugaaaagaagcccaggagaaaacucaagaauaaaaauggagucaggcuucagacugaaauuaccaaaaaucccauggaaguaauagaagaaaacaaaacugagaaacccaaaacauccucaaaccaguuaauuaaaacuuacagagugcccaggagauccagucuucuaaaagaacaggaauuucuuaaauaugaauaguugaggaacaagaaucaugaaugauguaaaguaauugcccagcaucucagaggggcauaaggagagcaggcaacaauauuuccagaggauggcaagauugcaggacucauacugaacuacucaugaggugaaccacagguugagauaacccuggcccuguccuuacagagaaccuacacaagauucugggauacagacgaagaaugacaucuuugcagauccucucagugcagaauauagucauucuuccaaacuccuuuuuuugugugugagacaaagucuaacauugucacccaggcuggagugcaguggcgccaucucaacucacugcaaccuccgccucccagguucaaaugauucuccugccucagccucccgcguaguugggauugcaggcaccgacaaccacgccugguuaauuuuuguauuuuuaguagagaugggguuucaccauguugaucaggcuggucucaaacuccugaccucaagugauccacucaccuuggccccgcaaagugccgggauuacaggugugagacaccgcaccuggccuuauuuuauuauacaaucauucagcauuauuucacuuaacaauguacauguaucaucaagauaaaaucuuaaaaagguaaaaaaagugaaucaacaagcuuaccaaauuuaaacaacuuauuacuauucaagcucagaauaaaacuuuaaaaggaaucagucaaucaucauuggaugcuaaaaucauuguuuaacaucauuggggaaaaggacucacagucucaaaauauuaacccuagccaggugugguggcccacgcguguaaucucaacacuuuggaaagccaacgcaggcgguuugcuugaggccaggaguucaagacaagucuggauaacaugaugaaaccuugucucuaaaaaaacacaaaaaugagccaggugucauggcacgcgccuguaaucccagcuacuagggaggcugaggcaugagaaucacuuaaauacaggaggcagaguuugcagugagccaagaugucaccacuucauucagccugugugacagagcaaaucugucucaaaaguaaauaaaaaucuuucauuggaucauggaugaaaaauaaaacaacuauuaauauuauggccauuacugggaaaauuaaauaugaacuacaugugcauuaguuaacaauauuauaucaauuuuauauauuuuuuuguuuuagagacucucuugcucgggcuggagugcaauuacaagaucauagcucacugcagccuucaacuccuagacucaagcaauucucccaccucggauucugaacagcuaggacuacaggcgugcaucaccacaccuggcuuuuuuuuuauuuuuauuuuuuaaucccugucauuauuuuuuugagauggagucucgcucugucgcccaggguggagugcaguagcgcgaccucagcucacugcagccuccaucucacggguucaagggauucuccugcuucagccacccgaguagcugagauuacaggcacacgccaccacgccuggcuaauuuuuguauuuuuuguagagacagggucucaccauguuggucaggcuggucucgaacuccugaccacaaaugaucugcccaccucggccuccugaagugcugggauuacaggcaugagccacugcaucuggcccuauuauuuuuuaauuuuuuguaaagaugugucucgauauguugcccaggcuggucucgaacuccuagcuuaagagauccuccugccucagccuugcaaaggacuaggaugacaaccacaggcaaaagccacugcacccggccaaauuucaugugugauaguggcauugugauuaugucgcagaauguccuugcucuuaggagauaaaugaaggauucacaggugaaauguuaugccacaauuuacuuucaaauuauccaagaaaaaagugugugugguacacauguguacauaaaauaucuaaacauguucauuggugaaucuaggaaaagaauacaaacguguucacuguacuuuuucaccuuugcugcaggacugaaauuuuuuaaaauaaaaagcaaucacugaaagucuucuuucugcuuaaguuugaaauguagaaugauaaaaaaauuuuuaaugaaaaauaaacaguuuaacuuacagcuaagaguugucuuauaagcaugucugaagcuuucucggaaauguugccaacaaaaacagugguaguaggaccacaauuuucaucauuuucuuuagccuuuaagccuggaugauccuuucuugcgcccaaaugcuuuccaaccauagacacaguggguacuaagaccuaaggugaagaaacaaaauaaaaauugauccagcaauuaaauuuccuaccacaauuaacauuaggcuaaaaacaucaggauuaaauaaauauauauagcacauuauuuaagcucugcaugcuuguauacuucuaaagcuccuaaagugcauagcacauuucauuaaugcaaacuuauuugugacaaguaaacuucuacuacuagauuaccuuucuucuuaaaaaagaaacaaaaauaaccaagaaaacuuuguuauguuuaagacauaauuuuuacuuuuauuuucugaaacggaauuucgcucugucgcccaggcuggagugcaguggcauaaucucggcucacugcaaccuccgccuccuggguucaagggacucuccugccucggccucccgaguagcugagauuacaggcgcgcaccaccaagccuagauaauuuuuuguauuuuuaguagacacaggguuucaccauguuggccaggcuagucuugaacuccuggccucaggugauccuggccuaugucuugaacauuuaaaauuuaugccuuaggccauauaccuuaggaagguaggaggaaacauguaaaagguaguccacacaaauuucauuucaaaauuuuaauuuuuacaaggauuccuauguucuuuuaagagaucagacaugucacauccuucucccaucucccaggaccaagaugagaaggcaaugaagagccaaaguccuaaauuuguaauaacaaguauaugaagagucuagauaguaacaggaaaaucauagaauuaucuacuuagggagcacauugcaagggcaacugcauauaugcacaccuaagugaaaaugauacuuauucaaauaaaugauaugcucuacaggggugcugucauucuguccuuguuauucuuuuaaauacucauaauuuaucuaaguuuaucaugcuguucagcuuaaaagcacuagcacuaccauaacucaugauuccuccuuuaaguuauacuuacaguuggagcaggagccauaaugcucauugguacaggaaucauuggggucccuaagaaaagaaaaaccacacugauuuuacaugacugcauucucuaucaacaacaugccacacaauuaaguauccuuacucauaauuaacauaaguggaaauauaagacaaaugaaagugaaauacugauaaauacuaucuuauuuucaaaaggaaugugguaucagguugguccauauaaacuuacaaaaaagacuauccugaaaacaaaauggccaccucaauaugcuuuugacuuaaagagcauaaaauccuggauaguuauccauucggguucaugugguucggugauccucaaaaccaaugccuuucacaaauacagacugacuuauaggugaacaaugcuauuaaagaauccuuuaaaaguaaaaacagcugggcacgguggcucacgccuguaauuccagcucuuagggaggcacaggcaggaggacagauugagcccaggagaucgagaucugccugggcaaaauagugagaccccguucuccacaaaaaggaaaaaaaaaaaagaccaaaaaaaagguaaaacacgucgugcaacauggugauacaguuaguaaguguacuauauucuugaaaauaacuaagagaaaaucuccacuuaaaaucuaggguguucucacaacaacaaaaaauaaguauguaaaguaauacaccaaguguuaauuagcucaauuuagucauuccacaacauauguuauuucaaaacguugugcaugauaaacauauaaaauuuugucaaauaaaguaaaaacaaaucuuuugacaguuauuuuaagcaugagaugagaaauuuauguguaaaucuaagaagaaucuuguuauuccuggcucuuucgcagaaaauaaaaaucaugggccgggcgcaguggcucacgccuguaaugccagcacuuugggaggcaaagauggguaaaucaccugaggucaggaguuugagacuaaccugaccaacauggagaagcccuguuucuacuaaaaauacaaaaauuagccaggcguaguggugcgugccuguaaucccagcuacucgggaggcugaggcagaauugcuugaacccgggaggcagagguugcagugagccgagaucacaccauugcacuccagccugggggacaggugcaagacucuguaccaaaaaaauaaauaaauaaauaaaaucaugcuuguaguuacagcuauucuggaagcugaggcacaaggaucccugagcccaggaguucaaggcugcggugugcuagcauugugccuguguauaaccacuguacucuagccuaggaaacauagcaaaacuccauuucuuuauuuaaaaaaaaaaaaaaaggcagggagugaggggacacgguagcucacacccauaauccaaacacuuugggaggccaagacaggcacaucgcuugagccaacacggcaaaaccccaucucuacagaaaauacaaaaauuagccgagcaugguggcacacacucauaaucccaguuauuagggagacugaaucaggagaaucacuugaacccaggaggcagagacugcagugagcuguaauggcaccacugcacuccagcgacagagugagacucucucaaaaaaagcaaaacaaacaaaaaaaaaaaucaaagaaauuuaaaaucuuuucuauaaacccaaucuacugguaaggaaauuaaagcacagauucuccauaaccaucuuuucugauucuaaacaagcaauuaagcuuacugccaccccccaccuccccacaagacagggucuuucuucccuauguuguccaggcugaucuugaacuccuggguucaagaaauccuccugcccucagccucccaaagugaugggauuacagguaugagccaccaugcccagccuauaacuucuagaacacucgggcuuugcaucaugguuaugguaaggcccaucgaaaaacggaucugagucagucaugguggcacacaucuauagucucagcuacucaguaggcugaggcaggaggaucaguugaguccaggagauagaggccacauuaaguuaugguuaugccacuguacccccagccugggagacaaagagagauccugucucaaaaaaauuaauaaauuaaaaauuaaaacccagaacugcauuaugagccuauaaauauaugaagaaaaucaggauauacggaccaaagagaaaacugaagcccaaaugaaaguuguucaaaacacuuuccuucuauaacuauuaaucuguuugauggcugauaacuaacuuuauucaguuuucugcaacauuuucucaauuuucucaauagaauuuccuuucagcaaaauucauuuuaagaaaaaacuuuguccaaagggccagcuagagccuuccaguagaauuuagucuauuuaugguccauuauaaaacaacuaaguuacuacuuaaaaucaguaauuguuacaugggauaauaaagcaguaguguaaacuuuuacauuacucuucuggcagcagaugauaacaaauauacauccaugauuaucuagaagcacagcguaaagcagcuccacuacaagcauaaugucuaaaauagcuuauuaaaguacugcauucuauuccauaauauacaugcauaaacaguuguucugauuuuuuuuucuuuuugagacaaaguugcauucuuguugcccaggcuggagugcaguggcaugaucucagcucacugcaaccucugcuucccaguuucaagcgauucuccugccucagccuccugaguagcugggauucacgccugagccaccacgcccagcuaauuuuuuguauuuuuagcagagauggcauuuugccacguuggccagacuggucucuaacuccugaacucaggugauccacucaccuuggccucccaaaguucugagguuacaggcgugagccacugugcccggccugauuuuuuuaaauuaugauuuuccccaaauucuugaaguguuaaauaauauuccacagaaauucccauauuuaucuuggggcuuuucagacccaaggguagaagguucccaaagcugagccuguggcaguaaauuaaaaauuuuacaaugaguaguugaauccaaaauaaagacaaggucaggugcaggggcucacaucuguaaucccagaacuuuggaaggcugaggcaggaguauaccuugaccccagaaguucaagaccagccuggacaagauggugagacccccaucuuuauaaaauguuuuuuaaaaaaauuuuaauuaacugaacaugguggcaaaagccuguggucccagcuccucaggagggcugagaugggaguccaggaggucaaggcugcagugagccaugaucgugccacuguacuccagucugggcaacaaagugaggccucgcccaaaacacacauacacacacacgcacacacaaacaaaauaaagacaaaugugcuguuuauacaacccccguaacauacaugcuaugaauuaacaacccaucauaagucagccaacugcaauguucuuaagucaaaagaaaaauuucuuauaagcaaagauuuuuguuuuuucaaagaugaggucucacucuuuggacuugaacuccugggcucaggccauccucccaccucagucuccugaauagccaagacaacagacacgcaccaccacacccagcauaagcaauguucacuauguacuucaggauaaugguucucaaauguggauucuccaugcuuaaaugagugccaaaaauuaccugugaacuuguuaaaaauuaagaauccugagccccaauuucugaggaucugauucagggggauggagcagggucugaacauuuuuuuuaacuccauaaaucuuuacuuauauugacuuauaauauacacuuuuaaguaucuggaaaaaucaagaaaaaacuaauaaccuuauugcuucccuuuuuaguaaggggauagcaauagcaguuaugggaguauaugaagaaaauuuuucacuguauuacuuucuguauuuuuuuuuuguuuuugaacaauguguauguauuacccauuuuuuuuaaauauagaauuuuuaggcugggcaugguggcucacaccuguaaucccgcacuuugggagccggaggccggcagaucauuugaggccaagaguucgagaccagccuggccaacauagcaaaacccugucucuacuaaaaauauaaaacuuagccaggcaugguggcaggugcgugcaaucccagcuacucaggaggcugaggcagagaacugcuugagccuaggagguggagguugcagugagcggagaucgugccacugcacuccagccagugugacagagcaagacucuagcucaaaaaaaaaaagaauuuuuuaaaaacuuuccagaugagaagaaaaaaaaaaauuuccagaugaguuugauacucagccagauauaaaagcuacugcuauaggaaaaagagacauccacauuucccaaacaacgcugagaggcaucuucacuaacacagucacauaucuaacauuuuccugaaguuaguaucacaaagacaaaaguacaaguuuaacgacaaaaaacaguaucaacaaacuuaccuggagguacagguggaggaaauccuggaaacugcgggggugggaucccuggugggagugcugggauucccaugggagggcgauucaaaugagguggaaaagacauucuuacugcagcagucuaaagaaaaaaggacaugacaaaucauuuuauuugaaaacgucacaauuuuauaugccuucuuuguugacuuucauuuuuagaguaucugcaaaauucugaacuuuucuuacccaaagaaauuggcaaagacccucuuuucauugagaauucuuacgacuuagauuuuuucuaaaauaaguuuccaaaauguacaugaucgaaguucaggacagacuccuacaaucauguaggaauacauauaaaggaagaaaaaaauuuugagguucaguuaauauccaaaaauuaaauaccacacauaaacgaaucuuuuuagaccaaacugagaauucagauggguaucuaauaguuuuuaaguguucugauuuuuuuuuuuuuuuuuuuuugagacagagucucacucuguggacaggcuagagugcaguggcgcaaucucugcucauugcaaccuccgccucccggguucaagcgauucuccugccugagccucccaaguagcugggacuacaggagcguaccaccacgcccagcuaauuuuuguauuuucaguagagacgggguuucaccauguuggccaggauggucuccaucucuugaccucaagugauccacccuccucggccucccaaagugcugggauuacaggcgugagccaccaugccuggccuuuuuuuuuuuuuugagauggagucucgcucuaucgccaggcuggagugcaguggugcaaucuuggcuuacugcaaucuccaccuccuggguucaagcaauucuccugccucagcuuccugaguagcugggauuacaugugcgcgccaccacgcccagcuaauuuuuaucuuuuuaguagagacgggguuucaccauguuggccaagauggucucggucuccugaucucacgaucugccugacucagcuucccaaagcgcuaggauuacaggccugagccaccgcgcccggcccauuuuucuuauaucuaucagaauccuaaaaacuaaagguaccaaguuacacaguauuuguugcuucaaugcuggccacuaccuaagagacaaaugugcucaugaaccauacaucucagcagggggaaauaaacuccugacuuccagucagauaguaaccauucaaauauaaagagaacauacaacuuuugacaagagaaaaaaaagucauaguuuuuuuuuuuaaacuuaaaaguaaacuuuguaaccauucuugaaucaaaacugaagaaucagaagcuagcauuugauuuuuuaaaguuuaagaacagguugguugcaguggcucacgccuguaaucccaacacuuugggaggucaaagcggguggaaaaccugaggucaggaguucgagaccagccucaccaacauggcgaaaccccguccccacuaaaacaaacaaacaaaaaaaaauuagcaggguaugguggugugcgccuguaaucccagcuacucgggaggcugaggcaggagaaucacuuguaauccacugcacuccagcgugggugacaggggaagacucugucucggggugggaagaaaaagaaaaagaaaaaaaagaacacauuuaacuguuucacuuaguuugucauguuaaagaaaacuuugucauuuuauuaaguauugccauuuaauguuaauauuuaaacauuagcauuuuuaguauuaaaaacaauuuccaaauuagccaagcaugauagugcauaccuauggucccaacuacuugggaggcugaugcaggaggauggcuugaggcugagagacagagaaagacccugucucaaaaaaaaaaaaaaaagaaagaaaaaaauuuuuuuuucaccucaaacuuuauuuucagcaacacacuuuuuuuuuuuuuuuuuuuuuuuuuuuuuuuuuaagaaacagggucggccaggcacgguggcucaugccuguaaucccaacacuuuugggaggccgaggcggacacaugaccugagguugggaguucaggaccagucuagcuaacauggagaaaccccaucuccacuaaaaauacaaaauuagcugggcaugguggugcaugccuguaaucccagcuacaugggaggcuuaggcaggagaaucgcuugaaccagggagguggagauuguagugugccauugcacuccagccuggacaacaagagcaaaauuccaucucaaaaaacaaacaaaaauauuugucucuacuauuuugucuuucauguuuuacagaaacauaaaaagagaaaacauaaaaaguuuaagucuuccacuuccuugcccccaaucccaacaguuugguaucuacugcugugcucuucuuaauaucauucuaugaacuaauaauuuuuauuuuucuacaaccaaucacaucaugugaauuucucccucguuauaauugccaucucuucaugucaguucacaaaaguuuuauuccaagccgggaugguggcucacgucugcaaucccaacacuuugggaggccaaagcagggggcucacgugaggucaagaguucuagaccagccuggccaacauggugaaaccccaucucuacuaaaaauacauaaaucagccaagugugguagcacaugucuguaaucccagcuacucgggaggcugaggcaagagaaucacuugaacccagggugcggaguuugcacugagcugagaucgugccacuacacuccagccugggugacagagucugucuaaaaaaauaaaaaauaaaaauaaagucuuauuccaccuuuauaaugcaguaaauuggcugggcgugguggcucacgcucauaaucccagcacuuugggaggccgagguggguggaucacaaggucaagagauugagaccauccuggccagcauggugaaaccccaucucuacuaaaaauacaaaaauuaggagaggggguggcugcaguaaugagaggcuggugcugcagcucuuuuccugcaguccagccaaggaagcgugcgucccuggcgcuuccuucucuuuggacagagagcuugggaugugguaaugccagccagacuucucagagccauggucagaucuaccguacacuggcaaaagcacaucagugccaaagaauuggucaucuaauguuaaaaccacuaaaggaauuugaaaauacaacaugcggcacacugacaauacgucaaaacuuggauuuguuccuuccugauaauacagcugguagucugaauaagucucagauccuguaaaugaaccaaaaaaaaaaaaaaaaaaucaaauacaagcauugucucuccauuaaaugcugcucacugccaagacgaaaaggcacaccuuccaaccaugaaauccuuugguacucacaagagagugacccacaaaccaaaucuauuggggucuaaaugguuuauaaaaauauuaaagaggcauuucucaucuguaucaauggaaacauuuguuccaaaacaaggcuuuccacauaucaagagaccacuaaagcauccaggaccaagcagccaucuaggaccaaccuuccaguucugucugugaacgagguaaaguugggguggucguagcucaugugcuuagugaucacugcucacgcuaaaccagugugcgcugcaccccagccuuaccgccaacuuaagaaacuggcagucaacucagacugcuccaucaagaucuuugaagccuaauaaauauccaaagagauucaaaaucuuaauuuuuaagaauuaaugauacauauaaaaacaaaauacaggccgggcgcgguggcucacaccuguaaucccagcacuuugggaggccgaagcggguggaucacgaggucaggacaucgagaccacggugaaaccccgucucuacuaaaaauacaaaaaaaaaaaaaauuagcugggugcgguggcaggcgccuguagucccagcuacuagggaggcugaggcaggagaauggcgugaaccugggaggcggagcuugcagugagccaagaucgcgccacugcacuccagccugggcaacagagcgagacucuguuucaaaaaaaaaaaaaaaaauacaggcaauaaaacaugaaaaaaauacaaaaauuauccaggcgugguggcacaugccuguagucccagcucuugggaggcuaaggcaggagaauugcuugaacccgggagguggaggcugcagugacccgagaucaagccacugcacuccagccuggugacagagcaagacugccucaaaaauaauaaaauaauaauaaugcaguaaauuauuauaauacggacauauuuauuuaaccaacauuaacaguuggcuccacuuucagcucucacaaauaauguugaacauuccuggagauaauagacauauaacuguaugcaucuguacagguaauucucuaauacagguuagaacuauauguaucugauuagcugggugugauggcaggugccuguagucccagcuacucaggaggcugaggcaggagaaucgcuugaaccugggaggcggagguugcagugagccgagacggugccauugcacgucagccugggcgacagagcaagaauccacaucaaaaaaaaaaaaaaaaaaaauuauauguauccaaacuuuaccuccaaaaucaucccugaaaacuagcauauaaauguauauucccaccaccagaauauggguaugcccuuuccucauauccucaucauugguagaauagaucagugucaaaauucucacaauuucauaaguaaaauauacucuuauuucaauuuacauuucccucaugacuaaugagguugaguaugcguuuaccuguuuacuagacauuucuuuaaaacagaaaagcaugaccuacaugcucacagcucuacuuccucagaauuccuuugacuuaaauugggauaauaccauauucaauaaaacuaaacuucaauuucagaaaacacaguauacuuaaaauauuuagaaaacuuuauagguaaaggaaucccuaggaugcauuuuuuuuuuuuuuuuuuugagauggagucuugcucugucacccaggagugcagaggcaccaucucagcucacugaaaccuccgccugucggguucaagcgauucuccugccucagccucccaaguagcuaggauuacaggugcacaccacaaggcacgcacgaccaagcucagcuaauuuuuguauuuuuaguagagacgggguuucaccauguauggccaggcuggucucaaacuccuggccucaagugauccgucggccucggccucccaaagugcugggauuacagguauaagccacugcgcccagcccuuaggaggauuuaauauacuuggcaaaugagguauuagaaauguuuuaaacaguagguagguuaucaguacauauuaacaaugaaaaacacaagauugcaagacuguaaauguguugaguuuuaaaauaaacuuucuguaaaacuuuuugaccaaaaccaaaaacugggggugguaucucuuuuuaaaacagaaagggcuacuguccuacuuacagaagcucuucuauuaucauuauaauagccuaucucagugcuuucuuaggauaguugguuuucauaccuguugaauaaacugauuaaugaauaaaucaguaaacaaacucugaggacuucaauaaacaaauuuauuaugcuaucucaugccgcauacuauauucuagcaauggcccagugccuagccucacaaugguuacaagacugggccaugaacucauuuuuaaaaccacuuuucccccaauaauauuagauauaaauaaugcuuaaaaacuaaaacucucggucaggggcgguggcucacaccuguaaucccagcacuuugggaggccaaggcgggcagaucacuggaggucaggaguucgagaccagccuggccaaaauggugaaaccccugucuccacuaaaaauauaaacacugggcugggugagguggcucaugccuguaaucccagcacuuugggaggccaaggcaggcagaucacaaggucaggagaucaagaccauccuggccaacacggcgaaaccccguaucuaauacaaaaaguuauccaggcaugguagugugcgccuguagucccagcuacucaggaggcugaggcaggggaauugcuugaaccuggguggcagggguugcagugagccaagacugcgccacugcacuccaccuuggcgacagagcaagacucaguuucaaaaaaaaaaaaaauuagcugggcacaguggcucaccccuguaaucccagcacuuugggaggccgaggcagaccgaucacuugaggucaggaguuggagaccagcccggccaacauggugaaaccccgucucuacuaaaauacaaaaacuagcugggugugguggcgggugccuguaaucccagcuacucaagaggcaaaggcaggagaucacuugaacucgggaggccgagguugcagugagccgagaucgcgccacugcacucuagccugggugacacagugagacucugucucaaaagaaaacaaacaaacaaacaaacaaaauuagccaggugugguggugcgcaccuguaaucccagcuacucuggaaggugaggcaggagaauugcuugaaccugggaggcagauguugcagugagccgaggucgcgccacugcacuccaaccugaacgacagaguaagacuccgucuaaaaaaaaaaaaaaaguaaaacucuauauucuugguauuuaaguuauauuuuaugguuuuuaaauguguaauucauucugcagaguuaaccagauauauuuaauuuucguuuaugccaauauacccauuccauucacuucaaauuuuuccauaacauauuccccuuuauuuggagcugccaaaacuugcuuguugauaggcuggacuucaaaggugaaggcaaaaauaccaguuaacagcuaauuuuuauggauauuccuuuaagauaacuggccucuccugggcgcgguggcucacaucuguaaucccagcacuuugggaggcugaggcgggcggaucacaaggucaggaguucgaggccagacuggccaacauggugaaagcccgucucuauuaaaaauacaaaaauuagccaggaauggugguaggcgcccguagucccagcuacucgggagacugaggcaggagaauugcuuaaaccugggaggcagagguugcagugagcugggaccgcgccacugcacuccaaccugggugacagagcgagacuccauuucaaaacaaaaauaaaaaagauuggucucucauggaaaaucagaaaacauuucucaucuuugauaaauacuaauguccacuuuaagcagccuaaaagauuaccaacuacuuauuucaacacagguuuauguguuuugccaugugaaacugauugagaauuaacuuucauaaucauaagcaaagcuuaucuguuaccuauagaugauaaacaaaauaaauuauaauacauugaaagaugguauguacuuuguagaaaaauaaauuagggaagagagcuauggaguaguuuauuuuaaauacagcgauuaggccucaccaagaaggugaagauuagaacaaagauuuaaaagaggcagaggcaggaagcccuauucauaucugggggaaagagacuuccaagcaaaggaaaagacaaauacaaagaggcugaagcaggaaugguguauuugagggaggaauagcaaggccaacaguaugacuggagcagaauaaaugaagaaaaucagaaauaaauacugaguauuaugaguagaguguagggcuauguaacacaauguaaauaaacauuuuaguuuuaacucugaaugaggugaaaaucauuugaagaguuucugacuugucacauuuuaacaguaucacuggccacuguguuaagccuggaagggaacaggauacaagcaagagacugguacaauaauccauauaagagaugguagccuggagagaugguggccuggaacaggugguaguggugaaagugcuaucaaguuguuggauccuggauauauuuugaaggcagccaauaggauuugcugagggauuguauaauaugugggauuuaaaagagagaaaugcagaguuaucuuauggcacugaaaucauuuccauagcauuuuuuaaaauauugaaaguaccucacauuuuagaagguucaaagcaccuuuuccugcuaaguaugaaacuccgggccgggcgcgguggcucaagccuguaaucccagcacuuugggaggccgagguggguggaucacgaagucaggagaucgagaccauccuggcuaacacagugaaaucucgucucuacuaaaaauacaaaaauuuagccgggcauaguggcaggcgccuguagucccagcuacucgggaggcugaggcaggagaauggcgugaacccgggaggcggagcuugcagugagcagagauugugccacugcacuccagccugggcgacagagccagacuccaucucaaaaaaaagaaacucuauagcccacgauaauaaaaacaggaaccugggccaggugcaguggcucauaccuguaaucccggcguuuugggaggccaaggcaugcagaucacuugagcucaggaguucaagaccagccugggcgacauggugaaaccccaucucuaccaaaaauacaaaaaauuagccaggugugguagcaugcaccuguggucccagauacucaggaggcugagaugggagaaucgcuugagcccgggagguggagguugcaaugagccgagcucacaccacugcacucaagccugggcgacagagugaggccccccaaaaauuaaauaaaauaacagaaaccuaugauagaaggguucccuaccucuaguguagcgguggucacacaaguauaugcauuugucuaaacucauugaaauuaaaacagaugcauuuuauuguaugcaaauuuuaucucaagaaaucugguccaaaaagaaacccugaagacauaucucuaguacucaacauaugcaugcacucagcuuuucuuuuuucacuuuuuucucuuugaaucuuucaaacuauuuuuuucugcacucuuaagaauacugcaaguaugcaaaauacagcaaaacacugcuaauaagcauuccucuauuguagacuuauccagauagaaacaaaauuauuucucccaggauagauuauuuuagacuagcuccaucaguacacuacgugccaaauuucugaaaugauaaugaacugagauuccucugagcaaauauucacauacaacucacucauucauucaauaucuacuuccaauuaugugucaggucugcaggaauuauuccuagaaaaaaaaaaguguuuuaugcccaaagaagaaugggaaaugcuuaacagaaaaacuacuuuuacagcaaagcuuuucagaaguaugaaaauacucaauuguuuggaaaucuccaaaaaagaguugaucuuuuucugacauugccacuuuuguuguuuuaccauuuucaaugauuaaagagcaacacuccugugccugccuauagucacagcuacgcaggaggaucacuugagcccuggaguucugggcugcagcacgcuacugaucagguguucaugcuaaguccauucagcauuaauauggugaccuccugggaugagagagaaccaccagguugccaacagagaagggcaaaacucccaaacugaucaauagugggauuacgccugugaauagccacugcacuccagccugagcaacacaggaagaauucaucuuuuuaaaaacaaaaacaaggcugggcacaguggcucauaccuguaaucccagcacuuugggaggacgaggcagguggauccuuugagccugaguuccagacccgccugggcaacauggugaaaccccaucucuaccaaaaauacaaaaaaauagccaggcaugguggcgugcaccuguggucccagcuacuugggaggcuggggugggaggauugcuuaagccugaaaugcggaaguugcagugagccaagaucgcagcacugcccuccaccugggugaaagagaccccaucucaaaaaccaaauaaaacaaaaaagcagcgcuaucuacuacuaucuauacagaaaaaugagggcuugccugaaacugggguggaacagggugacuugcaaacagacagaaggaauccuuuugggguaauggaugcauaacuuuguauauuuaccaaaaaucauugaauugugcacuuacaggugaauuuucuaugucaauauaguucauauagcugccauuuuaaaaaaggcauauuggccaagugcgguggcucacgcaaucccaacacuuugggaggccaaggcggguggaucaccugaggucagaaguuccaagaccagccuggacaacauggucaaaccccgucucuacuaaaaauacaaaaauuagccaggcaugguggcaggcaccuauaauuccagcuucuauggaggaugaggcaagagaauugcuugaacccgggaggcggagguuacagugaggugagaucgcgccacuacacuccagccugggugacagagcgagacuccaucuccaaaaaggaaaaaaaaaaaaaaguacaccaacucagaaaaaucggcaaaaucuauuuaagaacuguagauuagguauuuuaucaguguuaguuuccugauuuugauugucguacuguuguuagguaagacuaguccuaauuuuuagaaaauacacuuaaguauuuauggguuaaggggcaucacaucugcaacuuacuagcaaaacauuucagaagaaaccuaugaagagaaggauaaagcaaauuggcaaaauguuaacauuugaggaaucuggugaaagauagcugagauuucuuuuguacuauucuugcaacuuuuuuuguaaaucugaaauuaugucuaaauaaaaaguuaaaagccaauaccaauaauucuggguaguggaauuuuguucuucuaguuucagcaacuuucaauuuucaaaaaaagguagaaaagcuauuuaagaagaaucaaaaauccccuuuugugaauggcagugauaguguuugaaaagucaaucaagagaucucuaaaauacagacuguuuuagcaagauguuaagauugauaaaugauuccuuugcuuccaaagcuauaaaauaauguaaauuuucacuaaaucauguguaaauaagaaaaguaaacugcuaauuugucuguggacaaaaacauaacuugaaaauuccaaauuccuguuaggucugaaguaguuacccaauguuaacauggacuaguuuuacuuuaaaaauacauucagaaggccgggcacgguggcucacgccuguaaucccagcgcuuuggggccuaggcgggcggaucacgaggucaggaaaucgagaccauucuggccaacauagugaaaccucgccucuauuaaaacuacaaaaauuagccgggcgugguggcgcgcgccuguagucccagcuacucaggaggcugaggcaggcgaaucgcuugaaccugggaggcggagguugcaguggccaagaucgcgccaccgcacuccagccugggcaacacagcaagacuccgucuuaaaaaaaacaacaacacaaaacaaaaaaaaaaauuacagagucaggguuggacucuuacauuucauugaaaauccuuaaauaacaaauuaugucaauauagauuuaaaugcuuauguguguuaccuggauacugcacgaaggauuuuacauacguuuuucucaauccccaaccccaauaacguauagauacuacuauaaauucauuuuacagaggaacaaaaaccaaagcuuaaaagaaaaaagaaaaagaaaaaccaaggcuuuaaguuaaaugaauuagaauacuauaagauucacuugaaucaugaguaacuuaugaccaacuuaaucccuuucaaguccucugaauguuuuuggaaauagccuuuaaaaaaauuaaaagcuccaaagacuauacaaaaauuauuuauacauuacugcccacggccuaauacacagaguacuucacacuaauacagcaguagggugcaacagagguccaaucucuucccuucucuuggcuccacucugcccaguaucaaaauggcauuuccauggcaauacaaauccauauuacauaaccuccgaaaaaucuucauaguccuacgucuauuccggaaaaccguauuuaaaagcaggauugacgaccaaagaaaaaugagaaaguaacauuuuaauguggagcuuaguaaucgccuagaaugaauggcgauauacaguuuacugcacccuccaaugcgcaaaagaggcaggauggcaaaauucaugacuaucuuaagcaagccaggagacugcuaaaaagguagguauuagcucaauuccaaggggguggggcccaguucacuugguggcgggcucuagauggccaaagaggaagggaaagauauccguugguggccagcaccucgcuaaaaaggguggguagaggcuaacuucaaggcaacggcuggggcgagagugucccaggcccgaaaaccuacuguggggcuccgguaaguaagggggcucagggaagggcuccccuggggcagaucgaucguuuuguaucuaacguggagcccagggggggcagagacgauucacuccgcggcggaacguggaagggaaagggaaagugggcgacaaugcaagacggaaagcucaagccguaggucuggccuccaccagcuacggcugggcccacagcuuuuccaggccuuagagaagagaagaaaccaagccucgugccgaccccucccccacccccgccuccgcgcucccccuuaccucuaccccacccuggcgcuuucgcagccaccccggcuuuuccuccuccaccagcugaggcacccggucucccgguuuccacacgcguucagagacacaaacucacccgccgcugaggaaacgguacugccuucgcgaccuucugggauccagguuacgagugcgcuccacugguucgagauuucugcccgucgcucgccagggagacugagugcccaagcgccuacucgcacaggccgcaaauacagccgcgcugcgcggcgagcugauggaggucuuccucuugcccggcgugcacu

SEQ ID NO: 192372 - RNA, 87257 nt, Homo sapiens
aaaugacgacaacggugaggguucucgggcggggccugggacaggcagcuccgggguccgcgguuucacaucggaaacaaaacagcggcuggucuggaaggaaccugagcuacgagccgcggcggcagcggggcggcggggaagcguaugugcgugauggggaguccgggcaagccaggaaggcaccgcggacaugggcggccgcgggcagggcccggcccuuuguggccgcccgggccgcgaagccgguguccuaaaagaugaggggcggggcgcggccgguuggggcuggggaaccccgugugggaaaccaggaggggcggcccguuucucgggcuucgggcgcggccggguggagagagauuccggggagccuugguccggaaaugcuguuugcucgaagacgucucagggcgcaggugccuugggccgggauuaguagccgucugaacuggaguggaguaggagaaagaggaagcgucuugggcugggucugcuugagcaacuggugaaacuccgcgccucacgccccggguguguccuuguccaggggcgacgagcauucugggcgaaguccgcacgccucuuguucgaggcggaagacggggucugaugcuuucuccuuggucgggacugucucgaggcaugcauguccagugacucuuguguuugcugcugcuucccucucagauucuucucaccguuguggucagcucugcuuuaggcauauuaauccauaguggaggcugggaugggugagagaauugaggugacuuuuccauaauucaggugagaugugauuagaguucgaucugcggugguggcagaggcuuacaagaaacacuaacgggacaugggaaccaauugaggaucagggaauaaagugugaaguugacuaggagguuuucaguuuagaacauggcagagacauucucagaaauaaggaaguuaggaagaaagaccugguuuagagaggagggcgaggaagugguuuggaagugucacuuuggaagugccagcaggugaaaaugcccugugaacaggacuggagcugaaaacaggaaucaauuccauagauuuccaguugauguuggagcaguggagaagucuaagcuaaggaaggggaagaggaggccaaggcaaacacuuaggaacacuugcaacgaggggguggaagaagagcaaggagccagcugaggagaaugagugugguuggagaaccaccacagcgcagggucgccagagcugaggaaggggagggaagcuucaggaaggaaaagguuggcagggauuuugaguguuaggccugguguagcagaaggaacagaagauuuagagcagcgcuagccaauagaaauaaaaugugaggcccggggcgguggcucacgccuguaaucccagcacuuugggaggccgcggggcggauccuugagcugaggaguucgagaccagacaacacggcgaaaccccggcucuacaaaaaauuagcugggcgugggggcgcgcgccuguagucccagcugcucccaagcgaggcugaggcaggagaaucacuugaacccgggagaaggagguugcaguaagccaagauuaugccacugcacugcagccugggcaaaagagugagacugucucaaaaaaaaaaaaaaccuguuuuguuuuucuuuuggagaaaaggcauacaaauuuauuagcaugcagacugggagaaccacaaggugauuaucccuauuuuaaauuuucuaauaaacauacuauuauuuauuuauuuauuuauuuauuuauuuauuuauuuauuuuuugagacggagucuggcucugucgcccaggcuggagugcaguggcgcgaucucagcucacugcaagcuccgccucccggguucacgccauucuccugccucauccuccccagcagcugggacuacaggcguccgccaccacgcccggcuaauuuuuuuguauuuuuaguagacacgggguuucaccguguuagccaguauggucucgaucuccugaccucgugauccgcccgccucggccucccagagugcugcgauuacaggcgugagccacccugcccggccggcuauuuauuuuuuuagagaugggagccucacuauguugcccaggcuggucuugaacuccuggagucaagugauccucccgccuuggccucccagaguggugggauacaggcacaagccacugugccuagccauaaacacauuuuuaaagguaaaaaaaggccgagcgcgguggcucaccccuguaaucccagcacuuugggaggccguggcgggcggaucaugaggucaggagaucgagacauccuggcuaacacggugaaaccccaucucuacuaaaaaauacaaaaaaaaaaaaauuagccgggcgugauggcgggcgccuguagucccagcuacucgggaggcugaggcaggagaauggcgugaacccgggaggcggagcuugcagugagcggagaucgcgccacugcacuccagccugggcgacagagccagacucugucaagaaaaaaagaaaaaaaauguaaaaagaggcuggguggccgggcgcagcggcucacgccuguaaacccagcacuuugggaggccgaggcggguggauaaccagaucaggagauggagaccauccuggcucacgcggugaaaccccgucucuacuaaaaguacaaaaaauuagccagacauggugccaggcacuuguagucccagcuacucgggaggcugaggcaggacaauggcgugaacccaggaggcggagcuugcagugagccgagaucgcgccacugcacuccagccugggcaacagagugagacuucguuuuuuuuuuaaaaaaaggcugggcacaguggcucacaccuguaaucugccagcacuuugggaggccgaggcagguagaucaccugaggucaggaguucgagaccagccucgccaaaauggugagacccugugucuacuaaaaauacaaaaaauuagccggguguguuggcguguaccuguuaucccagcuacucgggaggugaggcaggagaaucgcuugaacccagaagguggagguugcagugagccgagaucaugccacugcacuccagacugggcuacagagcgagacuccauaagaaaaaaagaaaaaaaaggggggcaaaaagaaacagaugaaaccaaugugaauaauuuauuuuaacacaauauaccuaacauauuuuuauuucaauaucuaaccaguauaaaaauuuacuuguuuugcccucuagagauaguaagcuccuuaaguaaacagaaguaauaccugauuaauuagaauucccaacccucaucaagugugugcuuauauagaagaaacccaguaaauguuuguugauugaaagauauuaauacucuugcuuggaugagagugaggaaaaagguauuaguauuggcuuuucacaacgccuuguacgguuucuuguuuaaguugaucaaagcaaaagaaagacugcaggcaaugcuaaauauaacaagugauuuacaaauuaauuagacguaaauaaucauuuuucauuaaaaauuaguuguauucuguccauuuccucagaauuuuagacaaugauuuugaauaaucauaucucccuuauagaguuauugaaauuaaauaacuuauugggaaagauucuuuauaauuauacaaagguauauaggaccauagucucauauccagaguucugaaauccgaaaacuaaaagguuuuucuuuuuuugcuauucuuuuuuuuuuuuuuuuuuuuuuuuuugagacagagucucccucugucgcccaggcuggagugcaguggcacaaucucagcucacugcaacguccgccucccagguucaagugauucuucugccucagccucccgaguagcugggacuacaggcgugugccaccacacugggcuaauuuuuguauuuuuaguagagguggggugucaccauauuggccaggcuggucucgaacuccugaccucgugauccacccgccucagccucccaaagugcugggauuacaggugcgagccacugcaccuggccaagguuuuuuauaacuaauuuaacagcaaaaucuggccuaguuaucgucuuuauuuucuuuuuuuaaugugauuuaaaacuauucauuuguuucacuauagcuuaauaauuuguuugcuuuucugcuucuaagacccuguaggggcauuauauaacuucuggcauuugcauaguaccuuuacaaaauccaaaaaaaucugaauucuaaacacauuuaguccuaaaaguuacagauaagggauucuggacuugcgauucuaagucuuuguucguuuuuauugcauuuucugagccaacauaaccauuauuuaaaaacaaguugcuauaguaacucuacauuacagaccucccccaaacucagcaguucagagcauguauucucacucagggcucugcuuccuuguagguagauguguggaucggugagggcaguucuuauuuguaugccuuauucuggggcccaggcugaaggggcaguggcuauccaugauaagcuuuucucaaggcaccagcagaaguacaagaagucaaggccaacugcauaagcauaguucaaaugucugguuaugccacaucugcuaagauugcauugaccaaagcaagucacaugaucaugcccaaagacuuaggaguggguaguagacugcaaccaccaugcagccaagcaaacuacagagccaagccuauaacaucacuggagagagguguauuccucccuuggccaggcugggggagggagugaauauuggcugaauaauaaucuaaucuaccacagaugguuaacagagguggagugggauggaaggagaaaaaaaaaaaaucaccaaaugggauguaucacuacccuugcucuuuuuagcgucugcugcuuucacaaagccuuuuauagggcuggagaaaugauuugcuccuagucucuuaaaaaccagaggagucuuuugaggauguauuccuaaaguuuuuaaauuaguuuaaaaauuuuuuuuauuaauuucaauuauaggcugagcacaguggcucacgccuguaaucccagcuaaggugguggaucaccugaggucaggaguucgagaccagccuggccaacaugcuaaaugaaacccccaucucuacuaaaaauacaaaaauuagcugggcaugguggugggcgucuguaauccuagcuacucaggaggcugaggcaggagaauugcuugaacccaggagguggaaguugcagugagccaugaucguggcauugcauuccagccugggcgacaagagugaaacuacaucuuggccgggugccguggcucacgccuguaaucccagcacuuugggaggcagaggcuggcagaucacgaggucaggagaucgagaccauccuggcuaacacagugaaaccccgucucuacuaaaaauacaaaaaauuagccaggcgugguggcgggcaccuguagucccagcuacuugggaggcugaggcaggagaauggccugaaccugggaggcggagcuugcagugagcugagauugugccacugcacuccagccugggcgacagagggagacuccgucucaaaaaaaaaaaaaagaaaagaaacuacaucucaauaauaauaauaauuucaauuauagguuggaauuuagaguucgguuacauuuacuauuggaugugauccuuuaaaaacucaaguagaggcuuuuccagcccauucauaacauuagaaguugggccgccuguccagggagaagcuuucaaaguaacacugaggcugauuaaauacuuuuguaaaauaaagaauaaaucacaagcucauuggcacuugaaacuuagcauugcagugcagaugcagcagaaaauacuuguagcaguuuucucagugaaagagaaacuagucaaguagcuuagagacauuaaaacaagccacaagcccuuugugcuagagaucaugguuaaaaguccccugaagauguuuuuccacaguagaaauuuuguuuauauuuaugucugagagugaaaaaagaaaauggaaucaauaaguaaccauguucugcaggaguuugagguuuuguuguuacauugggauguagugagagaagaaaacguauuaauucuuuucuguugguacuuucuugaauuacauuuuuaauaaacuuauugugagauucugaacauugcuccugugauaauuucugaagugcugaugaguagaagguuuucugguuagacuucuguucagcacaucugagcuucgagauuauuuguaguucuccuggggcuuuuaaaaucucuuuguauauaauagauaaaugcuaguuucccaucagagaaggauuucuuuuuccuuuugucugauugagcaagugucuugagauuaagaaaauggaugucagugaauucaaguguugugcucugucaguuugcagcaggugaccagagagcaaaaacaccagaguagauucugucccuacucccaccuacuccucaauucgggucccaugaaagauccucagaucuggguaacuguuguuguuuuuguuguucacagggcuaagaauguucauggcuaagaauguuaaaaagucuccuagugucuuuugccacgcugccugaacaguggggucauugaccgccaugcaauccucaauuguuuucagcugauacuggaccgaaaucaaaucuagcuuugccugccccuuucuuuguaccaguagcgcuuguuuguucaccaggccugacugaagaccuagcccuguugccugccucugcuuccuaccgagcccccuguaaagagcagcucucccagggaggcucaccuuguagcauugugaucuuuggaagcaucaagggaggcacaagauuucucugggugaacuggaaaagacuugggcugggcaucagaagacuuggguucugcaacuggcauuguuuacacucucucuguaacucugugcaggcaaaaucuuucaccuuuucugaguuuuuuuuuacaugucaguacagauuccuuuccucaugagguuucuuuaagacucaaauggaagaauagaugugaaaagaacuuugaagauaguauuggaaaaugcuaaagugacugcuguguuauugaugauuuuuaugggauuugucugagaaagcuccagugugaccaguuuguaccagcuuguaugguuucuuguaauaaccgaacagauccuguuagcauaggguaaaaauggaaacuacuucuuuuaaaaugaccaguggcugcaguggcucaggccuguaauccuggcuaguugggagacugaagugguaggguugcuugaggccaggcaagaccagccugggcgauacagcaagacccuuucucuaaauaaaaaacuagccacccauguagucccaccugcuugggaggcugaggugggaggaucgacugaggccaggaguucaaggcugcagugagcuaugauugccacuguacuccagccugggugacagagugagaccuugucucuuaaaaaaaaaaaaaaaaaaaaaaaaaaagauuugcauuauagcuuaucuuuuuuuuuuuuuuuuuuuuuuugagauggagucucacucugucacccaggcaggaaugcaguggcguaaucucagcugacugcaaccucugccuccuggguucaagcaauuguccugccucagccucccgaguagcugggacuacaggugcacgucaccaugccuggcuaauuuuuguauuuuuugguagagaucggguuucaccauguuggccaggcuggucuggaacuccugaccuugugaucugcccaccuuggccucccaaagugcugggauuacaggcgugagccacugcgcccagccagcuuauccuuuuuuaaaaaaacauaaauacuaggauauugagauuauugaaaaugcuuuuggugcuucaguuuugaauuuauacuuagagcaguuuuugaaguuuaagaucucauuuacuucuaaguaauagauuuacuaguaaucaaaaucgcuucaaaauaccguaauccucauugcuguaaacuccuacggggcagguuuggaguuuuauaaagaggcaauauaguguacucugugaauuccaacuccucacuugccagaugugaccuuaagcaagugaacuucugugugccacacuguuuucaucuguaaaaggauaaagggaauaucauaaauuaguuuguuaagccuuaguuuaauaaugucucuaaguuuuacauauaaguagacagugucuuucuuguuuagugaauaaucauucuuauuauuuaauaguaucucuacuaaauuuauuguguaagauuauacuaaucuuguuuagugcgugguaaucacuucugcucauauuuaaccuauaagcauaauauaguuuauuuauauaccauuuauuuauuuuauuuuauuuuuugagaugcagucuugcucugucacccaggcugcggugcaguggcgcaaucuugcuucacugcaaccuccaccucccagguucaagcgauucuccugccucagccuccuuaguagcugggauuacaggcacgagcuaccaugcccagcuaauuuuuguauauuuaguauggacagggcuucaccauguuggccaggcuggucucgaacuccuggccucaaaugaucugugugccucagccucccauagugcugggauuacaggcaugagccacugcguccggccuacuuaccuuuuauuuuugcuugcauuacccuuucuuugccuuguuucauuuggcuaagacugucuuguuuacuugcuuugcuucugagggauuauaugagaguucuauggguuuuuccauaauggaguguacuuuuauuauuuuauuauuuguuuuuuugagacagggucucacucugucacucaggcuggaguguagugaugcagucacugcucacugcagcuuugacuuucuuggcuccagugauccuuccaccucagccuccugaguagcuggaaccacaggcacccaccacccacacccagccaauuuuuuuuguauuuuuaguagaaacaggguuucaccauguuggccaggcuagucacgaacuccuggccucaaguaguaacacccaucucagccucccacagugcugggauuacaggcaugagccaccgagcccggccucaugcaauuuauugacuacuucacugaaagugaacuuguauggauacucaaaaaguacaguuuguauugaauacauauuguuuuugcaucauacuaaagcugaacaguucuaaacugaacugucaucagggaccgucuguauugugaaaucuuaauuuuguccauauuaaaagacaggaacagggcugguucgugguggcucacaccuguaauccuagcacuuugggaggcugagguggguggaucacuuguggucaggaguuugagaccagccuggccaacauggugaaacccagucucuacuaaaaauacaaaaauuagcuggacaugguggugcacaccuguaaucccaguuauucggggggcugagacacgaaaauuacuuaaacccaggaguuagagguuccagugagcgagaucgugccacuacauugcagccugggugacagagcaagacugugucucaaaauaaagacaggaacaaagguaucgauaacucuuaaguauagguuaaauucccacaaaaaucuaguuuuaaaaaaucuuuuuuuuuuuuuuuuuuuuuaaaaacagagucucacucuguugcccaggcugaguacagugacgagaucuuggcucacugcagccucuaauuccuggacucaagccauccccccaccucagccuccugagcauuugggacuacagaugcaucccaccugcacccagcuaauuauuuuuuuguagagauaguguuuuccuauguugcccaggcuggagacugaucugcaacuccuggccuuaagcucuuuauuuuuuaagcaaauuugcacuguuuucaauuaauaugaauuugcauuucgcugaucucaugcuagcugacaaugggcugaaggugaggggaggagaaagauggacaugguacauaaaagcauguaugauaaaguggaaugucaccuugguuaaaaauguguaaugauuugaaugauacaaauauaaguaguuaaggguuauuuugaacuugauaccuuugcuggaggaaaaauuacuuuaugcauuuuugaugaaaaaucauuagaagaaaaaaaauggaauauuuagaggaaagaguauccugauguuaaaagugaaaaugaaauaggacauugagaaaauuuuuuuauguaaauguguauaugguaauguauuaauuagcguuagguauguacacggauuuuugccuucuauauuucugaaaaccuucugugaaaaggaagaguugaaaucauaaagaauuggcugauggaaauuaagguagacaggcaaaugggaauguggccccccuaggagggugaacucugagagacacagucaucccuguaaauaaggcugcgccaagaucaaaggagaggucugaggcugggagucaggagucagccauucuuuuuuuuuuuuuuuucugcaaccuccaccuccuggguucaagcuuuucuccugccucagccuccugaguagcugggauuacagaugcgcgccaccacacccggcuaauuuuuguauuuuuaguagagaugggguuucgccauguuggucaggcugguuucgaacuccugaccucgugauccgcccgccuuggccucccaaagugcugggauuacaggcaugagccaccgcuccuggcugagucugcgauuucuugccagcucuacccaguugugucaucuuaagcaagucacugaacuucucuggauucccuucuccuuuuguaaaauaagcauguuaucuguccguccugccuugggcauugugauaaggauaagaugacauuauagaauuuugcaaaauuaaaagcgcuagacaaaugauuuuaugaaaauauaaagauuagguugaauuuggucagcauagaaaaaggaauguugagaacauuccuuaagauuacucagcucccuuugcuggaaaucagaagucauuaaguaucuuugugguugaaaauguuuggugucucaggcgguucuacuuauugcuaaagaggucuaccuugagcuuauaguaaauuugucaguuaguugaaagucgugacaaauuaauacauuccugguuuacaaauuggucuuauaaguauuugauugguuuaaaugaauuuacuaggauuuaacuaacaauggaugaccuggugaaauccuauuucagaccuaaucugggagccugcaagugacaacagccuuugcgguccuuagacagcuuggccuggaggagaacacaugaaagaaagguuuguuucugcuuaauguaaucuaugaaaguguuuuuuauaacaguauaauuguagugcacaaaguucuguuuuucuuucccuuuucagaaccucaagaggcuuuguuuucugugaaacaguauuucuauacaguugcuccaaugacagaguuaccugcaccguuguccuacuuccagaaugcacagaugucugaggacaaccaccugagcaauacuguacguagccagguacagugucagucucugaaacugccuuugccagacuggauucacuuaucaucuccccucaccucugagaaaugcugagggggcuaggcaggcuuucucuacuuuaccacauuuauaauauauuuggugaacuucagcugauugcuggaggacacagggcuguuuaacacauagguguugauacaguuccuaccuaauucacauaucaccaccucaguugaagccuucuccagcuucccaaggugugcagcgccucauaguucauguuguuuauuauuuuaccuaucuugcucuuauucuucuacggcugaguccauuuuauuuacuguauucauuaccuaacaguuccuuuuagugcucaguaaauauucauuaugauuguacaaugcaaggauaaguguagaaguucuaaggguucaaaggagggauucaggaaaagaacguaaucugugcugucggacaaagagauuccucaccagcuacauacacagacaugaaauuugacugcaacucuacuagcuaaucaucauaaagugagagcagaggccaggcacgguggcucaugccuguaaucccagcacuuugggaggcugaggcgggcagaucaccugagguuaggaguucaauaccagcuuggccaacauggagaaaccccaucucuacuaacaauacaaaaauuagccgggcuugguggcaggugccuguaaucccagcuacucaggaggcugagccaggagaaucgcuggaacccaggagguggagguuacagugagcugacgucgcgccauugcacuccagccugggcgacgagcgaaacuccaucucaaaaauaaauaaauaaacaauaaauaaauagagaaaaagaaagaaaagaaaagagagagagcauggauguccugugagacaguuggaguaucuauaggauuuuuagagguggacccagaauagaggaaaacacaaggccaacuauaagcuauccaguugcacuagguguggggucagauuuuccucuguuaggaccagagagcagagcuaggaacagugguggaaguuaccaggcaauaaggucuggaucaauaaaaagaacuuucucauagccuggcaugguggugcaugcuuguagucccagcuacucaggaacucaggaggcugagguacgaggauugcuugucuaagaguuugaguccagcaugggcaacauagagagguucuguguuuuuuuuuuuuuaauuuucccacaguuaugguacaucugggcugccuuguaggcuuguguguacauuucacuacaaacagucacaaaaggcugaaaggccacuccagcaagaucuguagaggauuaguccgugaauuccgcaguugaacuagagcacugaauggcguggaacuuccuuuuacacucugaagauuuaggauucuucacuuuucccaucaguaaaauuagguaauuuacuagauaauuugaaaauucuuucccagcugggaaguuuugaugugcccagaagcuaggaugggcaguuguccagguuuguuuaaaacuagagguucuagaacacaggacuuucaguuuuaaaauugggacaguccugagcaguaggaucaagucaguugucuaccagaguauaaucaaauugaaauaauuuuggaucugacuaaccaagucuuauucaauuaguugacauuguuguuuaacuucgaguacuauuacaguucuauauuguuauaguucaaauagaagauaacaucuaaagcauuucucauuccaaagguuaaaucuugccuuuagcuucauuucuucaacucuaagcaaauacugugacgagcugcuauagccuggaaaauaguuuuccuuuugugggcugcugugcauaaucucauucauaguaaagggauuugaaguuugaugacagaauagucagagagcugaaguuguguuuguuuuuuuagcccaaauauuuauuucucaaguuuuuguugugaaauguuucuagcacauacagaaaguauggcacauaauguaauaggcacccauguaccuaucacccagcuuuauuaaaccuuaacaucuuauuugcuguuuuuuugauaagcuuuuuuugcuucuauugcuuauugauccuacacuaaaugaaauccuaacuaaacaaaacaagauuuugcauuuaauuugaaaagagacuaguuauaugacaaaaaauugcagauaaaauugaagugcuccucccccauucuuuuuccucuuuucucaggauaguuacuguccugaauuggguauuuaccauguuuaauaaaauugaguauuaggcuuacuauaauauuuauguacauaaaucguaucgcauuauguaauacacuuggcauguuuuaaaacuuuaggcugggugugguggcucacgccuguaaucccagcaauuugggaggccgaggcugguggaucacaaggucaggaguucaagaccagccuggccaacauggugaaacccugucucuacuaaaaaaaaaugcaaaauuuagccaggcgugauggcaggcaccuguaaucccagcuacuccagaaacugaggcagagaauugcuugaacucuggagguggagguugcagugagccaagauugcaccacugcacuccagcuugggcaacagaguaagacucugucucaaaaaaaaaaaaaaaaaaaaaaaagccaggugcgguggcucacgccuguaaucccaacacuuugggaggccgaggagggcggaucacgaggucaagagacagaccauccuggucaacauggugaaaccccgucucuacuaaaaaaauacaaaaauuagcugggcguggugacacgcgccuguagucccagcuacuugggaggcugaggcaggagaauggcaugaaccugggaggcggagcuugcagugagccgagauugcaccacugcacuccagccugggcgacagagugagacuccaucuaaaaaaaaaaacaaaaaaaaacuuuaugugguuuaugucugaaaguugaagagaauuuccacauauauguuaguauauguugcaaaagagacauuccuauguagaauuuugggcauucauguauauguagaugcauguagcucuagcauuuguuuucucuugugaauauauaaaaauaauucuguuuacaaacauuugguagguuccaguuuuucacaauaacugacagugcugcagugacauacuaauucauuagucugugugcacuugugugaguuucucaaagauaguugcugugauuggauauauggaucuuagaacuauuuuagagauugcuaggauucuuccaaaguguauauugcaggccaggcauggugguucacggcuguauuacaucuaucucagaaaaauaagagaagaaaagcaugggugaucuuggugauuucccccuuucauuuucuaaauguucuauaauacaguuauuuaauaauuuaaaaagcuauuuugaaaaaguaaucucacgcugucaccaaagcuggagugcaguggugcaaucuaaacucacugcaaccucgaccuccuugagaccaggguggucucaagugauccugccaccucagccucccaaguagcugggaccacaggcucaugccaccacaccuggcuaauuucuuguauuuuuggcagaaaugagguuucaccguguugcacagucugguccugaacuccugagcucaagugauccacaugucuuggccucccaaagugcugggauuacaggugugagcuacugcgcccaaccuaaaauauuuuauauauauauauauauuuuuuuuuuuuuuuuuuuuuuuuuuuuuuuuuuugagacggagucucgcucuguugcccaggcuggagugcaguggcacgaucucggcucacugcaaguucugcaucccggguucacgccauucuccugccucagccucccaaguagcugggacuacaggcgcccgccaccaugccuggcuaauuuuuuguauuuuucauagaggcgggguuucaccguguuagccaggauggucucggaucuccugaccucgugauucgcccgucucggccucccaaaguuuuuuuauauuuuuuaaugugaggaaaggucacaaaagaauaguaugcuaccugaggaauaucucuggaaagggaucaagcauucgagguuuucugugaugacugacuaaagucauggaguuagaacagcugauacaaaagaaaccaaaaaaggccaggcaugguggcucacacauguaaucccagcacuuugggaggccgaggcagguggucaggaguuugagaccagccuggccaacauggugaaaccccauuucuacuaagaaaaaaaaaaaaaaaaagucaaugggugugguggcauguaccuguagucccagcuacucaggagacugaagcacgagaauugcuugaacccaggacucagagguugcagugagcugagauugugccacugcaccccagugcagugugacagagugaggcugucucaaaaaaagaaaaaaaaaacccacaaaagcucgguagcaugagaucuuugagagcauucuuauguucuuauugguaauuggaguuuauauuaugcccuugucaucaauaauagcuucaguuauguuucuuagucuccauuugaaaaaagaaauauucgcugggcaugguggcucacgccuguaaucccagcacuuugggaggccaagguggguggauuacuugaggccaggaguuccagaccagccuggccaucacggugaaacccugucucuauuaaaaauacaaaaauuagccaggugugguggugcgcccuuguaaucccagcuaccugggaggcugaagcaagaggauugguuucaagguucaccugggaggucaaagcugcauucagccaagaucacaccauuguacuccagccuaggugacaaagugauacccugucucaaauaaauacauagacaaaaagcaaaccuaugagcuauuuaaaggaccuugaggagaaaaaaaauaaaugaaaugggugaucuaaauuuaaauagaaucugcagcucugguuagccuuugacaguguuguuguaucauuauaguuaugaauuuguuuucucaguuguguuaaaguggaguaaggcaaaaaagaacuugaaaucucaacgaccuccagagaaacaugcuagcuuuugcaugaguaaaaucucuuaggcacaaauauuaauaauauguuaagaaacuuuaggcuuaagccuaacauaacagccccauaaguguucaguauuaucucuaaccaguuaugucaacuguuuguggaaaugacagccuuucuuggcauuagaggaaugguuaaaccucugacuccagggaaucacaaagcuuggucagaugcugaauggaauuauguguguuguuggaagcauguucccuaugauuaauaaauguuuucaaguuuuccacuuaacuugccaguucuuugguuaagccacucuucuaguccuguccuacagagcaggcuuagagccccacauuugucauuguagaaauucaaacaauauccauuaagucauuuuuuuuuuuuuugcccauuaagucuuaaaggauuaauacauuuucuuuccuuuuuuuuuuuuuuuugaaacggagccucccucugucgcccaggcuggaguucaguugugcgaucucggcucacugcagccucugccucccagguucaagcgauucuccugccuuagucucccgaguaguugggauuaacaggguugugccaccacaccuggcuaauuuuaguauuuuagauagagaugggguuucaccauguuggucaggcuggucucgaacuccugaccucaagugaucugaccaccuaggccucucaaaguguugggauuacaggcaugaaccaccgugccugccaauacauuuucuuacaaauauuaauuauugaaaaaauguauuuuaaguaaauauucagacuauaaauauaucagcauaauugaauacauuauaaccacguaggcauguuaacugcuuacaugcgugcaugaaauauuaagggaaaagggcagaauauaauauuuguaaacacaacuauguauaccuguguguauauauugaaaaacguuagcauuuggggugucguaaaaauaaguuucuguuuucuuuauaaaauuaccuaaauucauauucaacuacacacaauuauaaacuuaauugcagagcuaggugugguggcucaugucuguauuccuaguacuuugggaggcugaggcaggaggaucccuugaggccaggaguuugagacuagcuuggguaacauagcacgaucuugucucuacaaaaaaaaaagugaaaauuaguggggugugguagugugcuucuauggucccagcuacuugggaagcugaggcaggaggauugcuugagacuaggaggucgaggcugcagugagcuguaaucaugccacugcacuucaaccugggcagcaaagugagacccugccucaaaaaaagaaaaaaauguguggcaaaaacugccaugaacaaaguccaaaacaaacuaggacaaaggcuugaaauauaugacagauauaucccaauauacauagaauucuuaugaaauuaaaaggaacaugaacaacuuaacucaguagcaaagguuacaagcaauauuuauggaguaagaaauagaaauggcaauaaauauaugaaaagccuaguugaucagccuuacuaauagggauaaaaauuaaaacuucacuucuuaccuaucagugaguuaaaauugauacacugcugcugagguuguagggaaauaggcuuucuuguaugcuguguucuuuggaguuaaguuaguauuuauuuggaggcaagcucuuaauugaaucuacagauacacaugccuuuuggaaauaauuuagcaauuaaaucuaaccuaaucugaucucaccuagcauuucacuucugaaaguuuauccuauaaaaauauuaccauagaagugccaagaauuuuuauugaaguuuuauuuauaacagugagaauguggcaguaaucucaaucuuuaucauuaauugcuuaugguuuacccaguuaguaguguaaagguacuaguuaacaguagggucucuugacuaaacaguuggacuuugaaucuccauucuagaacuucuuagcauuaugaucuuuggcaaauuaacuggccucgcuaaacuucaguuucuuuaucuguuaaaugaaguuuauagcaauuaacuuagaguuuuauuuaaauuaaaugagauaaacugaaugauuaguacacuaccuagcacauacuuguucaauaaauauuaacauuucuuaucaaaauugccauauuuaagaaugagguauauuuauaugucuagcauagaaucaaauauauauuaucauuauuauuuuuuuuuugagacagggucuccuucuaucacccaggcuggaguauaguggugugaucauagcucagugcagccuguaaguccugggcucaagugauucucccaucucagccuugugaauagcugggaguacaggugugugccaccaugccuggcuaauuuuuuuugcuguuaguuucacuuuuuuuguagagcuggggucucguuauguugcccaggccggucuugaacuccugggcucaagcgauucucccgucucggccuccugaagcauacagauuuuuuagggcagugaaucuauucuguaugauacuguaaucauggaaaccugucauuaucuguuuauacaaacccauagacuguauaacaccaaaaagugaacccuaagguaaacuguggacugucaauguagguucaucuguuguaacgguuuaccacaguggugcaggauguugauagaggcuguuggagggguuaugugggaacucuguguacuuucugcucaguuuugcuguggaucuaaguuugcauuuaaaaauauuuuauggcuugguggcucauacuuguaauccuagcacuuuggaaggcugaggcggguggaucacuugaguucaggaguuugagaccagccugggcaacauggugaaaccccaucucuaugaaauaaaaaaaaaaguaaauaauacuaauaguaauuaacugggugugguggcaugugccuauagucccagguacuugggaggcugaggucggaggaugacuugagccugugaaguggaaguugcagugagcagugaucaugccacugcacuccagccugggcaacacagccagacucggucucaaaaaauaauaauaauaaaauaaauaauauaaauaaaaauaauauuuugaaagaaaagagcuaucaagccacaaaugcaaaaggcuucaaguuccuaucuuuuagaaauacauacuaaaauauuuaugaaggaaaugauauaucuaagauuugccucaaaauaauacuggaguggcaaagugagcgggggaguagaugaaacaagauuagcaugaguucauaauuauugaaguugaauaaauugcacaugggcuucauuguacauuucugacaguauuuguuugaacuuuuuccauaauaaaaaguuuuguuuguuuuuuuuuuugagauggagucuugcucugucacccaggcuggagugcaguggcaugaucucggcucacugcaagcuccgccucccagguucacgccauucuccugccucagccuccagaguagcugcgacuacaggcguccgccaccaugcccagcuaauuuuuuguaauuuuaguagagaugggguuucacuguguuagccaggaugaucucgaucuccugaccuugugauccgcccgccugggacucccaaagugcugggauuacaggcaugagccaccacgccuggccuuuuuuuuaaaauggucuuacagguaauaccaugcaugcuuaagucaucauucucauauuuagcuaccaagauuuuuccuuucggaaaucccucaguauucuaguaccacuuuccucucauuugacacuuuucaaagcaccuacacacucccuugagaaagauaccuuuuuuuuuuuuugcgagggaguuucacucuuuuguugcccaggcuggagugcaguggcaugaucuuggcucacugcaacgucugccuccuggguucaagcgauucuccugccucagccuccugaguagcugggauuacaggcacgcaccaccacacccagcuaauuuuuuuguauacuuuuuuuuuuuuaaguacagaugggguuucaccguguuggccaggcugggcucaaacuucugacuucagaugauccgccugccucgaucucccaaagugcugggauuacaggcgugagucaccacgcccagcccaagaaagauacauuuuuaaaaacagcuuuauugugguauaauugacguaaaauguacauacuuaaaguauacagugugauguuuugauauauauguauacucuugaaaccaccaccacaguuaaaauaaugaaaauguccauuaccuccagaaguuucuucauguuuuguuguaaucucuccuucuccucccugauuccuccccauccccaggcaaccauguuuugucaccgcgcgcagccauuuacuauuaugauacuauuuuauauaaauaguaucauacaggccgggcacgguggcucaugccuguaaucccagcacuuugggaggucgaggugggcgaugacuugaggccaccuggccaacaugaaaccccuucucuauuaaaaaugcaaaaauuagccaggggugguggcgugcaccuguaaucucagcuccucaggaggcugagacaugaggauugcuugaacccaggaggcagagguugcagugagcugagauugugccacugcacuccagccugggcaacagagugagucucugucuaaaaaaaaaacaaaacauacagacucuugucuggcuucuuucuuucagcauaauuauuuugaaauucguccauguuaugugguuccuuuuuauugcugaguuguauaccacaguuuuugaucuauuuacuuguugguagauauuuggauuuucaguucugaagcauuacagauaguggcuguuacggauauucauguacagaucuuucuuuguaugggcauaugcuuuaauuuaucuugggcaaauaccuaggaguagaauaugauccaauaugguagguguauauuuaacuuuuuuuucuaucuaucuaucuaucuaucuaucuaucuaucuaucuaucuaucuaucuauuuuuaagacggaguuuugcuccaucuggagcaaaggcuggagugcaguggcaugaucuuggcucacugcaaccucugccuccuggguucaagugauucuccugucccagccuccccaguagcugggauuacaggcgccugccaccacacccagcuaauuuuuguauuuguaguagaggcuagguuucuucauguuggccaggcuggucuugaacuacugaucucaagugaucugccucggccccccaaaguguugggauuacaggcgugagccaucacaccuggccaguuuuuauuuauauuuuuuauagaagauggagucuuccuauguuucacaggcugaucuugaacuccaggccucaagugauccucccgccuuggcuucccaaagugcugggauuauaggcaugagccucuaugcccagccuuauauuuaacuuuuuaagguacuaccaaagaacuuuccaaacugguuguauaauuuuacauuucuaccagcaguaugaguuccaguuccuccacauccugucaguacuugauacugucagucuuuuaaauuuuuuagcucuuauaaaaagguauauaguuacaucucauuuugguuuuaauuuacauuucucuauugaguaaugauguugaguuucuuuucaugugcuugucauccugauaucuuuggugacuugucuguucaaaucucuugcccauuuaaaaauugcuuucuuaauggauuuuaagaauuauuuacauagucuggauacaaguccucuguaauauauauaauuugcaaguguuuucucccagacuguggcuuuucuuuuuauuaacagugcuuuuugaagggcagauuuuuuuuuuuuuuuuuaaagagacagagucuugcccugucacccaggcuggaguauaguggugugauuauagcucacugcagccucaaacuccugagcucaaagaauucuucugccucauucuuccaaacagcuaggacuacagaugugugccacugcacccagcuaauuccguuuguauuucauugauuguguuuuuggugucacaucuuaagaaacuuuggccuacuucaaguucucaggaguuuuuuccugcauuuucuucuggaagcuuuauaguuucauguuuuacauuaggucugugauccuuuugaaguugauuguuauacgugguccaagguauggaucaaaguucauuuuucugcauauggauauucaauuguuucagcacuguuuuuuaaaaaagacuauuuucuccacugaagugccuuuguaccuuugcaaaaaucaguuguccauauaugugucaaucuguuccaucagucaugggucaaaggcuguucucauggggaggcuuuugaauuugaaaaacugaaacucuauacucauuggacaacuuuauacccauugaacaacuccccauuuuccauuucucucagcccguggcaauaugcuuucuguuucuauaacauggacuacuugaguuuuuuucuuuuuuuugaugacaagaucucacuccguugcccaggcuagagugcaguggcaugaucuuggcucauggcagccuucaccuccugggcucaagcugucuucccaccucagccuccugaguaacuggaacuacaggugcacucuaucaugccucgcuaauuuuuuaauuuuuuuguagagacgaguucucgccauauuggccaggcugaucucaaacuccugggcucaaguaauccucccacuuuggccucccaaaauacagagauuaugggugugagccaucaugcccagcuggcuagauauuucauguaaguggaaucauacauuauuucucuuuuagugacuugcuuauuuugcuuagcauaauguccucaagguucaucuauauuguagcaugugacaagauuuccuuuuuaagggcugaauaauauucuguguuauguauauaccacauaucugugaguagacauuuggguuacuuccacuucguggcuauacugaauaaugcuauggugaaaguggcuaugcacauaucuguuugaggucuuguuuguaauucaguucguuuuuauauauacucauugguauuuauauaaaugggauugcugggucauaugguaguuuaauuuuuugaggaaccuccauauuguuuuccaugguggcugcaccauuuuacauucccaccaacaaugcauagugguuccaauuucuucacaacuuuaccaccgcuuguuacuuucuguuuuuugguaguggccauccuaacggguguaguuuuuuuuugcauuuuucuaaugauuagugauguugagcaucuuuucuuuuuuccccccauauuacacagauguagagcaucuuuucaugugcuuguuggcuauuuguauaucuucuuugaagaaauaucuguucaaguccuuugcccaucuaaaaaaaucugaugauuuguuuuuuuccaauuguuuaauuguaggacuuuuuuuuuuuuuuuuuuuuuugagauggagucucgcucugucgcccauccuggaaugcaguggcgcgaucuuggcucacugcaagcuccaccugccggguucaugcuauuguaggacuuuuuaauguauucuggauauuaaucucuuaccagauauaugauuugcuuuuuuuuuuuuuuuuuuucgauacaagguuuuacugugucacccaggcuggaguaaaguagugauguaaucugggcucacugcaacuuccgccucccaggcucaagcaguccuuccaccucagccuccugaguagcuggaacuauaggcacucgccaccauacccaccuaauuuuuguauuuuuuguagagacggaguuucaccauguugcccaggcuggccuugaacucccaggcucaagcaauccaccugccuuagccucccaaacugcugggguuguagaugugagcuaccacacccagccugauuugcagauauuuucuccaguucuguagguugccuuuucacucugaugacugcuuccugugguguguagaaauuugguguaggcccauuugucuauuuuuguuuuuguucuuuaauuucucuuagcaauauuuuguaaguuucauuguacaggauauuuggggaucuguaagacaacccucagguucaguaauuugcuagaaagacucaacucagagaauguuuuauacucaaauuauaguuuaguacauugaaaugauauggauuaaauuuagcaacagaaaaagacacauagggcaggguccaggagacaccccaggcucaagcugucaauaguccucucccaguggaguugugcacacagugcuuaauuuuuccagcaacaguguaugacaacacacguggaauauuggcaaccagggaagcuggcugagccuugguguccgggucacacauggcugaccucaguucucuggccccuucagaggccaagcugauacugugugacacaaggcccucaccguagaucacauuauuagcggaaacuuguuggcaugacccaaugccucauguaaacagcgcaguggcuguuuauaggccgggcgcaguggcucacgccuguaaucccagcacuuugggaggcugaggcgggcggaucaccugaggucaggaguuugagaccagccuggcuaacauggcgaaaccccguuuccacuaaaaaaaaaaaaaaaaaaaaaaaauagaaaaagaaaccaaaccagguguggugauaagugccuguaaucccagcuacucgggagacugaggcaggagaaucacucuaaccugggaggccaagguugcagugagccaagauugcgccacugcacuccagccugggcaacaggagcaaaacuccaucucaaaaaaaaaaaaaaguuaaauagaaaaaggacauaaaugaaaaagcacucaaccauccugauaauaagagaaauagauauuaaauuuaugccaagauuccauauuucucccaucagauugguaaaaaucuaagcacuugcuaacauaagguguuagcaacagugugguaaaguaggcaaucucuugcauugcugauucucuaaauuggugcaauccacagggagggcaauuuggcaugcucucguucucucucucgcucgcucgcgcgcucucucucucucucuccaugagaaggagagagagagagagagagagcacgcgaacaagcgauugagugagagagagagcacguaucugcagucucagcugcucaggaggcugaggugggaggauugcuugagccuaggaggucaacgcugugguaagcuguugacuaugccacugcacugcagccuagugacagagaaucugucucaaagauaagaagaaugaggauauucuuuauguacugauguguagaaaaaucucuaagauacauaguuaaguggagaaaacaaaaugcugcauggugcauuuacuguacuaccauuugugugaaaagggggaguaagaguauguguuuguauuugcuugcauauguagaaagaaacuuugaaaggauucaccaaauaacaguaguaagcagggggauuaggaaacuagguauauauuaagagggagcuuuuguacucuauaccuuuuaauacuuucuuugagaccaugugaauguuuuaccuauguauuuauuuauuuuuaauuuuugcuuugccugcuuuuaaacaaauaaauuguacuuuuuuugaagagcucuauuuuuauuuccuuucgauuaucaucuguagauucuuaugucacauuuuacuuuaacagcacauuuagacagaauacagucuuuaaauggaagccgacaauugauuucccuggaaaauuuuugaaguacaauaacauuugauugauugaacuuuauuuaguaagaauucuuagcaaaauucccucccaggcacaccuacauggugcuucauuuucagugaacuacaaaucucugaaacccaaaacugcaaucuaaaaguacaagauggcuggacucgauggcucaugccuguaaucccagcacuucgggaggccaaggcaggaggauugcuugagcccagaaguucaagaccagcuugggcaacauggugaaacuuugucucuacaaaaaauuagccgagcuucacaaacaaucuuacaggagucauucauuaauuaacucaacaaauauuuauagaguacaggagacacuagagauccagcaaaggucaauaacaugugcugucuuagagaaaacuuauauucuaagaauagucaagugacaaacaggagcuacaucaaauaaucacaaguacacuucagagaauuaaaaccagaucaacguagagaaaggcuuccuuacauucgauagucaggaaauucucucucuaccaggagggaacugagugacaaggaacagucaggugggagaagggcauuccagaugaaccagcccugagcggggaacuagaaggccaguuugagaaaaggaauggagagaggaggaacaguuuguggucagagcaaggaccaaaccauuuuagacuucaugagccuaagaaguuuugauuuuguuaugagcaugacaagaagccauuguaaucgaguuuuaaacaaaggaaugacaugaucucauuuuguuuaaaaaaaaaaaaucauccuggcuguaguguggagaauggacuaggggagcauaaaagcagaaagaccaauuggaagccuauuaacaguaauccaaaugauagauaauagugguuugaaccacaaagauuauggacauagaaagaagcagauagauccaggagauguuuuggagguauucuggcagaauuugcuggcugacuagacagagguacuaaggaaaagaaucaagaauaauuccuagauucgggacuuccuagaaacugggagaauggugcugcuguuuauugagauaaauggagaagacagaggagaagcuuagaauagaguucuaggagaggucagagauggagaucaacauuugggagacagaauuuucuaauuccauagugccgacgauuuucuauugauagacuaaaaaugucuggaauuuuauaugcaguuucaucuggacaauacccuaagaggagaucaguuauaccuuggcaccugcuaauagccauaggaauauguauauguagaauaaaugguaaaacuacugaaugcuuaauaugugccagacaccgugagauacgucuuugaaguacuaucccaguagaauuuacaacaacccuaucaggagauacuuuuuuuaucaccauuuuacagaugaagacacugaaguucaaagagguuaaauaacucgccccaaaucacacuauauagaagagaaaucuaaauccugguagucugaccccagaacuugggcuaauuaccacuauauaauacagugucacugggguaaacccaagauaugauaacauaaguuagagacuuuuaaauuccaaauuucacacacuaugauuucacccauaaaauguagugauucagccauagucuucugauuaguuggaguacccuaugcaauacuuuaggaacuugcuucuuuuauuuucauauauauauauguucauucauaaauuaaaucuggacagccagugaaucugccauuuuugucucuaaccaacacuucugucacaaaauuguacuuuuuuuuguuuuuuuuugagacggagucucauucugucacccagguuggaguacaguggcacgaucuuggcucacugcaaccucugcuucccggguucaaacgauucgccugccucagccucccaaguagcugagauuacaggugcccgccaccacacuggcuaauuuuuguauuuuuaauagagacaggguuucaccauguuggccaggcuggucuugaacuccugaccucgggugauccgcccgccucagccucccagagugcugggauuacaggcaugagccaccacgcccggcccaaacugugcuuuuuuuaaauaaagaaauuaaaacaguauuuuuuuccuuaaagauggugucucacuacauucccuggcucaaacgauucuggcucaaacgaauuccuaggcucaaacgauucuccugcguuagccuccugaguaccugggacuauagguaugugccacuauuccugaaaacauaaucaguuuugaagguagugucugggcugggcgcaguggcucacgccuucaaucccagcacuuugggaggccgaggugggcggaucaccugaggucaggaguucgagaccagccugaccaacauggauaagacuccaucucuacuaaaaauacaaaaaauuagccaggcaugguggcgcaugccuguaaucccagcuacucaggaggcugaggcaggagaauugcuugaaccuaggaagcagaggcuguggugagccgagaucgcaccauugcacuccagccugggcaacaagagugaaacuccgucuuaaaaaaaaaaaaaaaaagguaguguguggccgggcgcgguggcucacgccuguaaucccagcauuuugugaggccaaggugggcggaucaugaggucaggaguucgagaccagccuggccaacauggugaaacccugucucuacuaaaaauacaaacauuaagccggcgcagugguggaugccgauaaucccagcuccucgggaggcugacgcgggagaauugcuugaaccugagaggcagagguugcagugagccaagauugugccacuacuaggcgacagaaugagacucugucuccaaaauaauaauaauaauaauaauaaaauaaaaauaaaaguaguauccagcguacuacaaagaggaagaguuugugaauguguauguuacuguuaaguuaaacaguguucuaguauccaucucauuaucagccuugggcagggcaggguugaguuggcuaauguucauuauaaaccagaucauccaguuggggacucugaaugagcauaugauugccccuuucaugcuagacuuagcuaauuaaacuguucauaugaccuaaaaggauggcuguggugccauagaaagaaaacaaguuuugaggcaagagacuuuaguuugauuccuaccucugcuguuuucugguugugagauuuuuggaucaguugcuuuuguguucauuuaccaaaacuucucaagacaaaaagaauaaaugagauaaugugacagugccuuguaaauaccaaauacuauauagagauagcuauuauuacuuguauguuuauugugaacauuaaucagccaaucaaguuguucagacuuguacugcugaacaucaauugcagauauaacauucuuggcagaugacuuagucaccuccuucuguggaagaauagaagauagacagcuccuugcugucuaucacaguauguucuggucccguuggccucaccuuccauauaaucauuuccauucuacugggcuuuagccacucuggugacuugaguucagcaaaaauaaucuuucuugaugggugguauauauauuucuaccuuuuaugcuuuagaauaguuuccuuuccauuucucauaggguuuggaucuucauaacuguuugaagagaaauccugaccuccagacugaaggaaagcacaccaugccuuuauaacgccagccucggucuuuuuuuuguuccccucugucuuaguuccuuuuguauugcuauaacagaauaccgcagacugggugauuuauuuauuuauuuauuuuguuguugucauuuguuuucuucuuuuuuguaucuuuugaaauucuuuucauuguuguuguuguuuugagacugggugauuuguuuauucagcucaugguucuugaggcuggaaagcccaagaguauaugguaccagcagcaccugauuaugccaugguggauagacagaacggcaagagagagcuugcuuuuguaacaaagucacucccaugauaacuaaccuacuccugugauaacgacauugcagguucaguaucccugauuugaaagucugaaauucaaagugcucccaaaucugaagcuuucugaguaucaaugugaugcucaaaggaaaugcuuauuggaguguuuuagauuuuggauuuuuagauuugguauguucaaccuguaaguauaauggaaauauuccaaaaugcaaaaucugaaacacuucuggucccaaacauuucagauaaaggauacugaaccuuuaauccauucaugaaggcagaguccucaugacccagucaccuccuaaaggccucaccucuugauacuaccacaauggcaaccagguuuccaguacaugaauuuuuagggggaucauucaaacuauagcacccuccuuuaucccuuacccuauuccauuaguuuuaauccccacuuugucucuuccucuaaucuucagucuacacugugacaugauagguaugcucaagucucuaacagcucuaaaauaacguuuucuguuuuuuuuuuugucuucauuucuggugggguuggauaagaaaaguuuuucaaguuaaaucacucucuauugcaagccucuuccaccuuuuuuuuuuuuuuuuuugcuucgaagaaugauugccuuuaccuucucaguucucaguuauuuuccagcacauuaugauuuuaugaccuugauacagaagggcugggcuccuggcuaaauuccacccuuaaaccuggaacugcaacccuaagugaaaacagcuaaccccauuuuuuuucccacccaaauguugccucuuuggccugccaugccccuauccugugcucauaaaaauauuucagcugggcugggugcgguggcucacuccuauaaucccagcacuuugggagaccgaggcagguggaucaccuggggucaggaguucaagaccagccuggccaacauggcaaaaccguaucucuacuaaaaauacaaaaauuaguugggcaugguggugggcaccauaaucccagcuacuugggaggaugaggcaggagaauugcuugaaccugggcggcggagguuacagugagcccagauugugccagugcacuccagccugggcaaccgagugagacucugucucaaaaaaaaaaaaacaaaaacaaaaaagauuucagcagcugggagaacaauauaagcagcugacgucagggauauaaauggcuguguguugggaauacaagcagcugauugucggaaauacaagccacugaguguuggugauacaaguggcugagcagcgagcagagaaucaggugagcguuggagacuauggaugggacguggcuaacuucagauggugcagcuuuggagaauaggcccagccggagauggccuggcuucagggaaagaucaccuucuucccauaccaucccuuuuucaacuccccauucugcugagaaccacuuccaucgugcaauacaaucuucugcauauacuacccuucaaucuguucaugugaucugauuauuccuggacacuggaagagaaccugggugccaagaggagagggcaggggcugccacccugacccuccacugagcuggcuggcaccuggccauccccgaauggccgcguugaaggagcauugauuguaacacacuuggaugcugcugcggggccgcauagagccugcgccugccagagaggagcaacuggcugguucccgcauucguuugcucugauucccacacucacucacucgcuugcacacugccucuugcaagggguuugagugugugguggccgaguaaacgagccacgcuccgagccaugagggggucaagggaauuauccagucucaucucaauccgacuucccucuucacuguuuuacuuuuguaaaacccuugaugaacuucccauugucaauucagggucuuuuuagcucucauccugccagacuguugauaacaccucugauuugugcuccacuuuuggcuucugugucauauugauuccugaguuuucuuccuucuccucuauucucuuaaucucguuuucugguuuucucccaucaccugcugguuaagcuuagggguuauuuacacuucucuccuuggucaucuuuuuacuguauuuuucccuccacagcuauuucauccauuucugaggccugagauuucauccauuucugaggcuauagagaccagugacuuccucugacucuucugagcuugaaauuccuauugguaacugccauuggacuuaacugccugguuauaucucuaacuaaaguacuucucucuuccagccuguuuaucuuauuguguuccauuguguuccuuaucucuaccaaugcuaguuccuuaugcuagaaaucucauucauugccacucaaucaaguuugcuaaaaacgaaacaucugauugugucacuuauucaaccuuaccaauuuuuuuuuuuuuuugagccuugcuuugucacccauaguggcacgaucucugcucacugcagccuccaccacccagguucaggugauucuccugccguagccucaugaguagcugggauuacaggcaugugccaccaugcccgacuaauuuuuauauuuuuaguagagacgggguuucaccauguuggccaggcuggucucaaacuccugaccucaagugaucugcccaccuuggccucccaaagugcugggauuucaggcgccuggccuguuacuugauuauaugcuaaacaagggguggauuauucaugaguuuucugggaaagaggugggcaauucccggaacugaggaucccuccccuuuuuagaccauacaagguaacuuccggacguugccauggcaucuguaaacugucaugguguuggcggggagugucuuuuagcaugcuaauguauuauaauuagcguauagugagcagugaggauaaccagaggucacucuccucaccaucuugguuuugguggguuuuggccagcuucuuuauugcaaccaguuuuaucagcaagaucuuuaugagcuguaucuugugcugacuuccuaucucaucccguaacuaagaguaccuaaccuccugcaaaugcagcccaguaggucuuggccuuauuuuacccagccccuauucaagauagaguugcucugguccaaacgccucugacacaaggauuuuaaagucuuauuaauuaagguaagauaguuccuugcauauguggucugaaaucacagaaagcugaauuugaaaaaggugcuuggagcugcagccaguaaacaaguuuucaugcaggugucaguauuuaagguacaucucaaaggauaaguacaauuguguauguugggaugaacagagagaauggagcaagccaagacccagguaaaagagaggaccugaaugccuucagugaacaaugauagauaaucuagacuuuuaaacugcauacuuccuguacauuguuuuuucuugcuucagguuuuuagaacucauagugacgggucuguuguuaaucccaggucuaaccguuaccuugauucugcugagaaucugauuuacugaaaauguuuuucuugugcuuauagaaugacaauagagaacggcaggagcacaacgacagacggagccuuggccacccugagccauuaucuaauggacgaccccaggguaacucccggcaggugguggagcaagaugaggaagaagaugaggagcugacauugaaauauggcgccaagcaugugaucaugcucuuugucccugugacucucugcauggugguggucguggcuaccauuaagucagucagcuuuuauacccggaaggaugggcagcuguacguaugaguuuuguuuuauuauucucaaagccaguguggcuuuucuuuacagcaugucaucaucaccuugaaggccucugcauugaaggggcaugacuuagcuggagagcccauccucugugauggucaggagcaguugagagagcgagggguuauuacuucauguuuuaaguggagaaaaggaacacugcagaaguauguuuccuguaugguauuacuggauagggcugaaguuaugcugaauugaacacauaaauucuuuuccaccucagggccauugggcgcccauugcucuucugccuagaauauucuuuccuuuucuaacuuugguggauuaaauuccugucaucccccuccucuugguguuauauauaaaguuuuggugccgcaaaagaaguagcacucgaauauaaaauuuuccuuuuaauucucagcaaggcaaguuacuucuauauagaagggugcacccuuacagauggaacaauggcaagcgcacauuuggacaagggaggggaaaggguucuuaucccugacacacguggucccugcugcuguguucuuccccuacugacuaggguuagacugcacaggcuaaacuaauuccaauuggcuaauuuaaagagaaugauggggugagugcuuuggcaggagucagggaagagcagguagcagguaacuggaaugaggguggagcagguaauggaaaaacauugcuuuacgaggaaguuaaguuuaaaaguagaaggcaaagaauugaacauacuggcguauuaauucuuugaaauuuagaacucacaucuaacauuggcuuaaauguuaaauccucaaagauaacauuccuguuucuccuaacacgauuaaguccuucuugguaucuuuucucauagcaacuuguccuuucucacuugucacaauuugcaaauauauauuuauuuacauuguuuauuuaaugccuaauuuccuucuuuauugcaaggccugugaggguacugagucuccagggugagguguauaauaaauggccaaacgaauuguuaauugaaaggaugaacaacuaauucaagccagcacucucuagacuccuggggggcuaucauguggguucccuggugcugcugaugucagcccuuggccuccaagaaaaaugcuugauucaaaugucaucuaguuccaucucuacgacucucaugggguccaaagaagaguuuuaauugaguuuuagaauuugaaguugugaagugucugaaaaacuacaugguguucugaaagccaaacuuuuagccuuuugggagagcaucuaagacagcaggugaagggcagggguuagaacuagagggauugaagaauauuauccauauagguuaggguuagguuuggcaacguauuauagaacaaacauuggcaagcuacagccacaggccagaucugucugcuaccuuuccacaaagguguaauaacaaaguuauucacaaauuugugaauaaacuuucauuggaaagugaccacgcuccuugguuuauacauugucuguggcugcuuucacacuacaguagcacaguugaguguuugcacuggagaccauaugacccauagagcuuaaaauauucagucuggcuuuuuacagagauguuucugacuuuguuaauagaaaaucaaaacaacugguuuaaauaaugcacauacuuucucucucauagaguagugcagagguaggcaguccagauuaguacgguggcuucacguucaucaaggacucaaucuccuucuuucuucuuuagcuucuaaccucuagcuuacuucaggguccaggcuggagcccuagccuucauucugacaguaggaaggaguaggggagaaaagaacauaggacaugucagcagaauucucuccuuagaaguuccauacacaacacaucucccuagaagucauugcccuuacuuguucucauagccauccuaaauauaagggagucagaaguaaagucuuuuuggcugggaauauuggcaccuggaauaaaaauguuuuucugugaaugagaaacaaggggaagauggauaugugacauuaucuuaagacaacuccaguugcaauuacucugcagaugagaggcacuaauuauaagccauauuaccuuucuucugacaaccacuugucagcccacgugguuucuguggcagaaucugguucuauaacaaguuccuaauaagcuguagccaaaaaaauuugaugagguauuauaauuauuucaauauaaagcacccacuagauggagccagugucugcuucacauguuaaguccuucuuuccauauguuagacauuuucuuugaagcaauuuuagaguguagcuguuuuucucagguuaaaaauucuuagcuagauuggugaguuggggaaaagugacuuauaagauacgaauugaauuaagaaaaagaaaauucuguguuggaggugguaaugugguuggugaucuccauuaacacugaccuagggcuuuuguguuuguuuuauuguagaaucuauaccccauucacagaagauaccgagacugugggccagagagcccugcacucaauucugaaugcugccaucaugaucagugucauuguugucaugacuauccuccuggugguucuguauaaauacaggugcuauaaggugagcaugagacacagaucuuugcuuuccacccuguucuucuuaugguuggguauucuugucacaguaacuuaacugaucuaggaaagaaaaaauguuuugucuucuagagauaaguuaauuuuuaguuuucuuccuccucacuguggaacauucaaaaaauacaaaaaggaagccaggugcauguguaaugccaggcucagaggcugaggcaggaggaucacuugggcccaggaguucacaagcagcuugggcaacguagcaagacccugccucuauuaaagaaaacaaaaaacaaauauuggaaguauuuuauaugcauggaaucuauaugucaugaaaaaauuaguguaaaauauauauauuaugauuaguuaucaagauuuagugauaauuuauguuauuuuggauuucaaugccuuuuuaggccauugucucaaaaaauaaaagcagaaaacaaaaaaaguuguaacugaaaaauaaacauuuccauauaauagcacaaucuaaguggguuuuuguuuguuuguuuguuuguugaagcagggccuugcccugucacccaggcuggagugaagugcaguggcacgauuuuggcucacugcagacucaacccaccaguuucaagcgauucuccugccucugccucccaaauagcugggauuacaggugugugccaccacacucggcuaauuuuuguauuuuuaguagagacaggguuucaccauguugaccacacuggucucgaacuccuggccucaagugaucugcccaccuuggucucccaaagugcugggauuacaggcaugagccacugcgcccggcccuaagugguuuuaauauuuugauugacaguauacugaagaaauauacucuaagaccuuuaugaaucuccucauucacaaauaacacuguaggauauaauggucccuauaaaauacgguauaacuaaaaucagauuuuuauauuggaguacagaacaauaaagccaucuucagaugcugguauuaaacucacuggugacuggucacaccuugccuaaacugguagccaccaugcauccucucaccaucuccacuguacuacuuccuuccuugggaagucgggcgcugggagguuguacaggaaagauacagacccacccuucucagccucuccuccccuagcucgcucuuuugccaaagugaccuacugcugaguuucaaagugaccuacugcugaguuucagccaacuagcacguuucagauucauaccuuagaaaaaauuacacauuaucacaagucaugcaccuuuuaaggucauuuucaaauaauagaaauuauaaguguucggccaggcaugguggcucaugccuguaaucccagcacuuugggaggccaaggcaggaggauugcuugaggucaggaguuuuuuuuguuuuuuuguuuuuuuccccgagacgaagucucgcucuugucccgcaggcuggagugugacagcgcgaucuuggcucacugcaagcugugccuccuggguucaagcgauucuucugccucagccccccgaguagcugggauuacaggcgccugccaccacacccggcuaauuuuuguauuuuuaguagagacuggguuuuaccguguuggccaggcuggucuagaacuccugaccucaggugauccacccaccucggccucgcaagggcugggauuacaggcgugagccaccauaccuggccgaggucagggguuugagaccagccugagcaacauaguaagaccuaucucuaccaaaaaaaaaaaaaauuaacuuuccaaauguaggagucuacucuguuuccuucuaguauuuauuucuguauacuuuucuaacaugguuaaaauguguaaucaauauguguccuuuuacuuuggugugaacauuuuuucuauuauaaauucuuagaaaauauuucuauggcuaugagauauuugauucaagugccuuguaauuuacuucucaaaugucccugauguuggacauuuguuucuaguguuucacuauuuuaaaaaacaguaauaucugucuuuaugcuuagagcuuuuucaguuuuucaaauuauuuccuuaggguaaaauccuagaaguagaauuuuuggggcaaauuaucuacauauuuauaacugucuugguauucaaaaucucguuuucaaaaagcuuauaucaauuuguacuuaacaccaguagugaaugagaguaucugucguaccccaccagugcugaauuucuuuuuuaaaacugugcugguuuuuauagguaaagaaaaugucuuaauuugcauuuaguugguuacuaguaauaucacauaccuuuucaaugcuugugaacuuuaagcuuauacagaguuuaaccuugcauguugaacauuugagugaguggaaguguuaagugauggccaucuguauaaucuauuaguaauguauggagaccauuaaagaugacagguaugugugaugaugacagguuguuaccaacacucagaaggccaaaaagcaagugauauaaacccaugcugggaagcauucaccucccccacuuuaaaaaugcuaguuucuuaauuccuuuucuuuaucccuuuuuuugucugcacguguuuacuugccuuuaguuucccugcuuuaguaggcugaccuugugacuuuuaccaggaucccauuauacuuuuguucuucuguuuauuucucagauuuuauuggaggguggaauucuacuuuuucuuucuuauaaucuagaauuuacauucagauuuccugccuuucccuuacaaaauaccuguguaguuggauagguggagcucuggacucagaguucuuucuucuaguaaucuuaggaaauuauuuaauuuuucuguguuuucauauuuucacacauaaaagagaaaacaccauuucuaaacuaccucuucuuuucucugcuuuuaagcauguaaagguuuucccaaucuugggcagugacauguacaggacaguauagcuuuacaucugccuuguuuuaauuaaacacuaguucuuugagguaaccccuacuauuaucccaguuuuauggaugaggcacugaggcaggggucacacagcuagugugggucagaaccuaaugggucagaauggacauuugaguccagaguuuggccuggauugacacacauagcuauuacguaagauuccucucaaauucaguccucagcucccugaaguguggguucucuuuucaugccuccauggaaacugcguaucaugugguuaccaguuuuuccuuuggucguaucugcugaccuuuuugaaccuaauuuuuucuggaccuuauugccauuugacuuauuuauugccucccacuugacacugauucuggcuuuugcuuuucuuccuacuuugguccuuuuugcaguuuucuaaagcuaaccagccaugacucucagaugauggacuuuuucgucucucccauuacuucuugggaaauuauauuuuaaucucaugguuuaaauuuucauccuuaaauauaacuuuuaauguaguauuuuuagcccagaagggcccaugguugguuuguuuucuccuuugcauaucucuucuacucagauaccugguagcauauaaaucaaaugaauuauccuucauaccauuucauuaucaucaguaggacugcuuugcugggguuuuuuuguguguguguuuuuguuuuuguuuuuguuuuuguuuugagauaaagucuugcuuugucaccuaggcaagagugcuaggauuacaggcgugagccgcuaugccaggacagccguuuucuucuaguauuauuugcccucugucugaacaucuuccuuuaguaaugcuuuuagagcaaggcagcuggccucaauuuguuuuaauuuuucuuccccuuaggauguuuuaauuuuaccuuuauuacugaaggauauuguuacugggcagaaaauugucuugauauuccccuuuucagcauuuaaaaaaugcucuucugcuuucuuucagccuccaugguuucucauaaaaaucagucauucgaaucacuguucuucuaaaaguaauacauuguuuuguucuggucacuuucaaaauuuucuuuuucuuuucagcaguuuaauuaugggacugugugaggauuucuuuguucauucuguuuggaguucacugagcuuuuugaaucucuagguuuaugucuuuuaccaaauuuggaaaauuuuucaaccauuauuucuucaaaauuuuucuguaccacauucuuuacucuuuuuuuuuuugaaacagaguggcgcacugcaaccucugccuucccgguucaagugauucuccugccucagccucccaaagugcugggauuacgggugccugccaccaugccuggcugauuuuguuaauuuuuaguagagacgggguuuuaccacauugaccaggcuggucuugaacuccuggccuuaaguauuccgccugccugggccucccaaagugcuggguuacaggugugagccaccacacccggcccuuuuuuuuuuuuuuuuuugagaccgagucucgcuuugucacccaggcuggagugcagugaugugauuuuggcucacugcagccucagccucccaaguaccugggauuacagagaugugccaccaugcccagcuaauuuuuguauuuuuauuagagaugggguuucaccauguuggccaggcuggucuuaaaccccuggccucaagugauccgucugccucagccucccaaagugcugggauuacagacgugagccaccaugccuggcucuuuacccucuucugggagugacaacacaaauaacuuuuuauuccacagguuucugaggcucuguuuauuuuccaauuuuuuucacuauuguucugguuagauaauuucuauugaucugucuucaaguuuccugaaauuugcauuuuguugguaaaccuauucaguaaaauguuuuugguuauuuuauuuuuaguucuaaaauuccuauauagcccgucuuuacauuuuuuuauucugaaacuuaaaacuuuccuuucauuuuaagaguguuugcccuuacuucuuggagcauuuuuaugcuccaaggauuuugauauuuuuguuuuauuggccaauugaucugauugggcuagguccagccagccuugucaaagccuuugcaguguugcucagaucugccccauguauaugccacccagucaccagucugggacugguauagugguguucuauuuguaauucgguugucagggucgguguguacuguugaggaucauauccauacucacucaccuugggaauggacccacaaguuuauaaacagcuuuaagagauugcuuucaugaguuucuuucuuucugugaucuccaugugguuucuugggcuucccuuuuccauuccugcagccaaaaguggacuuuaucuuccuaaagucagggccaaaaugugggaggagagagagaaauaaagcaagggcuauuugccccacucucucgggacugacauucuuccagucagaguaaggauucccucccucugaauuuuaggcuucugccacccacauuaccaucaccacaggauugugugaggacugggcauacgagaauggagaaaagcggaaaagaaugccgggugugguggcucacgccuguaauccuaacacuuugggaggccaaggcgggcagauugccugagcucaugaguuuaugaccagccugggcaacacagugaaaaccugucucuacuaaaauacaaaaaauuagccaggcaugguggugggcaccuguaguuccaguuacucaggaggcugaggcaggaguauugcuugaacccgggaggcagagguugcagugagccaagaucgugccacugcacuccagccugagcuacagugcgagacucugucuccaaaaaaaaggaagaaaaacuggauuuuuacacugucuggguguuaggagaccucuuuccugauccucaagccagaacuagaggucuucuggagcucccauugucuugcuaaugcccacucauguuguaaugagcacagguggaggaaaaaaaguggucagcucacugcuaguacuucuaauuccccagcccaccuaccucucauuacuuuucaucuuuugcaaccagcugcugccugcuuucugcccagguuuuguaacuguauucagugggauagagagaguggaagguacuuacuccaucuuaucuggaaccuuucuuaauauauuuuuugucgcauuuguacaucuuuuauccauccuucauuuuauuuuauuuuuuuuuuugagacggagucucagucucucgcccaggcuggaguguaguggcaugaucuuggcucacugcaaccuccgccuccuggguucaagugauucuccugccucagccucccaaguaguugggauuacugggacacgccaccaugccuggguaauuuuugcauuuuuaguagagaugaggguuccccauguugcccaggcuggucucgaacuucugaccucaggugauccacugguuucggccucccaaagugcugggacuacaggccugagccaccacgcccagccuuauccuucauuuuagacaguuuaagagguuuguauucagccagaucuccacauuuacuuguucauuuguguugugauguuuuuuaauguucaagucuuagcacacacaaacaauuauauagaaacaaguuguuuacuuugacacccaguauaacuaaaaggaucuuuugagucagagauugaguaacuugccagagccuguuuggaaauaaacccugaggauuuuucauaucagugguugguuaugcaaugucuguggcaagcccuagaaacuaaaagaccaaaccuuaaaauguuaaaaacaggaaaggcaguuaauuauuauacauaauuuguuauaaaaggaacuauaacuuauuaaagucagaugauuucuggccuugauaguuuaggguuuagagaagauacuguuguguacuauaaaacagcagggcuguuuucuuucauacccuuuagcacaggaaagcugaacuagggauuuuugcaagaugagaaaggccuguugaaauguguguguauaacauaguaauaaaagaaaugcauaugaaaauaacaaauuaacauauuugacauauugacuuugucaagauuagucuuuuuugucaaguaacuaagccaguguguauuaauuaaaucaguaauuagaaaaaguuuguacacuuugauuuaguaauuuugcuuuuaugauauauucuaaagaaggaauuagaaaugcagaaaaauauuugugaaguaggauguucauuuuaauguaaauuaaaauuggggaaagaaagggaaaacaauacagauuccaugcauaaggcaaagguucaauuguggguuuauccguaugaguagacuauuauuuugucauuuaaaaaucauaguuucagcugggcgugguggcucacgcauguaaucccagcacuuuaggaggcugaggugggcggaucaccugaggucagaagaucgagaccagccugaccaacauggagaaauccugucucuacuaaaaauacaaaaaaauuagcugggcgugguggcgagugccuguaaucccagcuacucaggaggcugaggcaggagaaucgcuugaaucuggggaguggagguugcggugagauugcgccauugcccuccagccugggcaacaagagcaaaacuccaucucaaaaucaaucaaucaaucagucaaucaaucauaguuucacgccaggugcaguggcacggaccuguagacccaguuacuugggacccugagacgagaugauugcuugagcccagguuuuccagucuagccugggaaacauagugagaccccagucucuuaaaaaaaaaucauauuuucaaauaauauuugguggcaugagaauauguuuguaauaaaagauuacauuugugaaagcagaauguaaacaguacacuaguugauucucacuguuaaggucuuuacacacgccuauacgugcagauagaaaacaugucugaaagggaaacgguuuuauuuuguuucguauuuuuuuuugagacaaugucucacuuugucagucaggcuggaauguaguggcacugucucggcucacugcacccuauaccuccuggguucaagcaauccucccaccucaaccuccaugguagcugggacuacaggcaccugccaccacgccuagcuaauguucguauuuuuaguagagacgggguuuuggcauguuggucaggcuggucuugaacuccugaccucaggcaauccaccugucucagccucccaaacugcugggauaacaggcgugagccacugugccuggccugaaagggaaauguugguauuaauuuugguugucacuggccuuuagaauaguuuucuucuuuuaguguuucuguguuucuuaaguguuacaagcauauguuacuuuugauucagaaaaaugcuauuuuuaaaauaagcaagacugggcacggugacucucaccaguauggcugagaccagaggaucacuugaagccaggaguucaaaaccagcuugggcaacagagugagacccccaccucuacaaaaagaaaaaaaaaaaauuaaaaaauuagccaggcauggugguguacccacgccuauaguccuagguacuagggaggcugaggugggaguauggcuugagcccagugguucgagauugcagugagcuacgaucaugccacuguaccccagccugggcaacacagugaggcccuaucucaaaaaauaauuaaaaaaaaaauauuugggggcuccuagaagguacaguuaaaaaaauuaaaauuaggccgggcaugguggcucacgccuauaaucccagcacugugggaggcuaaggaggguggaucacuugagaucaggaguucaagaccagcuuggccaacauggugaaacuucaucucuaauacaaaaaucaccugggcguugguggugggugccuguaaucccagcuacucgggaggcuaaggcaggagaauugcuugaaucugggagguggagguugcagugagccaagaccaugcuacugcacuccagccugggcgacaaagugaggcuucaucucccaaaaauaaauaaauaaaauuaaaaaaagaaauaaauaagaacaucuccuucuuccuuugccaaaaaaccgaggugaaaagcaucucucaagaaugaugagaauuucaauuauuuaauauuuacucugguccuuaauuuaaagcuuaauauggaaucccaguguacaucucccacugguauuguuugucuuggccaagacagacaaguuuuaaagagugagauaaaauuuaggcuaaaguugaaguauuuggagggaaauguacagauguucucagcuuaccuuuuuuguuuuuuugagauggagucucgcucuguugcucaggcuggagugcaauggugcgaucucagcucuccacaaccuccgccucucagguugaagugauucuccugccucagccucccaaauagcugggacugcaggugugugccacuaugucuggcuaauuuuuguauuuuuuuuuuuuaauuuauuuuuuauugauaauucuuggguguuucucacagagggggauuuggcagggucauaggacaauaguggagggaaggucaguagauaaacaagugaacaaaggucucugguuuuccuaggcagaggacccugcggccuuccgcaguguuugugucccuggguacuugagauuagggaguggugaugacucuuaacgagcaugcugccuucaagcaucuguuuaacaaaacacaucuugcaccgcccuuaauccauucaacccugaguggacacagcacauguuucagagagcacaggguuggggguaaggucacagaucaacaggaucccaaggcagaagaaguuuucuuaguacagaacaaaaugaaaagucucccaugucuacuucuuucuacacagacacggcaaccauccgauuucucaaucuuuuccccaccuuucccgccuuucuauuccacaaagccgccauugucauccuggcccguucucaaugagcuguugggcacaccucccagacggggugguggccgggcagaggggcuccucacuucccaguaggggcggccgggcagaggugccccucaccucccgggcggggcggcuggccgggcggggggcugacccccccaccucccucccggacggggcggcuggccgggcagaggggcuccucacuucccaguaggagcggccgggcagaggcgccccucaccucccggacggggcggcuggccaggcggggggcugauccccccaccucccucccagacggggcggcuggccgggcggggggcugacccccccccaccucccucccggacagggcggcuggccggccggggggcugacccccccaccucccucccggacggggcggcuggccgggcggggggcugacccccccaccucccucccggacggggcggcuggccgggcggggggcugacccccccaccucccucccggacggggcggcuggccgggcggggggcugacccccccaccucccucccggacggggcggcuggccgggcagaggcgccccucaccucccggacggggcggcuggccgggcggggggcugacccccccaccucccucuccgacggggcggcuggccuggcagaggggcuccucacuucccaguaggggcggccgggcagaggcgccccucaccucccggacggggcggcuggccgggcggggggcugacccccccaccucccucucggacagggcggcuggccuggcagaggggcuccucacuucccaguaggggcggccgggcagaggcgccccucaccucccggacggggcggcuggccgggcggggggcugacccccccaccucccucccggacggagcggcuggcggggcggggggcugacccccccaccucccucccggauggggcggcuggccuggcggggggcugaccccccccaccucccucccggacgggguggcugccgggcggagacgcuccucacuucccagacggggcggcugccgggcggaggggcuccucacuucccagacggggcggcugccgggcggaggggcuccucacuucucagacggggcggccgggcagagaugcuccucaccucccagacggggucgcggccgggcagaggugcuccucacaucccagacggggcggcggggcagaggcgcuccccacaucucagacgaugggcggccgggcagagacgcuccucacuuccuagaugugauggcagccgggcagaggugcuccucacuuccuaggugggauggcggccgggcggagacgcuccucacuuuccagacugggcagccaggcagaggggcuccucacaucccagaugaugggcggccaggcagagacgcuccucacuucccagacgggguggcggccgggcagaggcuacaaucucggcacuuugggaggccaaggcaggcggcugggagguggagguuguagcgagccgagaucacgccacugcacuccagccugggcaccauugagcacugagugaacgagacuccgucugcaaucccggcaccucgggaggccgaggcugguggaucacuugcgguuaggggcuggagaccggccuggccaacacagcgaaaccccgucuccaccaaaaccagucaggcguggcggcgugagucugcaaucgcaggcacucggcaggcugagucaggagaaucaggcagggagguugcagugagccgagauggcagcaguacaguccagcuucggcucagcaugagagggagaccguggaaagagagggagagggagaccguggggagagagagggagagggagagggagagcgcuuaaaacaauuuuuaagauguauuucuuuucucauaguuccagaggccagaagucccaagucaaggguuggaagcaauuuuuguauuuuuaguagagaugggguucaccauauuggccaggcuggucuugaacuccuggccucaugauccgccugccguggccucccaaagugcugggauuacaggcaugagucacugcgcccgaucucucaguuuacuuugauauguauuaauaauaacaaagacuaauggaugaggagcuagacagaaauuuuauaaaccaaguacugcaaaauaugaaugguagacucuaggugauauauggguguucacuguaaaauuaauuaaauuuugcuguguguucgaacauuuuuguaacaaaauguuggaaaauuuuuguggaagaacaccagaaacaacuuuguuguaucuggauauaauuuagaauauucaaauguuggcuaggugcgguggcaaccuguaauccuagcacuuugggaggccaaggcagguggaucaccucaggucgggaguucgagaccagccugaccaacauggagaaacugugucucuacuaaaaauacagaauuagccaggugugguggcacaugucuguaaucccagcuacuuggggggcugaggcaggagaauugcuugaacccuggaggcggagguugcggugagccgagauugcgccauugcacuccauucugggcaacaagagcgaaacuccgucucagaaaaaaaaaaagaauauucaaauguccaaggaguaccaauaucuagguaaagccauucuguuggccuuugccaaauuguacuauuuuauaaaguuguuuuaaagagagaugugggccgggcauaguggugcacaucuguaaucucagcacuuugggagucugaggcgggcggaucacuugaggucaggaauuugagaccagccugggcaacauggcgaaacccugucucuacuaaaaauacaaaaauuagccuagcgugguggcgcgcacgcgugguuccaccuacucaggaggcuuaagcacgagaauugcuugaacccaggaggcagagguuguggugagcugagaucgugccacugcacuccagucugggcgacaaagugagacccugucucaaaaaagaaaaaaaaaaucuguacuuuuuaaggguugugggaccuguuaauuauauugaaaugcuuucuuuucuaggucauccaugccuggcuuauuauaucaucucuauuguugcuguucuuuuuuucauucauuuacuugggguaaguugugaaauuuuuggucugucuuucagaauuaacuaccuuugugcuguguagcuaucauuuaaagccauguacuuuguugaugaauuacucugaaguuuuaauuguuuccacauauaggucauacuugguauauaaaagacuagucaguauuacuaauugagacauucuucuguugcuccuugcuuauaauaaguagaacugaaagaacuuaagacuacaguuaauucuaagccuuuuugaagauuauauagucuucuaguagaagucugugcaucagaauguuuuaagaaaggguuuuaagaauguauaaaaaccaaaauaauugauuuucauacuucuauauuguuuuuuaucagugacucuuuuuucuuucaaaugaaaucuuauaugaaauuuucauauauaauauagaaaaaaguggaucuagucugucaaagagaauagugaagcucagagaugugccagccuggccuuuuucucagcucaaguggcagaauacaguuuguaaacaauugcacuagcucuuaaauucgaagaggcagucaaacuaauaaauaaauuggagaguuauuucuuugguagaggauuaagggaaauaaccacagacagaagaagcaaauaugagaaucuaugugaaauggaugauauucuagaaaaaaaauuaucaaaacugaccccuaaagagagaauaucuaaacagaguaaagaagagguacagaaaguuacugaagaaguuuccaccccaccugcacaaauaacaauaguaccaggccccaguggauuaauggggaaauucuguuaaaccuuuaaggaaugguaacucuaauacuaaguguuccgaacauauaaaaagaaaaaaagcuuccagauuaauuuuaugaagccagcauaacauuaauaacuaaagcccugcaaguuaucaaguaaaagaaaacuauuggucgguuauauuuauugauuucaaaagcauaacagaauauuaagagaauucagcaauagaugaaaagaauaauacuuuuuuuuuuugagucucacgcuguugcccaggcuggagugcaguggcaugaucucggcucacugcaacccccaccuccuggauucaagcgauucuccugccucagcccccugaguaaccgggacuacaggugcgcaccaccaugcccagcuaauuuuugcauuuuuaguagagacagaguuucaccauguuggccaggauggucucgaucuccugaccucgugauccgcccgccuuggccucccaaagugcuggaauuaacaggccugagccaccgcacccugccauaauaauacauuugaccaaguggaguuuguuugcagaaucguucauuauaaguugccauauuacuagaucaucaucucuguaugugcuaaaaggcauuugauaagauuccuguucuugaucagauuccuuaauaaauagacggggucgggugugguggcucauguuuauaaucucaauacucugggaggcuaagguaggaggauagcuugagguugaaaguuggauaccaaccugcgcaacauaacaagacuuugccucuacaaaaaauaaauuagccaguuguggugugugcauguaguucuagcugcaugggagacuaaggcgggaggauggcuucagcccaggaauucaaggcugcagugagcuaugauugcaccacugcaccccaggcugggugacucagucucuaaaaauaaauaaauaacuaaaucucuaacauuauaaaauguaugcaucucauucuaaaggccaaugucauccucauagggaagcuagaagcuugccuauuaaggucaggaaugagauggagguuuucuuuucuuucuuuuguuuguuuguuuuuuguuuuguuuuuucugagauagagucucacucugucauccaggcuggagugcaauggugugaucucggcucacaggaacuucugccuccuggguucaagcgauucuccugcaucaaggccucccaaguagcugggauuacaggcaccugccacuaugcccggcuaauuuuugcauuuuuaguagagcagggguuucaccauguuggccaggcuguucucaaacucuugaccucaggugauccaccugccuccgccucccaaaaugcugggauuacaggcgugagccacugugccuggcugagaugaagguuuucuuuaucaccaauuaucuagcauugcucuggagggacuagcaaacacaauuaaacaggagaaagaaauacgaacuauauaauuuggaaaagaagguuaaauuaccaauauuuggagauaaaaugauuguuuacuuuguuuuagaacuaacugaaaaccaauucaaauuacuaaguaaguuugguaaggcaauuaauugauuacaaaauuaaacaaaaguccccugucugggugccguggcucaugccuguaaucccagcacuuugggaggccgaggcgggugguucaccugagguuaggaguuugagaccagccuggccaacguggugaaaacccaccucuacuaaaaauacaaaaaauuagccgggcgugguggugggugccuguaauuccagcuacucuggaggcugaggcaggagaguggcgugaaccugggagauggagguugcugugagccgagaucgcaccauugcacucccaccugggcaacaagagugaaacuccauuucaaaaaaauaaagugaaaacacaaaucaauaaccuucacauaaacaacuaguuagaaaacauaauaaaaggauaagucccauuuaugauagcagcaaaaaagauuaaauaucuacgaguaaacaagaauugugcaagcccuggacacuggugaagcagagaugccagcugagguccugcccccagcuccccuuaagcugagcaguguggagaacaucuugcacaggcugcugacugccuuccaagaagcccuugaccuuuaccauguguuggucucccuugaccgggugggcacugagcaguagcagguguagacugagcuggccucuaacuuccuuuggauccacagccaguuguaggccaacaacgggguggaggggucugauguggcuccaggcccucuccagcucagguuaccccuccuuauguacauuguacucagagcugcuagugcaggcugugcagaggaaggcaggggacacugagguccagcagucccugcuccugcuucugaagaaauagauauuuuaagugaauaaacugacagcuuagagggguaaaaaagauaauaugcaagaucuauugagaauuuuaaggcugggugugguggcucacacuuguaaucucaccuauuugggaggccgaggugggaggauccuuugagcccagggguucuagaccauccugggcaacaugguugaaacuccaucucuacaaaaaauacaaaacuuagccaggcgugguggugcaugccuguagccccagcugcuugggaggcugagucaggaggaucacuugagccaaggacuuuggggcugcagugaacugugguugugcccucuauccagggugacagucagaccuugucucuauuuaaaaaaaaaaaaaaaaaaaauuaaaauaugcuaucauuugugucaaguagaaaaguauauauaugacauguauagacuuucuggaaggauguacaugaaauuaauaguagugcuuuccaaucaggcacgguggcucacaccuguaaucucaacauuuuuggagguggagacaggaggacugcuugagccuaggaguucauagccagccugggcaacauagcaagaccccaucucaagaaaaaguagugcuuuccucuaaagaggggaaccauggggcacaguggggagaaaaccuacuuuucacaguaucuguugugaauuuuauaucuuauucauguguuaccuggccaaagauuaauaaauagauuguuuuuguuuuuguuuuuuaguuugaggauacuggaaaugcuuaauauaaauaucuacaucguccagaaauuucaauguuuacucuauuuuggaauuucaaagugggagaggaaucaucuuuuuggaugguaccugaaacugaaaguuuaugccuaaaggcgugcuugcuuucuccucaguuaccucaggcaucuucuacaguugcaaucucuuuguuguuagaugguggauuuugccuccccagaauuaaaauagcauuuucuucauuauaaaaauacuuaacauucauuguuuuuuuaaaaaagacauuauauaagauuauaaagaagaaaaaugaccagauucccaccaccuaaagauaaguccugucauccuuucaggaauuaauauaucaauuucucaucuacucuucucucacacuacuuugcauaaaugggaucauaaaugggauccuauauuuuuucaagcaacaguguguuaugccuauacuccauguuuauauguguguauuaaaaaauguauuuguauauauguguauguauaaguguguguguguguaugaugauucuucucccgcuuugaaggugaaagaaagcacaccuuuauuuaagcauaaacuuuggguuucagauacugucuggaaaaaugauuuaucucccacuuugaaauuccaaaauacguacauauauuuuuuuuuucuuuucuuuuuuaguuuuagggucuugcuguguugcccaggcuggagugcaguagugugaucauagcucacacagccucuaacucccaggcucaagcuaucuuccugccccagccuccugaguagcugggacugcaggcaugugccaucaacuuuagcuaauuuuaaaauuuuuuuguagugauagagucucacuguguugcccaggcucgucuggaauuccuggccucaagugauccucucaccucagccucccaaauugcugggauuagagugugagccacugugccuagccugcauauaucuauuuuuaaugacugcuaaaucucauuguaugaaaauuuauguccuagcuauaaaauuuguuagcacauguuuaauuuuuucuaauuucagauguuuuaaacuaauauuucccaaaguauaguauggcauuuuagguaugauaugaucuuuuuuccucuucguacucauuuuuauaguuauggccugugcaacugguuucccauuuauaugaaugauacagagcuuccuauuaagaaaaaguucagcuugggaaaaaaaaagugaauuguucaacuugagggaaaaaagugaauuaauuggccaggcaccguggcucaugcuuguaaucccagcacuuugggaggcugagacggguggauugcuugaacccaggaguuuuagaccaaccugggcaacauguugaaacccuaucuguacaaaaaaaauuagaaaaauuagcugggcauaguggcacacaccuguugucccagcuacuuaggaggcugagcugggaagaccaccugaucuccggagguaaagacugcagugagccgugauugcaccacuuuacuccagccugggcaacaaaaugagacccuggcucaaaaacaaaaacaaaaacaaaaaaagaguaaauuaauuuaaagggaaguauuaaauaaauaauagcacaguugauauagguuaugguaaaauuauaaaggugggauauuaauaucuaauguuugggagccaucacauuauucuaaauaauguuuuggugaaaauuauuguacaucuuuuaaaaucuguguaauuuuuuuucagggaaguguuuaaaaccuauaacguugcuguggacuacauuacuguugcacuccugaucuggaauuuugguguggugggaaugauuuccauucacuggaaagguccacuucgacuccagcaggcauaucucauuaugauuagugcccucauggcccugguguuuaucaaguaccucccugaauggacugcguggcucaucuuggcugugauuucaguauaugguaaaacccaagacugauaauuuguuugucacaggaaugccccacuggaguguuuucuuuccucaucucuuuaucuugauuuagagaaaaugguaacguguacaucccauaacucuucaguaaaucauuaauuagcuauaguaacuuuuucauuugaagauuucggcugggcaugguagcucaugccuguaaucuuagcacuuugggaggcugaggcgggcagaucaccuaagcccagaguucaagaccagccugggcaacauggcaaaaccucguaucuacagaaaauacaaaaauuagccgggcaugguggugcacaccuguaguuccagcuacuuaggaggcugaggugggaggaucgauugagcccaggaggucaaggcugcagugagccaugauugcaucacuguauuccagccugggugauagaacaagaccuugucucaaaaaaaauuugguuuuucaagcuuuuugagguuuugacaagcuggccaauauggugaaaccccgucucuacuaaaaauacaaaaauuagcugggugugguggcguacccuuguauucccagcuacuugagaggcugaggcaggagaauuauuugaacccaggaagugaaguggagguugcagugagccgagauggugccacugcacucuagccugggugacagagcgagacucugucucaaaaaaaaaaaaaaagcaaaaaaaaaaaagcacaagcagagugguagacacacaaaaugcucaauucauuuuuuaaacgauuuuuuuccuuuauaucuuacugcagaagcuuuuuucuuuuuuuugagacaaagucuugcugugucacccaggcuggggugcaguggcacagucauagcucacugcaaccuugaacucccuggcucaugcgauccucccacuucagccucucaaguagcuagaacuacaggugugcaccaccaugccugacuaacuuguuuauuuuuuguagagagaacgucuugcuauauugccuaggcuggucuugaacucuugggcucaagcaauccuccuaccuuggccucucaagguauugggauuauaggugugagccacugcaucuggccucaauucacuuuuaaaaucaaaauuagguuaccuacuuuuuauaagguaauguauagaauuauucuuuuaaaaauaaaaccgauuuggacagugugagauucacauucuguaaccaccagugugacauggguccugaacaguuagaacauacuccagccauuaacccaggcagcuuucagguacguacucuguggcuguugccuuguaugaaagccaaaaagagauccauuuucagagauuaauaugugaccccuucuauauuauaaggccauggccauacucuuuuuuuuuucuuuuuguuuuuuucuuccaaagacaggaucucucucugucauccacgcuagaguacaguggcaugaacguggcuuacugcagccucaaacccuuguccugggcucaaacaauccucccaccucagccuucaaaguagauagaacuacaggcaugcacuaccaugccuaauuuuuuaaaaaaaaauuuuuuuucagagaugagaucucacuguguuucccaggcuuguccggaacuccuggccucaagcgauccucccaccuuggccugccaaaguguugggauuacaggcaugagccaccaugccuggccauacacuuuuuuuuuuuuuuuuuuucaagacggagucuggcucugucgcccagacuggagugcaguggcgugaucuuggcucacugcaagcuucgccucccagguucaugccguucuccugccucagccucccaaguagcugggacuacaggcaucugccaccacgcccggcuauuuuuuuguauuuguaguagagacgggguuucaccauguuagccaggaugaucucgaucuccugaccucaugauucaccugccucggccucccaaaguguugggauuacaggcaugagccaccgugcccggccuggccauacacuuuugucauuauuuacauacuuacuaaaauguuugguggccuguaauaggaaacaucauccucauuugauugacgaagaagucuguggaaauaggauugaacugguucuguucuuguauuugaguaaucaguuguggaacuauagaagucauauacucucucugacuuucauaauuaccuuauguuguauaguacuugaugguuugcaaaguaaccaucuauucuugcuuagcugugaguaagaaugccaggucuggagacagaaugucuggguucaaauucuacucaucacuuuuuauuuuuauuuuuuuugagauagagucucgcuuuguugcccaggcuggagugcaguggcgugaucucagcucacuacaaccucucccucccgggaucaagcgauucuccugccucagccuuccgaguagcugggacuacaagugcgcaccaccacgcccagcuaauuuuuguauuuuuaguagagacgagguuuugccauguuggccaggcuggucucaaacuccugaccucaagugaucugccugccucagccucccagagugcugggauuacaggcuugaaccacugcgcccagccuacucaucacuuacuagcuauuugaccacacaaguuacucaacuccuaugucaguuaugaagauuaaauuaaaugauccauuuaauacaauaauacacuuagaacaaugucuaucaguaaauuuuuuucuguuuuaagaaacaggaucucacucugucucccaggcuggagugaaguggcacgauuauagcucacuguagcuucaaaagccugggcucaagcaguccuccugucucagccucccgaguagauaagacuacaggcacagguugguguugaccuccuagcuucaagcagccucccaaagugcugagauuacaggugugagccacuauacccagcccaguguuauauuuuuguauaauccuaugaaguaucaaggcaguuauuaucccuguuuuacugcuaagaaacuugaaguuuacagagguaaauuauuugccuaagccuaaacucugaucucgaaucugaaucccaaguccaauauucuuuucaccguauuacaauauuuuuaccaucaacccuccauucugucugcacaucauacaaaugaguaucucuacagagcuuugaguugcuuuuaaacaaaagagauuuuuguacccaauguuuagaguagugauucucggcuccauuuuuacaagauuucaagauuuaauuugucaaaaaaguucugaaauuuucaaagcaaaagcaauuuuaauuuaauugcucuaaaaaauaagcagauuuaucauuuagcaauucuuuaagggagaguguaucauaaaacugaaauaguacugaauguggcagaaucaaacaaguugaaaaucucaucacuucagagcagggcagacuucucauucaaacaaauugagguagaaguggugagaguagagauuucuuuguguauguguguuuuauuacuguacuauauuauauuauaguucuauauauacuauauuauauuguacauauauauuauuauaugaagagacaugaccacuuugaggcaugaaauuuuuuuuuuuuuuuuuuuuuuuuugaggcacggucuuacuuugucaccuaggcaguggcgccaucuuggcucacugcagccuccaccuccagggcucaagcaauccucccaccucagcuuccugaguagcugggacuauaggcaccugccaccaugagcugcuaauuuuuuguauuuuugguagagacgggguuuugccaucuuggccaggcuggucucaaacuccugagcacaagugaucugcugccucagccuccccaaagugcuggaauuacaagcauaagccacugugccuggcaagacaugaaauuuuuaaauguaaaugcauuuaagugacaauaaugugaauacaaguuaucaauucuuccuuuacaaguuuagcuauaccuguuuuauauuuuucaguguuuaaaauuauuuuuauauuuuuauauucugaauuuucuuucuuucuuucuuuuuuuuuuuuuuuuuugagacggagucucgcuguauugcccaggcuggagugcaguggcgcaaucucggcgcacugcaagcuccgcuucccggguucacgccguucuccugccucagccucccgaguagcugggacuacaggcacgcgccaccacacccagcuaauuuuuuguauuuuuuaguagagacaggguuucaccguguuagccaggauggucuugaucuccugaccuugugauccgcccaccucggccucccaaagugcugggauugcaggcgugagccacugcgcccggccuauaugcugaauuuucaugacagagaaugaaagaaaaagugcaguugaucgaaagaaauggugguauaaacaggaauaacaggcauguuguuuccucucugauuuauuauuuuuguaaaauaagcuacuuuucagcaccacauacauauguucugagaccugaauauuugugaccaaagaguaaagaaguaauaaacuuuaucucgcaaagaguuauuauuguguuuuauuuaaauuuacugcccucuuacuucaaguacuucucaguaguacguaauacugcuuuuaaaaaggagaagggaugaauuucuucuacucugcucuucauauuuugaaaaguucagucaaauccccuuuauuaaauucaucucagaguaaucuuuuuaauuuguaguucauauccgugauuaguuuagaagugacuucucccuguuucugcucacuguagguugacaacugcuuaaaauagucuaucucaucauuaucucugcagcuuuccuuuaaacuaggaagacuuguuccuauaccccaguaacgauacacuguacacuaagcaaauagcagucaaacccaaaugaaauuuuuacagauguucugugucauuuuauuuuguuuauguugucucccccacccccaccaguucaccugccauuuauuucauauucauucaacgucuuuuuguguaaaaagagacaaaaaacauuaaacuuuuuuccuucguuaauuccucccuaccacccauuuacaaguuuagcccauacauuuuauuagaugucuuuuauguuuuucuuuuucuagauuuaguggcuguuuuguguccgaaagguccacuucguaugcugguugaaacagcucaggagagaaaugaaacgcuuuuuccagcucucauuuacuccuguaaguauuugagaaggauauugaauuaguaaucaguguagaauuuaucggaacugaagcacauguaacuauggucauuuucaugguacuuguucucaucuuaaaugcacagcauuccuggaacuccugcagaucucuuuguuuccuugcaagcaauugucuucuaccugauguugauucaagagaguuuucaauaugaauagaaagaaagaaaauguuuagauauuggggaaccagcauucccauuuuaaaaccuguuaggaguuguugauuagggcaagcucaaggauuccuuugagugacugguuuagaugucuuucugcuauucggugaccacuggggaacugagauuguugagcagaaggguaaugugagcagagccgugccuuuguaagcuggcagcacugugugagaugaauugguggguuggauacugagaucaugagaggcauacuaagcauaauuaagaugauauugccaugaucuagguggaaaguaauggggguuugaauuaugguaguggcaguagcaaucaagggaaagaguugaucagaggauucagagguagaaucaauaguucuagcaacugaggagagaaguuguaagcuugaaggaaaggugaugaagaaaaaaugcuuuccuguguuuucuuguuguuguuguugagauagggucucacucccauccaggauggaguacaguagugugaucauggcucacugcagccucgaccucccaggcucaggugauccacccaccucagccucccgaguagcugugacuacaggcacgcacuaccaggccuggcuaauuuuuuuguguuguguguagagacuggguuuugccaugugcccaggcuggucuugaacuccucggcuuaagcgauccuccugccuugacuucacaaagugcuugaguuacaggugugagcuaccacgccuggccauguuuucuugugugaaggaucuguuuaguuuuauaucuuucuguggcucauaucuaauuuaguugacaguaccugugggucacuagguagacauugcuagcagacguuuagaaaugaaauacuagagcuugggaaaaaguugauauuugagauagagacuugaagaacauuagcagagaguugguaguuaaggucugugagcuggugagcaauucaaauaaaagcagaagagaagaggaagacaagggucaaacuuugucaacuacuguguuuagagaaugagacaagagaggauacuacaggaaguagaggaaaauaguggaaaauugggcaagccaguauuuuucacuuaagaauaucauuacuguuuuuugaugucagcacaugaaauggcugcauaguguucucuuacguagauauucagugguggguauccucauugauagacauuuagaucauuuccauuuauuuucuaucacagacagcacuuacagagugcauccaugaacuuaugaauauuauuauaaaauguauucuuacaguagaauugcuaagucaaaggauguauuuaaauuuugauaguuugccauauugccuccuaaaaaagcugugccuguuuacauucccuucaguaauaugaaaguaucaauuuccuuaccccuuugguguuuugguuuguuuuguuuuggagacugagucucgcucugucaugcaggcuggagugcaguggugcgaucucggcucacugcaaccuccgccuccuggguucaagcaguucuccugccucagccuccggaguggcugggauuacaggcgugugccaccacacccagcuaauuuuuuguauuuuuaguggagacacgguuucaccauguugaccaggcuggucucgaacuccugacuucaggugauccgccugccuaggccucccaaaaugccaggauuauagcugugagccaccaugcccggccacugcuuuguuaaugcuugccugugucugugcauacaugcaugugugugugucugagagagaaagagaucuaauaggcaaaaaaauaacaucuuguuuuauuuuuuauuguuugucuaaugcuuugggugauuauuugaacuuuuuuucauguguuucuuaguuacagaucugaauuuauuuuguaacuggcuugguauaaucuuuuucauauuugugaaauuaaucuuuuuugugugugugugagacagucucucucugucacccaagcuggaguacaguggcgcaaucucaacucacugcaaccuccaucucccagguucaagcaauucuccucucucagccucccaaguagcuggaauuacaggcgcaugccaccacgccuggcugauuuuuguauuuuuaguagagacgggauuucaccacguuggccaggcuggucucaagugauccaacugccucagacucccaaagcauuaguauuacaggugugagccacugcucccagcccuguaaaauuaaucuuaauuauacaaguaauucauuauccuugaaaaaggauaaacauuacagauaaaaauaaauuucacgguaacuaucaucucuaaucuuaaugccuuaucaaguacuuaccccuguugucaguuuguuguauauccuuguagauuuuuuuugccaauuuuucuguugaguuacuggaaaagcaguuucaagaaggagagaggcugggcgugguggcuaacaccuguaaucccagcacuuugggaggccuaggugggcggaucacuugaggucaggaguuugaaaccagccuggccaacauggugaaacucugucuuuacuaaaaauauaaaaaucagcugggugugguggugcacacuuguaaucccaguuacuugggaggcugaggugggaggaucacuugaacccaggaggcggagguuacagugagccaugaucgugccacugcacuccagccugagugacagcaaggcuucauccccacccucccaaaaaaagagaauaucuuuuuguuuguuuguuuguuuguuuguuuguuuguggcagagucuugcugugucgcccaggcuggaguucaguggggcgaucucggcucacugcaagcuccgccuccuggguucagccauucuccugccucagccuccccagcagcugggacuacaggcacacgccgccacgcccggcuaauuuuuguauuuuuaguagcaacgggguuucaccauguuagccaggauggucucgaucuccugaccuugugauccgcccgccucggccucccaaagugcugggauuacaggcgugagccaccgcgccuggccgagaauaucauuuuuuauaaagaagucaaagguaaugaggacuaaguaaaaccauacaguauuugcugucuaagaugucauuagugacauugaagagagcaguuucaguagagugauagaaccagaagcaguacuccaaagggaaggugcguaugugugcaugcaugucucuguguuuugccagugcuggcaguggaagugaugguguaggcagagaauggguggugaagaaggagagguauaguaaaugucauguacuacaucaaagauuccugucucacaggcagagcagguggugaccugacaggagaacagguuucaggaaagguguuucaaggagagggaagguuccauuuuauuuuauuuauuuauuuuuuuugaaacagagucuugcucuguugcucgggcuagagugcaguggugugaucuuggcucacugcaacccccgccucccaaguucaagcaaugguccugucucagccuccggaguagcugggauuauaggcacccaccaccacauccggcuaauguuuguauuuuuaguagaguugggguuucgccacauuggccaggcuggccuugaacuccccaccucaagugauccaccugccucggccucccaaagugcugggauuacagacgugagccacugcacccgaccuguuuuauuuuauuuuugagguaagucuugcucuguugcccaggcuggagugcaguggcgcaaucucagcucacugcaaccuccaucuccuggguucaggcaauucuccugccucagccucccgaguaguugagauuacaagcaugcgccacuauaccuggcuaauuuuuuuuuuccauauuuuuaguugagccacagguugggagaagggaaaauacauucuacucaaagugaguccguggcaaaagugugaguacagagaugggugaggaauuaggaccagacuuucagucugcagcaacauuaaacauguauguuaauuuaauacucagaaagaagcauuuacucuguuuuaaaauaucuaucacauacuauauauauauauauauauauauauauauauauauauauauauauuuuuuuuuuuuuuuuuuuuuuuuuuuuuugagacagucuugcucugucacccaggcuggagugcaguagcgugaucucgacucacugcaagcuccaccucccggguucacgccauucuccugccucagccucccgaguagcugggacucuaggcgcccgccaccaugccuggcuaauuuuuuguauuuuuaguagagacgggguuucaccguguuagccaggauugucucgaucucuugaccucguaaucugcccuccucggccucccaaagugcugggauuacaggcgugagccaccgugcccagccuaucauauauaauauuuuuaaaacucaacgucugugcucgcuuuagcagcacauaauaguaaaauuggaaugauacagaugauuugcauguauuuuuuuaaaaguucucaagucuauuuaauaaccacagaauaugagacauucugagauguuuuagaaacaguucaacauaugugggaaaauaggaguauaaacccuuaccuccuguguagaucagguagguucaagauugcaucuguucuuuuguaauacuaaaugucuggugaagauuugaggauuuuauauaaaucauugaguuugagagguuuuuuuguuuuuguuuuugagauggaguuucacucuuguugcccaggcugaagugcaauggcacaaucucggcucacugcaaccuccgccucccagguucaagcgauucuccugccucggccuccugaguagcugggauuacagacgccugccaccacgcccagcuaauuuuuuguauuuuuguauuuuuaguagagagaggguuucaccauguuggccaggcuggucucaaacuugugaccucaggugaucuacccgccucacccucccaaagugcugggauuacaggcaugagccaccgcaccuggccuucguuuuguuuuuucaacagaauguaagaauuuuuucuuacauuuuucuuacauuuuuaacagaauguaagaaaaccacaacgcaaugccgaugaguacuuuuucccugaaguggauauaagcaugaauauaaaaaguuuuaaaucagucauccuggcuauuuguucucuaaaaaucaauaaauaauucuuucaugcauuuuaauacugucucccaguuaaggguauucaguuugcaaaaugcucuuacugacaggaaauguaugagcauuuuuguuuuuuacuucugucguuugacagaaaaaauauacaccuacucuuugagcuaauuuauucuuaccuaguggucauuaguagaagugguucacucugggagcuuaacuagaagggaaacuaacaauuccuugagguagaucauuuuaucuaaagcuuuuugauuucauaucaguugggggcggguauauuauguuaauuuuuaaaucugcauauuuuccagccaggcaugacuauaaucccaggacuuugggagguagaagcaggaggauugcuugagcccaggaauucaagaccacccuagacuacauuaaaaaacauauuuuuuuguauuuauuuuuuauuuuauuuuuuugagacagaguuucgcucucauugcccaggcuggagugcaauggcacgaucucggcucaccacagccuccgccuccuggauucaagcaauucuccugccucagccucccgagucgccgggauuauagacaugcaccaccacaccgggcuaauuuuguauuuuuaguagagacaggguuucuccauguuggucaggcuggucuugaacuccugaccucaggugauccacccaccuccgacucccaaagugcugggauuacaggugugagccaccaugccuggccuuuuuuuuuuuuuuuaauuuaaacgaaaucugcuuauuuuccuguugauguaagguguuuguguuaaggugaaaugaaaagugauuuuuaaaaaaauauuauuuuaggacuauuuaacaaauauacuauuuaugauaauuaacaugggguuagcaaacuacugcuugaagccaaauauggcccauggcuuguuuuuguacagcuuauaagcuaaaaaugcuuuuuacauuuaaaaaaaaaaaaaaagaacaaggaagaauaugugacacacaaaaccugaaauguuuacucccuggccauuuacagaaaaaguuagcuggacauugauuuucauguuacuauuaacugcuaaaacaaaggagcuuguagcuauauuuuuucauacuugcauaaagaaagaaaaccuaauaaaucgcugguggcuucauuuccaaaaggcuauggaaauccauaaacaggcugggugcaguggcucaugccuguaauccuagcacuuugggaggcugaggcgggaggauugcuugagcccaggaguuugagucuggccugggcaacguagugagacccuguuuuuagaaaaaaugaagauaaaaaacuaauccauaaaccucauacuuggugguugcccuucaguuuuucuucuuuagaucuggauuuaguuaaacaguguauugccugccugguuucuguuaacuuuugaucauuugguuggguuauccuauaaugaaacuugguugaccucagaaauaacaagguggucguucagcuucuuugauuguguguuucuuucauaaguucuucaagaagccugaguauuagaaacauggauaaaauuauugugauaaaaagccagagagacauaaaugucaaguaucuuguuuaaaauuacugugaccaggccgggcgugguggcucacgccuguaaucccagcacuuugggaggcugaggcgggcggaucacgaggucaggagaucgagaccauccuggcuaacacagugaaaccccaccucuacuaaaaaaaauacaaaaaauuagccaggcaugguggcgggcgccuguagucccagcuacucgggaggcugaggcaggagaauggcgugaacccaggagacggagcuugcagugagccgagaucaugccacuguacuccagccugggugacagagcaagacucugucucaaaaaaaaaaaaaaaaaaaaaaauuacugugaccagauuggacucagcuugcugcuggcauuugguucccaccauaaccucauaugucauguguuugcuuauauguacuuuuguguuauuguugguguaucuucaggauaaguuccaaaauguaauauugcuggguuaaaggauuaaugcacauguaguuuuauuagauguuaccaaauuucccuccaguggggauuauaccauuuuucauuccugccugaaauauaugagagaagcaccauuuuaaaguuuucacaaugucucugaacuaaaaugugguagagaugcacauguguauaucuagaucuagauugauauauugauauacauguauuuuuguagaaggggcacagaggaggccucuugacuaucccuauuauguuuauugcuuuuaacguuuuuucucacgccggguuuaaaacaugguuuagcauuauugaacauucuaaaaaugagacauaauaugaaggaaauuuacucugugcaucuuuugaauuauaaucaccaucugaggcuuuugugagcuccaguuuguccuggaauuuagaacauucaacuaguccagcuauuguuucaguggaaucuugcuggccugaacaguuuuccuucugguuccuuuucagggacuaaaaaugaugaagaguuuugugauagcaggugcaguuugaguacuacaguaaacauucaguuucagaacuucuucucuuaccugcuaaaaccaaagagaaccuuuuuuuuauuuuuacuucugauuguugaacagucuuaaggcagcauuaggaagacuggcgauuuguguggagaaaugauggcuuguuguugucuaugcauacuuuguguguccagugcuuaccuggaauuuugucuuucccaacagcaacaauggugugguuggugaauauggcagaaggagacccggaagcucaaaggagaguauccaaaaauuccaaguauaaugcagaaaguagguaacuuuuauuagauaauaucuugauuuuucagggucacuguuauaagcuaacaguauagcaauguuuuuaucgucuuucuuuggucauagacuccuuugagaaucucuugagaacuaugauaaugcccaguaaauacacagauaaguauuuaaggaguucagauacucaaaacccaacaauacagucaaagcauccuagguuaagacaccucccauuaaauacagaauaccagcauggaaagguucaggcugagguuaugauuuuguuuuuguuuuuuguuuguuuuuuauaagucaugauuuuaaaaagaaaaaauaaacucucuccaaacauguaaaaguaagaaucuccuaaaagaaacaaaaaagaaacagacaauaaaggaaaaauaaguaaacaaaaaaagcaaaauauaaacaacauaaaaaugagaaccucuugucuaacauggccagaauaacugaaauaugauuugagaugugcugauguguauacugagaagaucaaauauucuagguggauaugacuuuuuagaagaggauaagaaugacuuaggaugagcugggugcagugaugugugccuguagucccagcuacauggccaaggcaagaggaucacuugagcuaaggaguuccggauuacccugggcaacuuauaccuuaccucaaaaauaauaauaauaaugaauaauaauaaugacuuaggauaagagagugaaaggcccucuaaggauacuacagaacauauuaaggagaacacaaguuagaaguuguuauuagauggaguugagggggagcuuucauucaguuuucuggaauggaggcuaccuucccacacacacuaaaaaaaaaaagaaaggguugaggaauaacagcacaauauaaauagucuaaaaaaagggcuaacuuuuaugaggaaucugaaaaacaacaggcacaguaaauauuggugaggaaaaaaaggccuuaauugaguugcuguuugucaggaaagggagaguuuauguuuuauaaagccaggaaaucuacagaguuagcauuuaggcaacugcaaggaagauacuuucaaccaggaauuccuauuuggaacucagagaugugagucuuuauuauacaguaagcaaggcagcagaacaaggucauguuagacucucacgggauccuuagggugugacuuugcuagccagaaaccucuguggcugguggcaccuuuuccugagauuugcucaggcccacugggcucauuccaccuacucagccuagcuggcuaugcuuggcuuucucuaccagcuggaccccaugccugccaaaggcaagccaggcauggagcagcgaggagugcaugagcaagugagugcaggguccagccacugcacacagccaggcaugcuggcugcagcagggcaggcagccucagguacuagcucccugcugcagcuagaccaggcauuaccuaagcagcuuugacuacaggccacuaccacuaguaaaccugauagaaaaguaagaaauauacuggaaagaauugccacaagccuggcucuuguguuaaccuuguguuaaccuggggaacacaggggcacccagaagcuuggagaugccaggaacugcagaaccccaaagaggggggucauagcccuggcuuagggaacuccugagucuggacuccccgaagggccacaucucuucacuccucucuucucuccuucucgccaccugcaacguggcaaguggggggcacguuucagcccuguuugucuuacgguucuuucaauccugccauucaaugggucccaaguucuuguccugcauccaggaagaaugaaguacguggacagcuggagggagagcaagaugaaaaggugcuuuauugagcaacaguacagcucucaggagacccuaucugcaggcaggucgucccauugucucugcagcucucaguggagaggagaccuggaguggguagcuccugucugcaggcaggucauccugaugucuguaauccucaguggagaggagacccggaauggguaucuccuauccacaagcaggucaucccaucaucucugcagcccucaguggagaggagacccggaguggguagcuucuuucugcaggcagguugucccuucaucugcccaagucugacugagucugggguuuuuaugggcuucagaggggaggaaguacaugcugauggguccauggguggccaugagcaggcccagaaaaugcaccauaaguucucacuguggucuguggaacugggagcuuggccuccaggcuucaggcuuucccugacuugagguggugcuucaccagggaacuuccccuuuccgccuaggagccugucugccuccugcugccaucaaccugcugucuauagcucccauggcacccaggcuguucaugccaaagggugccugcaggcccacgguaagcugccuucagccccuccucagucucccucccaugcuugucagcacccaaaguccagagggggccaagguggcagggggcuggcaugucagugcugccccaagcgcccgcacacccggccaggucaugacagcacccagccucagccacaacuuugcucugaaaucggagccugcagacgcaaggggcuuccuggaccccugagagcacagggaugcccaggucuacagccacagcugggaagcugcagcugugggagugcgggacuucugccccaccaacucagaagggggcaggacucccgccuguuccuggcuccugccagcucacagagcaugcugccccagcugcaccuccccugcugcagcugccaucuuugcagcagccacuccagaugggccgcugcugccaucaagaccacuaguaaaccugauagaaaaguaagaaauauacuggaaagaauugccacaagccuggcucuuguguuaaccuguguuaagcuaaagaaaaucaaaugauugucugugagcauguagguauauauguaugugagugagugauacaacagaauuucauucauuuuacagauguugacugagcaccugacuaugugcuaggcccuggggauauagcacugaacaagauuuccccugcccuuguggagcuuauagucuauuuggagagauagauggucaacaaauuauuacauaaauaauucauacaguugugauagguacuacaaagaagacguauaaguugcuaugaaaguuuauaauaggggaauuuuacguauccuggaaagucaaggggugcuucccugaggaagugguaauaggggacggcccgcugaaggauggaggaagagcuuuccaagagagggacaacaugagcaagggcuuugaaaugagaaggcuggaugaacugcaggcuuccucagugagaaugcugcugguauuuuggggggcacaguucuuugugggacuuucccucauauugcaagauauuuaacaucccuggccccucacccacuaaaugccaauaauggcuuuaaggcuuugcaauaaucaaaaacuccuccauccuaguuauuuccaaacacuccccggaagggaggugcuaucccuaguugaaaaaucacuguguuaacggaacuagaaguuacauuggaacaaaagggcauagggcuccaagagggauaucuguguaaggaaaaaacaaacaaaagaacugagagauuaccugaugugguugagcucugucagagcauuucaggauaaauuagucauagauaauaauauaaaauucaucaguggaaaaaaaugaggcaguuuuccaaagaaaacaaaaacuugcucaaaaaagcaaauguaauuauaguauauucuggcuauagcaaaguaguuuaguugugaauauuauuugcauagugagaauauaaagcugaauuuaauauaagguuauggcacugggaagacaggaagaguuacauuugcgugcacuaaaggaugagaccuaaugcuuuaucuucucuauaggaggugaauaaguaccucaaauuaaaacaucaaguuauggcacaaugagcaugcuacuuauaauuaauuauggagguaaauaccaaaagggauggcuaaaagaguuuaagguaggaaugaguaucagaagugaggagggaggggguagaaaagggacugcuguuuucauuuauaaaucuuauucuuauauuauuucauaaacuccaaaccagagaagauucagguuuuuggagaucuggauaauaaaaagaauacaaaacuaucaauacaaaauugugagggcucucccagaggaagccaugcaaggaagggcccugaagcuuacaagcuuuacuuauucauggcaaaucuacuucugcucugaacauguauuacuuuuauaaaaaaugaaggaagaauaaaaguacuuugaacuucacuuauauauuuuaauuauuuuuaauguauggaaguuuuuuaagacuaucaugcucaccauuuucaaugagauugauagucauuauaaugaaaugacuggcccauaaagacauucacuccccgcuccuuucccaauccacccuccagaaugaagccacuuuuauaauuuugucaccaaauccagggaugagugccaacaguuaggaagcuuucaguugcaaaagauaaaaagcccaacucaguugccuuaaacaaagaagaaauuuauucuuucacgugacaggaaggccugagguguaggcauuugaaauuuguaggguugguuaauuugguggcucagggauguuuucaaguagcccaacuuccuacucuaccaucacuaguuuauaggcuuggucuucagcccacugcucuucguggucaugacagcuguaguucuaggcaucaugucuagauaaggcaacauucagggguagaaggggacuguuuauuuuuuccuuuagucucucuuaaagagugagaaaaauuuucccaggaaucccgguggacuuugcuucaccacucauagguucauaccaaguuacaaccccacaaccuuagagcuuuuguuaggaagaggcuuggugggauuaccgugcuuggcuuggcuuggucaggauucaccaccagagucaugugggagggggugggaacccaaacaauucaggauucugcccucaggaaauaaaggagaaaauagcuguuggauaaacuaccagcaggcacugcuacagcccaugcuuugugguuuaagggccagcuaguuacaaugacagcuaguuacuguuuccauguaauuuucuuaaagguauuaaauuuuucuaaauauuagagcuguaacuuccacuuucucuugaaggcacagaaagggagucacaagacacuguugcagagaaugaugauggcggguucagugaggaaugggaagcccagagggacagucaucuagggccucaucgcucuacaccugagucacgagcugcuguccaggaacuuuccagcaguauccucgcuggugaagacccagaggaaaguaugugcauuucucuauguugcaaagucauggauuccuuuagguagcuacauuaucaaccuuuuugagaauaaaaugaauugagaguguuacagucuaauucuauaucacauguaacuuuuauuuggauauaucaguaauagugcuuuuuuuuuuuuuuuuuuuuuuuuuuuuuuuuuuuuuuuuugagacagagucucgcucugucgccagguuggagugcaauggugcgaucuuggcucacugcaagcuccaccucccggguucaagugauucuccugccucagccucccaaguagcugggacuacaggcgugcgccaccacgccuggauaauuuuuguauuuuuaguagagaugggguuucaccaucuugggcaggcuggucuugaacuccugacaucaugaucugccugccuuagccucccaaagugcugggauuacaggcgugagccacuguaccuggccucccuucagacuuuuuaaguuggcauuuuacagccugaccuuuuggcauuuauuuuauaaaguaaaagauuuguuuuuuuaauuguuccaguaagccuucauggccguaauacauuugucuacaaaaauuuuauuaauaugucucacucugcuguagagagaucuguggauuugcaugauacaaccuuguacauuauuauuccuuuuguugacaagugcuauauuuuauuuuaaagaaaaucaaagggauuuaggauauuggcagaaaugcaaguauuucuucagugucuaagauguguugccacuugauggauuuaaguuaacacuuagggcuucuuaggaacauuaucagccacuaaagcccuuugguuagggcucagucaucucuucaguuagucuuagagaugugguucauugaauaagacuuuagcauauuuuccaaccaaguuauuuuugguugucuuguuuuugcaagagugaaacuugauuaaaacauuacaacaagaauauuaaguaguuuuaaggaaacaaacaccuagguuccuuagcaucuuuaaucauuagucacuaauuauuaugaccuugacauauccaucaguuugaggagaacacuuuuuacaccuuguccucaguuuuuuaacugagucagaacuuucacugggcauguucaugacuuuacugcuuggcugaguuuuccagauaucaaagcccagcugcagccugugacuuucacacuccuggaaaaguagacguaucugccugcucuuacagcaggcuuuagcuugccuuugcugggacuuuguucugcccucaguuaccacaguaauuagguugccucuucuacuuuccucuuuucucacaggcaccaggagccagaggaaauaacauaauaguuguugaccagagcagcagcauaauucuuucaugacugccuuuucuaauuugacgauucccucuccugagagggcucuuuguguccuccuccucuucgucuccaacuuuuaaaaaaaaaaaagugaaacuaucaaguauugcuccugcuaacuucagaucaguauuuucuuucucugaagccaaugcaaaguaauaacggacgugcuucaucaucuuagcauucagcacacgugucaccaucucugauggugugagcauguuaaaccagacuuguggguacuuaccaaaagguucaguugacacuauaggucaguugcuaaaaggcacaaaugucuucuaaagcaaucuguuaaaagucaacauuuaacauuuaauuagaaaacugaucaaaggaucugaauguuuaguucucccaagaaaauguaaaaaugaucuguaaacacauaaaaagauacucagcaucauuagccaucaaggaaaugcaaaucaaaaccacuucauacucacuagauuggcuauaauaaaaaagauagacaauaacagguguuggugaggaugcgaagaaacuggaauccucauacacugcuggugggaauguaaaauaguauagugauuuuggaaaacaguucgguaguucuuugaaagauuaaauaugacccgguaauucuacuccuagguauauacucaagagaauuuuaaaacauaugucaacacaaagacacauauacaauggucauaguaauauuguucauaacagguaaaaacagaaacaacccacaugucuauuaacugauaaguggauaauaaaugugguauauucauacaauggaauauuacuugguuauaaaaagaaacaaucuaucauuaguacacuuaggaugagcuuguuacuggcauguuggcugugggaaguauaucuugaaauucacuaaaagaccaacuauugcugggcgcaguggcucaagcaccuguaaucccagcacuuuggaaggccaaggcaggcggaccaccugagaucaggaguucgagaccagcccaaccaacauggagaaaccccaccucuacuaaaaauacaaaauuagcccauugugguggcacaugccuguagucccagcuacucaggaggcugaggcaggagaaucacuugaaccugggagguggagguugcagugagcugagaucauaccauugcacuccagccugggcaacaagagcgaaacuccaucucaaaaaaaaaaaaaaaaagaccaacuaccuucacaauaaauaaaaaugucuuacauuucuaauuaaaauuuuuguucaguuuuauuauucagcuuuaaaaaggaagggaauucugacauguuacaacaugaauaaaucuugaguacuuugugcuaagugaaauaagcuaguuacaaaaagaaaaauacuguaugauuccacuuacaucagaguagucagaaaguagacuggugguugccagggguuaaggggaggggaaaugaagggucguuuaauggguguagaguuucaguuuuacaagaugaaaagaguucuguggauggacgaugguaaugguagcacaaugauacgauuauaccuagugucuuugaacggugaacuuaaaaaggguuaagauguuaaacuugauggguaucuuaccacaguuaaauuuuuauuauuuuuuuauuuuuugagacaauuucgcucguugccuaggguggagugcagugcugggaucucagcucacugcaacucugccucccagguucaagcgauacuccugccucagccucccgaguagcugggacuacaggcacacaucaccauacccggcuaauuuuuauauuuuuaguagagacaagguuucaccauguuggccaggcuggucuugaacuccugaccucaagugaucugcccaccucagccucccagagugcugggauuacaggugugagccacugugcccggccaaaaaaauuuuuuuuaaauaccguuaagaaguggaaaauaaggccaggugugguggcucacaccuguaaucccagcacuuugggagaccaagguugguggaucaccugagguuuggaguuugagaccagccuggccaacaugguaaaaccucauaucuacuaaaaauacaaaauuagccgggcgugguggcgcaugucuguaaucccagcuauucgagaggcugcggcaggauaauugcuugaaaucgggagguggagguuucagugagccgagaucacuuaaaaaaaaaaaggaaaauaagcuaccagcugagagaaaauauaugcaaaucauauugaaguccuguuaaaggacuuguauuuaggauauauaaaggaugcuuacaacuuaauacgaagacgauagcccaaauuuaagauagggaaaugcuuugacuagacauucuaccaaaagagauauauaauggcuaaaaagcacaugaaaagaugcucaacaucauuaaucagaguggcuagaaugaaaaaggcuaacaauaccaagagcuggugaggaugugaaaaaacuggaacucucaauuguugcugguggaaauucagacugguacagccaguguggaaugugauuuggcaguuuauuaaaaagcuaaaaaccuaaacuuacauagcccagcaauugcacccccaggagucuacccaauggaaaugaaaacaguccguccccacagagacauggacauaaauguucauagcagcauuauucagaauagccccaaauugaaaacaauccagauguccaucaacugguaaauggauaagcaaaccauauaauggaaaaccauucagcuuccaauaacuuccaagaaacuguagacacaugcaguaucaugguuaaaccucaaaaacauuauauuaaguaaaauaggcgaggcauguauuguaugagucauaugaaaugucuagaaaaggcaaauuuauugagauagaaagcagaucacugguugcuuaaggccuaggguaggaguggggauuaacuguaaacggguacaagguaccugacuggggcaauggacauguggauugugaugauaguuaaauuguacagcucucucuauauauaguuguacagcucuauuaauuuuccacaaucauugaaucaugucuuccaguuuuaugagguaaaucauaguccaaugaagcuuuuuuaaaaauaagaugauaggccaugugugguggcucacgucuguaaucccagcacuuugggaggccaagguggguggaucaugaggucaggaguucgagaccagccugaccaacauggugaaacccugucuccaucaaaaauaaaaaaauuagccaggcaugguggcaugcgccuguaaucccaccuacucaggaggcugagacaggaaagucgcuugaaccugggcggcagagucugcagugagccgagaucaugcugcuguacuccagccugggccacagagcaaaacuccaucucaaaaaaaaaaaaaauauuaauuaauaugauaaaaugaugccuaucucagaauucuuguaaggauuucuuaguacaagugcuggguauaaacuauauauucaauagaugacgauuauuacuuauuauuguuauugauaaauaacagcagcaucuacaguuaagacuccagagucagucacauagaaucuggaacuccuauuguagaaaaccaaaaaagaaagaaaacacagcugaagccuaauuuuguauaucauuuacugacuucucucauucauugugggguugaguagggcagugauauuuuugaauugugaaaucauagcaaagagugaccaacuuuuuaauauuuguaaccuuuccuuuuuagggggaguaaaacuuggauugggagauuucauuuucuacaguguucugguugguaaagccucagcaacagccaguggagacuggaacacaaccauagccuguuucguagccauauuaauuguaaguauacacuaauaagaaugugucagagcucuuaaugucaaaacuuugauuacacagucccuuuaaggcaguucuguuuuaaccccagguggguuaaauauuccagcuaucugaggagcuuuuugauaauuggaccucaccuuaguaguucucuacccuggccacacauuagaaucacuugggagcuuuuaaaacuguaagcucugcccugagauauucuuacucaauuuaauuguguaguuuuuaaaauuccccaggaaauucugguauuucuguuuaggaaccgcugccucaagccuagcagcacagauauguaggaaauuagcucuguaagguuggucuuacagggauaaacagauccuuccuuagucccuggacuuaaucacugagaguuugguggugguuuugcauuuaaugacacaaccuguagcaugcaguguuacuuaagacagcaagcaucuagugagaggagcuggugccaugcaugaccccacauagaucuugcugauagugcuacagcaugaacccugaagcuuucaaaacuaugauuuuuuuuuuuuuuuuuuuugagacggagucucugucacccaggcuggaguggugcaaucucggcucauugcaaccucugccucccagauuuaagugauucucugccucagccucccgaguagcugggauuacaggugccugccaccacgcccggcuaauuuuuguauuuuuaguagaaacaggguuucaccauguuggccaggcuccucuugaacuccugaccucaagugaugugccugccucggccucccaaagugcugggauuacaggcgugagccaccgcaccuggcuuuuuuuuuuuuuuuuuuuuuuggagacagagucuugcucugucgcccaaacuagagugcagugacauuagcucacugcaacuucugccuccuagguucaagcgauccuccugucucagccucccaaguagcuggaauuacaugugugcaccaccaugccuggcuaauuuuuguauuuuuaguggagaugagguuuugccacauugcccaggcuggucucaaacuucugaccucaacugaucugccugccucagccgcauaaagugcugggauuacaggcaugagccacugugcccaaccugaaaacuaugauuuaaguaaacaacccauaaaauauuucuugcuauuuuuacuaaagauguguuaucuuggccgggugaagacuuucuaguguuuccguaacuaggguaaaaaaugaacucuauuauauggcuuguacauguguuuacaagaaagcaguguacuccucauaaauaaacuuuuaguuuauuuuauuuuuuaaacacugcagccucaucaugcuucacggaggagccugugcgggaagaaugcucccacacagcauaaagaaugcucccgcacagcauagagaaugcccccgcacagcauagagaagcccccgcacagcauagagaaugcccccgcacagcauagagaagcccccgcacagcauagagaaugcucuucaccucuggguuuuuaaccagccaaacuaaaaucacagaggccaacacaucauuuaagauagaaauuucuguaucuuuuaauuuuuuucaaaguaguuuuacuuauuuucagauucuauuucuuuacuagaauuaagggauaaaauaacaaugugugcauaaugaacccuaugaaacaaacaaaagcuagguuuuuuucauagcucuucuuccagauugaaugaacgucuguucuaaaauuuaaccccaaaaggaaaauauucaguuaacuauguuaaaaaccaagacuugugauugaguuuugccugaaaaugcuuucauaauuaugugugaaugugugucuuucccaucuucuccacaggguuugugccuuacauuauuacuccuugccauuuucaagaaagcauugccagcucuuccaaucuccaucaccuuugggcuuguuuucuacuuugccacagauuaucuuguacagccuuuuauggaccaauuagcauuccaucaauuuuauaucuagcauauuugcgguuagaaucccauggauguuucuucuuugacuauaacaaaaucuggggaggacaaaggugauuuuccuguguccacaucuaacaaagucaagauucccggcuggacuuuugcagcuuccuuccaagucuuccugaccaccuugcacuauuggacuuuggaaggaggugccuauagaaaacgauuuugaacauacuucaucgcaguggacugugucccucggugcagaaacuaccagauuugagggacgaggucaaggagauaugauaggcccggaaguugcugugccccaucagcagcuugacgcguggucacaggacgauuucacugacacugcgaacucucaggacuaccguuaccaagagguuaggugaagugguuuaaaccaaacggaacucuucaucuuaaacuacacguugaaaaucaacccaauaauucuguauuaacugaauucugaacuuuucaggagguacugugaggaagagcaggcaccagcagcagaauggggaauggagaggugggcagggguuccagcuucccuuugauuuuuugcugcagacucauccuuuuuaaaugagacuuguuuuccccucucuuugagucaagucaaauauguagauugccuuuggcaauucuucuucucaagcacugacacucauuaccgucugugauugccauuucuucccaaggccagucugaaccugagguugcuuuauccuaaaaguuuuaaccucagguuccaaauucaguaaauuuuggaaacaguacagcuauuucucaucaauucucuaucauguugaagucaaauuuggauuuuccaccaaauucugaauuuguagacauacuuguacgcucacuugccccagaugccuccucuguccucauucuucucucccacacaagcagucuuuuucuacagccaguaaggcagcucugucgugguagcagauggucccauuauucuagggucuuacucuuuguaugaugaaaagaauguguuaugaaucggugcugucagcccugcugucagaccuucuuccacagcaaaugagauguaugcccaaagacgguagaauuaaagaagaguaaaauggcuguugaagcacuuucuguccugguauuuuguuuuugcuuuugccacacaguagcucagaauuugaacaaauagccaaaagcuggugguugaugaauuaugaacuaguuguaucaacacaaagcaagaguuggggaaagccauauuuaacuuggugagcugugggagaaccugguggcagaaggagaaccaacugccaaggggaaagagaaggggccuccagcagcgaaggggauacagugagcuaaugaugucaaggaggaguuucagguuauucucgucagcuccacaaaugggugcuuuguggucucugcccgcguuaccuuuccucucaauguaccuuugugugaacugggcaguggaggugccugcugcaguuaccauggaguucaggcucugggcagcucagucaggcaaaacacacaaacagccaucagccugugugggcucagggcaccucuggacaaaggcuuguggggcauaaccuucuuuaccacagagagcccuuagcuaugcugaucagaccguaagcguuuaugagaaacuuaguuuccuccuguggcugaggaggggccagcuuuuucuucuuuugccugcuguuuucucucccaaucuaugauaugauaugaccugguuuggggcugucuuugguguuuagaauauuuguuuucugucccaggauauuucuuauaagaaccuaacuucaagaguagugugcgaguacugaucugaauuuaaauuaaaauuggcuuauauuaggcagucacagacaggaaaaauaagagcuaugcaaagaaagggggauuuaaaguaguagguucuaucaucucaauucauuuuuuuccaugaaaucccuucuuccaagauucauucccucucucagacaugugcuagcauggguauuaucauugagaaagcacagcuacagcaaagccaccugaauagcaauuugugauuggaagcauucuugagggaucccuaaucuagaguaauuuauuuguguaaggaucccaaauguguugcaccuuucaugauacauuucuucucugaagaggguacgugggguguguguauuuaaauccauccuauguauuacugauuguccuguguagaaagauggcaauuauucugucucuuucuccaaguuugagccacaucucagccacauuguuagacaguguacagagaaccuaucuuuccuuuuuuuuuuuuuaaaggacaggauuuugcuguguugcccaggcuagacuugaacuccugggcucaaguaauccaccucagccugaguagcugagacuacagcccaucuuauuucuuuaaaucauucaucucaggcagagaacuuuucccucaaacauucuuuuuagaauuaguucagucauuccuaaaacauccaaaugcuagucuuccaccaugaaaaauagauugucacuggaaagaacaguagcaauuuccauaaggaugugccuucacucacacgggacaggcggugguuauagagucgggcaaaaccagcaguagaguaugaccagccaagccaaucugcuuaauaaaaagauggaagacaguaaggaaggaaaguagccacuaagagucugagucugacugggcuacagaauaaaggguauuuauggacagaaugucauuacaugccuaugggaauaccaaucauauuuggaagauuugcagauuuuuuuucagagaggaaagacucaccuuccuguuuuugguucucaguagguucguguguguuccuagaaucacagcucugacuccaaaugacucaauuucucaauuagaaaaaguagaagcuuucuaagcaacuuggaagaaaacagucauaaguaagcaauuuguugauuuuacuacagaagcaacaacugaagaggcaguguuuuuacuuucagacuccgggauucccauucuguagucucucugcuuuuaaaaacccuccuuuugcaauagaugcccaaacagaugauguuuauuacuuguuauuuacguggccucagacaguguauguauucucgauauaacuuguagagugugaaauauaaguuuaacuaccaaauaaggucucccaggguuagaugacugcgggaagccuuugaucccaacccccaaggcuuuguauauuugaucauuugugaucuaacccuggaagaaaaagagcucagaaaccacuaugaaaaaauuuguucaguguuuucuguguucccguagguucuggagucugaggaugcaaagaugaauaagauaaauucucagaauguaguuauaaucucuuguuuucugguauaugccaucuuucuuuaacuucucuaaaauauuggguauuugucaaauaaccacuuuuaacaguuaccauuacugagggcuuauacauugguguuauaaaagugacuugauucagaaaucaauccauucaguaaaguacuccuucucuaaauuugcuguuaugucuauaaggaacaguuugaccugcccuucuccucaccuccucaccugccuuccaacauugaauuuggaaggagacgugaaaauuggacauuugguuuugcccuugggcuggaaacuaucauauaaucauaaguuugagccuagaagugauccuugugaucuucucaccucuuuaaauucccacaacacaagagauuaaaaacagagguuucagcucuucauagugcguugugaaauggcuggccagaguguaccaacaaagcugucaucgggcucacagcucagagacaucugcaugugaucaucugcauaguccucuccucuaacgggaaacaccucagauuugcauauaaaaaagcacccuggugcugaaaugaaccccuuucuugaacaucaaagcugucucccacagccuugggcagcagggugccucuuaguggaugugcuggguccacccugagcccugacaugugguggcagcauugccaguuggucugugugucuguguagcagggacgauuucccagaaagcaauuuuccuuuugaaauacguaauuguugagacuaggcaguuucaaagucagcugcauauaguagcaaguacaggacugucuuguuuuugguguccuuggaggugcuggggugaggguuucagugggaucauuuacucucacauguugucugccuucugcuucuguggacacugcuuuguacuuaauucagacagacugugaauacaccuuuuuuauaaauaccuuucaaauucuugguaagauauaauuuugauagcugauugcagauuuucuguauuugucagauuaauaaagacugcaugaaucca

SEQ ID NO: 192373 - RNA, 17423 nt, Homo sapiens
uugucugggaaauuuuaaguuuacuuaaaaugaaccucaugcucacauaaacacacaggcacauucuaaacagauaacgggagagaauuguuuuaaauucuuaauuuguuaaugacaugcauaaucacauaguacauagacuguguucauggcaauuacuuguauucuuagaaugccaguuuuugcuucaugcagccauuuauauuagagcagugguucucagccaggcacauuuuugcccccuggggauaugcaauaucuggagacauuuuugguugucacagcuggggagagggguacuacuggcaucuagcagguaguggccagggaugcuacuaaacauucuacaauguacaggacaguucccuuccccaacccucaacaaagaauuagguggcccaaaauauuaauagcacugaggauaagaaauccuguacuagaaguuguaaguuuuucaucccccaugggcuagaucugauaugcagauguauuuuauuuugcccauacaauauuucuaaguaauuuuuaaauuaguugauagcauacaaauuucuggcuugaugaaaauguaguugauguaguaacucugagccuauauuccagcaggauuugauacuuuccagugucuacuaucuccuacugucuacacccacuccauggacgcauuuauguuucugcacuagccccuuauaggcauuugggccugugcucucuuuucuguaccuaauucucuaagugugaggcacaaagcaggaacccuuaacuuuaggcuaccaucccuccaccugagccuccccacuuugauuuccuugaacuauucucuguuaucugcugcucuuuuuuuuucucagacagaguuuugcucugcugcccaggcuggagugcuguggagugaucucagcucauuacaaccucugccucuuggguucaagugauucuccugccucagcuucccaaguagcuaggauuacaggcacgugucaucacgcccagcuaauuuuuguauuuuuaguagagguggaguuuugccguguuggcuggacuggucucaaacuccugaccucagaugaucugccugccucagccucccaaaguguugggauuacaggcgugagccacugcgccuggccuguuaaucugcuacucuucauuuguccauccucuaacaguagccaugacucaaaacccaaguuuucccugccuugacucaaacccaaguuagcugcuuaauauuuuucaaaagcaguaauuuuaaguguagugauuaagcaagugauacgagauuuucuggugacugaugagacagcuccuccaguacuuuccuggggcuugcaggcuguucuagagauccuucuaaacccugcucuggaucucugaugcugaguuuuguaguuucuuggaaccugcagaauaaauuaaaacaugaaaaacaaaaaaaauuuuuuuuucagacagggucucacucucacccaggcuggagugcaguggcaugaucucagcucacugcagccuggacagcccagcugaagcaacccucccaccucaagcaauccucccaccuuagcuucccaaguagcugggauuauaggcacgugccacugcacccagcuaauuuuuuuuuuuuuuuuaacuuuuuguagagacaggguuuugccauguugcccaggcuggucucaaacuccugggcucaagcgauccacccacgucagccucucaaagugcugggauuacaggcgugagccaccgugcccagucugaaaaaagaaagucuuaaagcacuguguaagguuuaagaacggucucucccagcacuuugggaggccauggcaggugaaucacgaggucaagagaucaagaccauccuggccaacauggugaaaccccaucucuacuaaaaauacaaaaaauagcugggcgugguaguggacaccuguagucccaccuacucaggaggcugaagcaggagaaucgcuugaacccgggaagcggagacugcagugagcagagacugcagugagccaagacugcgccacugcacuccaaccuggcgacggagcaagacuccgucucaaaaaaaaaagucucaacauuauuacuauuuuauaugggauguaaaggaaaauuucuagggguauaaaacugagauaggaauuaggguaggggcugcuaggauuuaagauacaaaacaauugagaauaauggagagaagauacuauuuucucccuuugacucaauaucaaaauggguuauggagggccgggcgcggucacucacgccuguaaucccagcacuuugggaggcugaggaggguagaucacgaggugaggagaucgagaccauccuggcuaacauggugaaaccccgucucuacuaaaaauacacaaaaauuagccaggcgugauggcgggagccuguaaucccagcuacucgggaggcugaggcaggagaauggcgugaacccaggaggcggagcuugcagugagccagaaaucgcgccacugcacuccagccugggcaacagagugagacucugucucaaaaaaaaaauacaaaaaauaaaaaaaaaaagguuauggagaaggugauacuaaugagcuaccuuuaaggaaugcuagaaaaacaguuuuauaguuuuauaagaagucaaaauauacaugauuuuucuucaaaaauaaaguagaaauaguuucagcucaugaaauuggaacuggaauuggaaaaugaucuguuucaaaauggaagaaaacgaaacauaauuugucagauuuuauucacaacugcaucacucucuaaauucaaauguguuacuuggagaucucuggauuacuuauuaauguuacauaaauacaggauuaugaucucaaaauaccaguggcuauucuaaaguuuccucccagugguauuacuggguaugacaauuuagagagcugcagaaugacagcaacauuucagguuaccugggaaaauccuugauuuuggucucuuucucuugaacagcccgggugccuugacccuuguuucucacaaagucuuccuccagcccagccugcuucagggugucuagauaccacuguucugcuucuuucuuggcuagauccugugggauggaaauuaaucuguuguagcugucuuaugaauuaccagacaauucuaaauuacuuaaucaguauuguuacaauacugccacaaccaccaccacccuuauuguggggcauagauuugcaagaaaauuauuuaacccuuguuuuccagccuuaauguguauauaaaucaccugaggucuuguuaaaaugcagauuucacauuugguaggugucagaugaggacuguaauucuguauuucuaacacuccccagagaugccaaacuguugauuugggagucacaauuuugaaaagcaaugacuuagacuuuugggagacaaaugagacccagauuuaaaaggauggacuaaaaaccuaagauuuuaaagcaacaaaccauuaucaggaacacuaaaauaaaauagaaaauaagcuacaccaagacucuuaguggaaggacagauggucugcauguggaccagcagaauauuauuuuuuguuuaaguauucaagaacaaaaucauagaguacuuuguauuuuuccuagagaggugaaagaucuguugagaucugaagagugagcuugcuuaacauuaacauaaagaagcaugagauuuugaacaaugcagguugcuaaguaaauccaagaccaugugugcuuaugugugugagaggagaaagauuuauggagggaggaggaaguggagccagcaaaugccuagacaauguacuaacuauaagauggagcuaaugcccugccauuggaacuaggucacuauggaaccccaacuugucugaaacuggagaggaaagagauccacagagccuaaugcaguagaaacagagcauccuuacauccuuacggagaucucagcugaguccaacaucccuaaaagucuacagagaauaucuuaaaaugauacucuuccaggauacuucggguacacugccuauggguuagcccugcuccauaaggaacacacacucacacacacauacacaugcauacaaaauaaaagaagaaaaaaaaauuucaggcuuccagccugaaagccacuuagucuagagaaagccuugcaggguguuugugggcauccuaaugcuuggagaccuauaaauauaccacagcucuagaggcuggggaggcccagggccagcagcacugccagaggagagauaccuuuccagcacugugaacaguggcuccagagcauagaaagagccaaauggucccugugucucuggggucuaaugcccagucugaugaaaucugaaugguagacuacagugaaagcucuaggaagugaaauaucccuuuaucgaugccuuuggaguccacucuuggaugaaaucaacacaagcagcauucucuauuguacuauuuauuuugggaaaagaagguaguagugaaauuagaauuucugggccucaaggaaaauuuuaauacccacauauuaaaauuguuuuguaauuuuucagaguccuuuuaucuaaggcagaaagaaaacaaaugaugguuuaguuuuaccuuggcaacuuguucaaagagauagggccuuguuuguauucgcugcuucauuuccuccaguucuuucuuauauucuuucgcucuuuuacggucauuguuccuggaauuagcaagacuuuuagaaagaauuucaucuuuucuaauccagaauacccuucauuuccaguaaagcaguguaacucucguguacacuguaaauuccuaucugacuuggaaaaucaugacccugcugugauuacaggagccuaccuaccucgauaacucuauuuugcauuuucuggcaauaggccaguggucuguuggaucccaaggcaagcaccccuuuugacacauagaggacacugaccgguucucuuucagcuuugcuuugaacacuuccuccaggcuuuuauggggauccauggcuuuugcacgcaaggucacagauuuggacauugcuugagacuucuuuuuguguaucuccagccacugaauacucucaucugcuuuguucuuuuuuucaagugcacuucuaaaggaaggaggcagaaaaagaguauagauuaccaaccuggguauacugaaaagcaaucuuaggccaggugugguggcucacacuuguaguccuagcacuuugggaggccaaggcagguggaucaccugaggucaggaguccaagaccagccuggccaauacggugaaaccccagcucuacuaaaaauacaaaaauuagcugggcaugguggugugcaccuguaaucccaacuacucgggaggcugaggcaagagaaucgcuugaacccgggaggcagagguugcaauaagccaagaucgcacugcugcacuccagccugggcgacagaucaaauuccgucucaaaaauaauaauaauaauaaaauaaaauaaaauagccgggcaugguggcucaugccuguaaucccagcacuuugggaggccgaggcgggcggaucacaaggucaggagaucgagacuauccuggcuaacacugugaaaccccaucucuacuaaaaauacaaaaaauuagccgggugcgguggugggcgccuguagucccagcuacucgggaggcugaggcaggagaauggcaugaaccugggaggcggagcuugcagugagccgagaucgugccacugcacuccagccugggcgacagugagagacuccgucucaaaaaauaauaauaaauaaauaaauaaaauaaagcaaucuuaguaaccuuuucuggaaaguaaguugguguuuuuaaugaauggggcauguaauuuaccucaacugccauuuuuaaaaauaauaaaauucuaggauuaaaugcacuggcagaugaagccuuuccagcacuagggacacagugaguuccuacccuagaagugcauuuacugaacuggagaaacgucaguuaaaauauccuuacuuaggucgggcacgguggcucauggcuguaaucucagcacuuugggaggcugaggcgggcugaucacaaggucaggaguucgagaccagccuggucaacauggugaaacccugucucuaccaaaacuacaaaaaaaauuagcuggguguaguggcacgugccgguaaucccagcuacuugggaggcugaggcaggagaaucacuaaacccgggaggcagagguugcagugagcugagauugcgccauugcacuccagcaugggcgacagagcaagacucugucucgaaaaaaaauauauauauccuuacuuaaacaguccaacauucaauaggucuucgccuaucuggauacaaaauaauacuaauagcuaccauuuacugagcuccuuauuaugaaccaaguaccauuacauuucacauuguccucauaacugccuuaugagguaaauacuaaauucccuuuuuauaggggaggugauugaggcucaaaggagguaagccccuugcucaaagcuacccagcaugccaguggaaaagccccuauuggaccaggaccucugacuccgaagccucuggccuugaccacucugcuggaaacagugggcuggaaggugucuggguucaugguccuuugggaauacaaaucugcacauucagagagaacuggaaaugagccucccucagugcagacuauuuggguucaacuuguagcacuuaguuuguucaguuaucuacaaaguaauauguugaguucuuccaaaaggaaaaucaaccaagacucuuauauuuggauguuuauauucaaauggacauacugggaagaaggacaugaaaauuuaaucuguuaauaugucagauucccuguggcuggaaagcagauguggauguccucuauaggaaggccagccucuuuguucaggaggccuguguucuugggcccucaggauacugagcaauuaauuagcccugauuuaguaggucuaacugaagucugaagaagaaaggaguaucccuuggaccguaaauacucuucuacaaucccugcuguggggcuuaacgauccaaguagguucugaguacuccccuacaugccccaugggaaggcaguaagacauuaguccucucccuggccuaagcugcuguuacaccaugaccucucuugccuacuucagcucagaagccugguggaagaacccuugcugggggcuggcuuaaugagaacaucauaacagaaucaggucaguugaagaguuaaaaauaagcaggcucuugcugcccaacagacucugacaucuucccaagaugaaucucagagaaucucaaaucuaugcaauggaugucucauauuugcggcaacuucagccaccugcuagcaugcuucucugaauucuuguuccucacuacucccuuccucucacccaugggcuuuuauccauguucucucugucuggaaccuuccuucucuccaggcuuugucuggcgaacucuuccuuguucuucaguuucacuuuagacaucuauuccacaagacaagaccccccugcuccaggcugcccagugcccucacaguccccuuuaccccccaucauugcacuacucaaaaaauauggccauugcuucuuugcuuuucuguauuucagacuagauaauaaacuggagguucccuaagaucuccagccuuaacacugugccuggcacagaauaagcccacuaugaauaugugcugaaugauggcuagcuguucuccaagcaccagguguggagaaccgcaauuguuccaguccugaucagaaaauucccuuugaccccuugagguaucucugauaacaggaaaggaggccccuuggcagggagguuuccagcauuuggggccagaaucagagcaugggucucgugcagccugaccacucaccugacugcagauucccucuuccugguggcaucugugaugugcacagggagaguguuggcagagagggaagcaaggccgcucagagaacgacuccuuggcagggguguagcugguggcuguggggaauccuagaagaaacaaagguugguauuggugggacagcaugugugauuaguuucuaucuuuuuuuuuuuuuuuuuuuuuugagacagagucucgucucgcucuuuugcccaggcuggagugcaguggcgcaaucucggcucacugcaaccuccagcugccugguucaagcaauucuccugccucagccucccacguagcugggacuauacagguugugagccaccaugcccagcuacauuuuugcaguuuuaguacagacgggguuucaccauguuggucaggcuggucucgaauuccugaucucaggugauccacccgugucggccucccaaagugcugggauuacaggugugaacuaccgcgcccagccauuuucuaucuuuacuaggauucagcuucacugaaggacugaaaaugagaaucuucauuuuuuuuccugggaauaaggcaaggauaaagagaucucaaguuucacaaccaagccaagacuuggauaucaauccuaaaguuuuuagucaaaugagaagaguuccuuggaauugguauagagacaucaacaacugaucccaacuccuugccucucaagccugcuuggacuuauuucugugaaauccuucuacaguaagggaggaaaagaagugucccuaugguuucuguuguguucuguuuuugagaugaacuuucacucuuguuguccaggcuggccugcgguggcacaaucucagcucacugcaaucuccgccucccagguucaagcaauucuccuaccucagccucugaaguagcugggauuacaggugcccgccaccgcacccagcuaauuuuuguauuuuuaguagagaugggguuuugccauguuggccgugcuggucucgaacuccugaccucagaugaucugcccuccucggccucucaaagugcugggauuaaaggcgugagccaccacgccuggccuguuuuuuguuguuguuuuuagauggggucucacucuguugccuaggcuggaguacaguggcaucaucuuggcucacugcagccagaagguccucccaccucagccuccugaauggcuggaacuacagguacacaccaccacauguggcaaauauuuguauuuuucuuuuagagauggggucucuguugcccaggcugggcuguggucuggaguuuauaggaaagugaaucugcuuacaacugagcugguguuuaaaaaaaagauaggaaaaccuuguugagaagugcuuuccaggaagaccuggccccacccuguauuucaggccgcagcccugacccucccacagcugccugggcucucaccugccuccuuccggugguggcagcaucacagggccgcugaggguggcgcagguuggcgguccucagcaagaagggcuuguugcgaguggccucuuggguuucucuucuuuuggcugcucuucucuggaaggccuuguaaaggcccucauagucagggaccacaggauucacccgaggcuggaaucugaaguuagugugcagaaacccaagcuuuuccugcuggguucggguggcugugcggggcuguggguuagcccgguuacuagaggaggcgauaggggaagaggccaucuggagcauguccagggcucucauuuggaugcgaauuuuccugaagagcucagcuucuguggagaaaggauggugauggguaagaaaggaccaagcaagaaaccuacaggguuggagaacuuucccucuuuuacacacuagcuguaaguguuacuggaggcaaguaggaacuuuucaggaauucugacacguuaacauccugugagaugccugcagauggccugaauaggaguaauuaugccacagaaaauaacaaacauuacaaaccagcuuccuuuuuuuuuuuucuggagagcuuguuaauaaaugucauccagaacaccacugccugugucaaucaggcugcagaagcagugaccaucuacacuuacugagcacuuucuaugauugcuucuucagagaugaagcagaggaagugggccaguaaccugcuccucucccagguuuccccaucugagagaaaggcccuaccauccacccagcugcccaggcccuuugcccacaucacugacuccuccgugucucucaucagucacaaguucugucauuuccuccucuuuaaccucucuccaguccauccucguuuuuucaucccugcaaccaguugcacaauuucucuacugaauugugaaauagcuuccucuuggcucaacaucccuccagucuugcugcccucucagauuaucuauacagcaaucagaaggauccuucugaacuauauuucugaucaugggccacccugccucacucccucaguggcuucccugugcccuugggaugaaguccagacucgccaacguggcuugcaaagcuccucaugucuggcccaugccugccucuuccuucccacucccucuucucucagcccucgaccuuuccaucccuugcagaugcucugcuuucucuccccuccaugccacauucugccugcuccacuucuccucccucuucgccccuccuucaguucagccccagggcccacuuucucaggggaccuucccuaacugcucccuugcuucaccaauccccggguuaggucccuuugauauaugcucccaugcuuccccuuuuaauccuuguaaauaacucgccacauuuguauguauuugucuuuaucuguuuuccucacauaucuacaaacuccaugucuguguguucaccauggcacagugccuggagcauggcacaugcuaccgaaaagugaauaaagccugagccccuuauuuggagcuauacuuuuggaaauguguaaauaaucaucccccagguaauuucggcgauugacacuaccucaccaggacgaaggagccaugggggagcaucucagggcagugugcuggugguggcaugagcccaagcugguccucaggugucucacugguucucuauuccugcaccugugcuggugcagaggcccucaugugcauucacuuagaugucaacaggacgagccuuggggacacugugggaccucucacuccuggcaccauacagguccugauuguauagacagaccuaacccuccccaauggccugcacuaagcgugcagccucuaguggguccacccaagcagcaaaucuccaagccaggcagaucccugggcccugacuaaaucccuauggugggauugguuccccgaggcaggaggcagcaagguggcaaggaugucuuuacccuggaguuuauccccaagggcuggcuccagaauggacuugggaauccuucugguggccuucugcuuggagaucuuggcuucagcuguggcugccaagucucucugucgagcagcuuccuuuagcugcuccuccuucuccaggaagcugaagggcuucaaagaagagaggagcaguuccuuccucuucuggaucccugccugccuucgggccucgcugcgcuccaugaucucuugguagaggggcagguagacaugugcaggcacaggcugugcccggaacugccuguggcacucggccucuuccucacccugccucugggcccgcugccucuccugcucaaaggaggcaggugagcccagccacucggccuucuuccgggccucgcgcagcgucaugcggaauggccgagggacaguaauggaugaugcccaggagcugacgcuucugugcugggagggaggccgggagccugaggguggcugggucugaggccugggaauguuggagggaagguuguucagggagcugcagcgccuuguggagccacaccugggaaaaaagcagaucugugaguggaggacagggcagucaggaggcccugcucccuccagaccuccuccccaguccucccuucccacuggucacagcuggcugcucagccuaacaccacagccccacaggccucuauguccaugaccuucccacagacaauccuggcagcccuaauggaaagucucuucucagaauugauccaagaacugccacuuugcacucuaauauuucauaugagagagagaacaaugagcagaguagagcuuuagagucagacagaccuggguuuaaaucuugcuucaaacuuugagcaaaguucuguuaaaaccucaauuuccuccuauguagaguggcaaaaauuaaugucuacuuaccagguuauuggaggagaaaguaaauauuaaauaagauaaaguaaugagauaauguacacuuuaucucauucaauauuuacuuucuaaggcuugaccaagauaaagguacuuuguugucauucucagggaaaguguauuuaggaaaugcuucccuguauuuuuuuuuauuuuuuauuauuuauuuacuuauuuuuugagauggagucuuguacuguugcccaagcugggcgugaucuuggcucacugcaaccuccaccucccagauucaagcaauucucugccucuccuuccgaguagcugggauuacaggcaccugccaccaugcccggcuaauuuuuuuauauuuuuaguagagacgggguuucaccaucuuggccaggcuggucuugaacuccugaccucaugauccagccaccucggcuucccaaagugcuggaauuagaggcguaaacacggugcccggcccauuuuuaaauuuuauuuuauuuuuauuuguugagacagagucuugcucuguugcucaggcuggagugcaguggcgugaucucagcucacugcaaccaccaccuccugggcucaagggauucucaugcgucagccuccugaguagcugggauuacgggcacacgccaccaugacuggcuaauuuuuguauuuuuaguagagaugggguuucaccauguuggccaggcuggucucgaauuccugaccucaagugauccgccugccucagccucccaaagugcuggaauuacaggugugagccccugcaccugaggaaaggcugcccuuuaauuaauuccagugcaucacuggacuaaguguugcccaaaguaauucaggauuccuggggaggaaucagaacaccuguuuggaaccaaaagcugauucucagcuagagccucaguaaauggcaacuugcagaagugcucuuugcuuuacagaggaagaugaagcccagagacacgaugugaccuguguggagguguggagugaggcagccguggagcugcagugccuuaccucagagccugcgggcacuggaccugcaccaucccccuguccuugucuuggaagaaacucuccagguccuccucaucuucagagagguuuucaucacucucugggucagacugaaagagagacuccaacagacaccaucucccuuucugcuucaguuccuguaaguucugguaaaugcucccaguugagucagaaguagaaucuaucuccuccucugggcugaggaacucgucaaguuugcuggcccugggcaaaaccagcccauccccggacagcuccucuccugccucugugucugcgaaggacucggggggaaauaucuaaaauagaauagaaauaggcugugggucaaacaauaauuucaaagguauucaaaucauaacuuaauuucgcuuugaauaagcuucuguauauuagggacuggggagaauuuggggucugccagaugcacuggcucacaccuguaaucccaacacuuugggaggaauuuuuaaaaauaagguguguuucuuggucuaaagaaauuucacaacuuggucuaugaagugcgcuugguugaagggauggagagggaagugaagagcugaaguugguucccuaugccauacagugcaguaagcuuuuacagaguaccucaccuacaccaggcuuucugaccccugcacuccaggaauccugcccaugaugauggccacacucucccuuacuuggguuuuaaccuacuucuugcucaucuuccuucucucccuucccuuauuucuacuccucugcuuuccucauguucuagcuaauuugcacucugucaaggaauggaugauggcugggugcaguggcucaugccuguaaucccagcauuuugggaggccgagggagguggaucaccugaggucaggaguucaagaccagcuugaccaacauggugaaaucccgucucuacaaaaauacaaaaauuaguugggcgugguggcgggugccuguaaucucagcuacuggggaggcugaggcaggagaaucgcuugaacccgggaggcggagguggcagugagaugagauugcgccacugcacuccagccugggcaacaagagugaugcuccgucucaaaaaaaaaaaaaaaaaaaggaauggaugauuaacaagacagacaguauggucuggcuggaagagcaaugucuuaagaagugggacacacaauuaacuuuuucaguacuccauucauucauaaaauauuuacugggugccugaugugcacugggcauuuggcugagaacaagacaaacaagguccuuacucucaugaagcuuacacuguaguaagaggagacagacaauauaagaugaugauaaauucugugaaaaccauaaacaacugugagguuauaaaaagauggagugccuauggaaagcuuuuugguugauaaaguccaucagauuaagguuauuaggaauguacuuguaaucaguacaucaguuaggcuuauuaacuugcugcaggacacuacggaaaaccacagggaacuuaggguugagggugugauuuuuauaggguuggcuucccugauugauucagggaaccagguaucaacucuggaauggugcugucaugaaguggggacaauuuaguuaagcgaaugacugagcaauuuuuuuuuuuugagacagguucuugcucugucacccagguucuggagugcaguggugcaaucaugccucacugcagccugaaccuccugagcucaggugaugauccucccaccucagccucccgaguagcugggacuacagcacacaccaucacaccuggcuaguuuuuguauuuuuuguacagaugggguuucaccaugcuucccaggcuggucuccaacuccugagcucaaaugauccgccugccuuggccucccaaagugcugggauuacaggcgugagccauugggccccgcccaacggcaauacuuauucaaaaggugagaagaauaaaguaggguggguaaguaauugaucaguaagccuuuuggaagaagggguguuaguaauuuugcaccuauguuauggcccugagagaaacacuguuuccugaugcucuugccguuggcauuaucuaugccuaugacagucugaguuauacuuucucaguccugggcugauuuuuauuuuucauuguggaggaauuuugaauugacacuugauugaugaggagccaggcuuacuaaaauccaggguaagagucagagauauguaugcacccuagcccuggcucugcuacagugugugaucuugggcacguuuuuucuuuucuuuuaaagacaacuuuauuaagacauaauuucuauacaauauauucacucauuuaaaguguacaauucagugguuuuaguauauacacagaguugugcaacuaccaucacaauuuuagaacaccuucaucgcccuuaaaagaaaugccacacgcuuuaguggucacucccuauuuccccuaacccuccacaccccaccccaccagcccuaagcaacugccaaucuacuuuuugccuuuaauaguuugggguccaccaggugcacuggcucacgccuguaaucccagcacuuugggaggccuuggcugguggaucacuggaggcacgcgccaccacaccuggcuaauuuuuuuuuuuuuuugagacggagucucgcucugucgccaggcuagagugcaguggugcaaucuuggcucacugcaaccuccaccucccggguucaagugauucuccugccucagccucccgaguagcuaggacuacaggcgcgcaccaccaugcccagauaauuuuuuguauuuuuuuguuuguuuguuuuuguuuuugagagaguuuugcucuuguugcccaggcuggagugcaauggcacaaucucggcucacugcaaccuccaccucccagguucaagcaauucucuugccucagccucccgaguagcugggauuacaggcaugugccaccacguccagcuaauuuuguauuuuuuuuaguagagacaggguuucuccauguuggucaggcuggucuugaacuccugaccucaggucccaaagugcugcauuacaggaguaagccaccgcacccggccaauuuuuguauuuuuaguagagacgggguuuugccauggaaaccagccuggucucgaucucuugaccucaugauccgcuuuccuuggccucccaaagugcugggauuacaggcgugagccagcgcgccuggccaauuuuuuuuuuuuuuuuaaauuuuuagacggaguuucaccauguuggccaggcuggucucgaacuccugaccucaggugauccacccgccucggccucccaaagugcuaggauuacaggcgugaaccaccacgcccggccaaauuuggggagcaauuuucuuaaucucuuugugccucaguuuucucuucuacaaaaaugagacgacaauuguacuacuggucauagaguacuaagaggauaagcgaaaacugagugacauugccuaucaagagccucguauaaaguccgagagguucaggucuguaagucagaguccgccuccuggucccuaaacgcucauuuuaaucccacgccccuccgugacacgccccugcugucugucuccaaggcaacgcccaacaguuuccucuccgggauuccuuucccgggggcagucucuuuucucuccucaccugacggcuccccuccgcgccuccgggggcucccucaggccuccccacggucauuucagcuggacagaggcagcagcgacagugacagcgauaguggcagcagcgguggcagcgagagcuaugcggggccaggguccaccccuuucuagcuuuggcgucugguuggcuuccagggcagccuccgauccaucccgcccgaggaggcaagguucguuuuccgauuggccuauuuucuccgcgcauuuuauuuccgguucugaggacgccgcggaagcgggacgggauuggagugcucugcuccggacgcacuacguaggugggccugcgggaguucugagugcgacggcgcaggucugcaccauggcggcccggcuugucagccgaugcggggcugugcgugcagcuccccacagcggcccgcugguguccuggcgcagguggu

SEQ ID NO: 192374 - RNA, 52846 nt, Homo sapiens
cgccgcggcgcgcgggguggggcggaggucgcgccgagggcggcgggcugccgcgcaaggguggcgcgcgcgcggugagugugcgagugucggcggcgccggauccucuacguggggcccgggcucugcgggcgggaggcgggagcuggcagccccaggcgguagcgcuucguccugcggccugggugugucaggagucgcugcggucggggcgcccuugccucaggagacuuagauccccgcugauccgcccgucccgccgcaguggucugagccgcagcccuuucccgugccgcccgcgggucccguuccucccgugucuccaugccgcagccagcguggccgcggcuaccuugcccucgcccccgcuccgcuucugccgcucccggcacugccuuacuccuuuggguugcaucucuuuccuggcuuuucacccuugcugauucuguaagggauagugcagccagcggacgucccaggccaaauguuuuuugauaggcagucgaggacuuucccgagggcggugguugagggcgaggcugccagccuccgaagagcagcggcacgccagggagccgggcggggaggggagugcugccaccgaggucgggagcaggguccucggccucacuagguccuguguggccgauacuuccugcccacgaccgccccccggauuuccauuugcuaauaccgguccgcagccuucuuuccugaaaguugcauaaaguuggaagcucuucaacuugccuccccgacuccugaaaucccgaauacaccucugaaaaggaguguacucacaaguauucucauuuuucaaugagagucagucagugagucauuaaggaagguacgguauucugagugccaagccaauaguuaggagacuugugguugaagcucugcucuguuauacuccauuucaaauuaaaaaguuuauuuuaaaugugguuguagauccuucgucaccauuucucuagggaggacuuaauccguacacuccuucccgaugucuuugaccucuaauuacuccccuccgccuuguuucccacuugcauaguuucuguuucugaauuucuguuucuucugagggaacaugccgauuugguaaugauaagccuuguaaacuuuuuuuuuuuuuuuucugagagagagucuucugucacccaggcuggagugcaguggggcaucucggcucccugcaaccuccaccuccuugguucaagcgauucuccugccucagccuccccaguaagugggacuacaggugcaugccaccacacccggcuaauuuuuguauuuuugguagagauggaguuucaccaugcuggccaggcuggucucgaacuccuggccucaggugauccaccugccucggccucccaaaguguugagauuacaggcgugggccaccgccccggcuguaaaccuuuuuuuugagacaagaguuuugcucuuguugccuaggcuggagugcaauggcgcaaucucggcucaccacaaccucugccucccggguucaagcaauucuccugccucagccuccccaguaacagacuauaggugcgugccaccaugccaggcuaauuuuuguauuuuugguagagacagaguuucaccaugcuagccaggcuggucuugaacuccuggccucaggugauccacccgccuuggucucccaaaguguugagauuuacaggcaugagccaccgcccccggcuguaaaauuuuuuuuuuuuuuuuuugagacagaguuuugcucuuguugcccaggcuggagugcaauggcacgaucucggcucaccgcaaccuccaccucccaguucaagcgauucuccugccucagccucccgaguagcugggauuacaggcacacaccaccaucccuggcuaauuuuguauuuuuaguagagacaggguuucuccauguuggucaggcuggcguaaaccuuauuauacauaccaucugccagcaugaucauggcuuuuucuuuucuuuuuuuuugagauggaguuucgcucuuguuucccaggcuggagugcaauagcacgaucucggcccaccgcagccuccaccucccagguucaagcaauucuccugccucagccucccgaguagcugggaauccaggcaugcgccaccaugcccggcuacuuuuguaauuuuaguagacacgggguuucuccauuuuggucaggcuagucucgaacuuccaaccucaggugauccgcccgccucggccuaccaaaguacugggauuacaggcgugagccaccacgccuggccgaucauagcuuuuucugaguguauuucugguauacuuucacacucccgugaguccauaggcggaaucgccauauauugaagaguuuaucucugauguaaaaucuauaaaguuaccauuaauuuuguauguguaagguucugaaaaagcacacuguugauaagcugcagaaaagagaguagggcaucuucugucacaggcuguauauuuggaauuuauucuagaaauugguaacuuuauaauaugaaagucaguccaagacuccucauuugaacauaggcuuacagauuaauguaugaacauaaaaauuugacuauaacaagauuauuaauguaugcguaguaccuuaguuauaguacuuuauaguuucuuuuauugguuuuuggguuuuuugaugguuuuuuugagauagggucuuacucuuaaccaugcuggaguacaguggcaggaucauggcucauuacagcuucgaccuccuggacuuaagugauccucccaccucagccucuggcauagcugggacuguaggcaugcaccaccaugccuggcuaauuuuguauuuuuuguagagacaggguuuugccauguugccuaggcuggucuugaacuccugagcucaggugauccuccugccuuggccucccaaagugcugggauuacaggcaugagucgccacacuuggccuaguuuauuuuauuguauuauauauauuuuuuauugacuaaguuugauuuuguagauaaagcuguugugacaugaauauggcucagggaaaugccaagauuucauacucugguagagguggauauagagucuacauucuucugaauccccucauuuucuaccaaagaacuggauguuguuacugucaucugcuggugagcaacaacugauaguacagauaguagaguaggaaguugcuauuuaguaguuuaucugguagcauuuccuuccacaguuacugguaggugccuuuacuaugaaguuccaggaauuauuacuaaauaaauuuuccuuguuucauuguuuagaacacuaaugcuuuuaaacuuggaauaagccacuucauguuuuguugacuugguuuuguaauucuuuuucuguccaguuuuccuuguuccuggucaacaaagaaauguggagugucuuggcugaauccucauacagacaagaucauuauggugcuguuagguaggacuuguauccagauguaagguaauaucuccacuagcuuaaauuuauaaauguauuucaaauguuccugaauggugguuuucuuuuuuuccugaauuuaauucucuguuuuuugccaagugauguuaauuuuguccaacaagccauauauaaaauuuagaacuauuauguaucaaaauagauagaauuucuggcuggucauggugguucaugccuguaauccuaacacuuugggaggccaaggcagacggauugcuuaagcccaggaguucaagaccagucuggacaacauggcaaaacccugucuuuacaaaaaauacaaaaauuagcugggugugguggccauguaccuguaguuccagcuacucaggaggcugaguucagaggaucaccugagcccagggagaucauggcugcagugagccgugccacuguauuccagccugagcaauggugugacuguuucucaaaaaaaaaagggggggcgggggguggguaguacuucugcuuuuuucuucuaguagguccaaaacuggguuuacuuuauaaauucaucuauaacuuuauucggguuuaccuuagaggccauguuucccuucauaaaucauucuugagaucaccuuauagcagaugguacuuuauagguggaucagucuaagugaacaacuuuagauuuuguuucuacauagccuuuagaauccugaauaaauauauuauuauccaaacuguuucuuaugggaguuacuuucuuuuuuuuuuuuuuugagagguagucuugcucugucgcccaggcuggagugcaguggcacaaucuugucucacuucaacucugccucccagguucaagcaauucuccugccucagccucccgaguagcugggauuacagaugccugccaccaugcccggcuaauuuuuguauuuuaguagagacaggguuucacccccauguuggccaggccggucuugaacuccucacuucaagugaucugccugccucggcuucccaaagugcugagauuacaggcuugagccaccacaccuggccaggaguuacuuucauccugcuuuuuuauugcaugugcugcaaauauagaauucuacuaaauugacauuuucucgugauauuaagacuaguucacaucucugcaggggcauuuuaagaaauccuggcggucaaggauuuaaucuuaucacuuuuagauaaauuuuuaaaaauuuaaaacauucaauguuuuacuuauauacaagauauguuaccacagauaauuauuuguuuauuuauuuguuaaugaaugacagggucucacuaugucacccaggcuggagugcaguggugcaaucaugacucacugcagccuuaaccuucuggggucaagcaauucucccaugucagucuccugaguagcuaggagcacaggcuugugccaccaugcccagcuaacuuuuuuuuguggggggggggaguaaagacuggaucucacucuguugcuacugggcucaaaugguucuccuaccucaggcccccaaagugcuggaauuauaguugugagccacuaugcuuggccauauauuuuugaaaugggguuuuguuauguuguccaggcugaacuuaagcuccugagcucaagagauccuccuacuucagcuucccaaguaguugggacuacaggcgugcaccacuaugccuacaaauaaucauuaacuacuguuccuuuauuugcaaaauaucccauuuuuauuaguuguccaucccaacagagccacagacuaaaaguucucuaagaaaacuuaccuggacugggcacagugacucacaucuauaauccuagcauuuugggaggccgagguaggaggauugcuugagccuaggauuuugagaccggccuggacaacauaacaagacccugucucuauuuuuuaaaaaaagcaaugaaaaauuaccuaaguuuuaggcccacuugucugcauuuuuaugucauggaucugucaaauguucauucauuuaagaaacauuuaaugaauaccaacuguauaacagccugucugauaacuucauggguacaguaaggaacaagagaaggcccuugcccucaaauuguuuacagucagauguauaaagcucugaccuggauguugaucucugagaauauacaaccuuauugucacccauacacaaacacuuaacaguaaacaguaccaagcagggauugauaaaggagagaugguguagaccagggguguucaaucuuuuggcuuccuugggcuacauuggaagaagaagaauugucuugggucacacauaaaauauacuaacacuaaugauggcugaugagcuuaaaaaaaaaucacaaaaaaagaucucauaauauuuuaagaaaguuuacaaauuuguguugggcugcauucaaaaccauccugggcuacaugcggcccaugggcuguggguuuugacuaagcuuggcccaaacccuaggugcuauagaauuuggaggcauuuaagacugucguagucagggaaaguuuauagaaggagauggacugaaaggagagggaaguuccucugggaaguuagaacaaugugagcacaauucagaguaugcuuaaaauagggaguaguuuaacucuagcauugguuccuaaagugugguccacagaccgguaacaucagcuucaccugguaacuuauuagaacuacaguuucacaggccccaccugagaccuacugauucagaaauacuggcaaugaggcccagcagucuaugcccuccaggugguucugaugcgugcuaaaguuucagaaccacuagacuagagcagaggguuauuguauggaacaaguaggcaaaacacucuaaaaagguaggcugggaacucauugugaaugacuuagaaugucagacagggaguuugucuuuuauccugcagacuagaggccccagcuugugacuugagggcuggacuuggcucauagaauguguuucguuuggccugaaugguagguuuuuggggguuuuuaaauggaauuaguugucaucauuuaaaaaucagcagauuuuacaaagaaaucugugcuuucagcuuaccuugaaaaaucagaagaccuggcaguauggagccuacauuccauuaugguagcaguuggugggaauagcaagaagcugccccuuuagaugggacacaugcucuccaguuuacugcaauccccaccgguuccuuuugucuuacacacaccuuuacucauuuauauuuccugccuggugccuguagguguuugaguuuguaacuucuguuguggacagugggacauuaaugaaaauuuugagaagcagagugaugagauuuauguauuuguuaauuuauuuaacaaacauuaauuaaacauauaugccagauuguacucuguuaaguaaucaguguucaaagaugaaugagucccagcugggaccgguggcucaugccuauaaucccagcacuuuaggaggcgaagucugguggaucacuugaggucaggaguucaagaccagccuggccaacauaaugaaaccccccccucucuacuaaaaauaaaaaauuagccggggaugguggugggcacguguaaucccagcuacuugggaggcugaggugggagaauugcuugaacccaggaggcggagguugcagugagccgagaucaugccauugcacuccagccuggaugacagagugagacuccaucucaaaaaaauaaaaauaaauaaaauacauguuuacuuuggagaccuuauaguuagaauuuauaacauggguugcgugagucaaauccauaauucaaauccugucuugaauguguaaucuucagauuuauguugcauagguaaguuuaacuuuuuuguuccugagggaauagaaaauaauauauaaacucaaauucuuaagugauucuuucaccucagccucccaaagugcugggaguauaggcaugagccaccaagcccccaucugcuuggucccuuuuaaccacauacucgugcauguaauaguaaguagccacucauugaucauacuguggaacauauggcugacauuuuaacagcaaaaaaagaccucacaucucggcucacugcaaccucgacuucccauauucaagcaauccuccugucucagccucccaaguagcugggacuacaggcacaugccaccacaccuggcuaauuuuuuuuauauuuuguagagauggaguuucgccacauugcccagguuggucacaaacuccugagcucaagcugucugccugccuugacuucccaaaaugcuaggauuauaggcgugaguugcugcgcccagucuguguacuuuacuuaugaauuagcuccuuggucauugccuucuccaccuuuacacacacauauacaccagcuucuagagggagugugacuugcuucucuugcuguuggugacuuuuuaaaugagcuggaugugugguaaaguggcugagguuguaguuugagugagaagaaaguguaggggagcagaaagagcugaagggcauuagacuacaacucaggagaugagcuuggugaucuggguuccaaagccugaaaagauuagaaaugaaaauguggaagagauaacugagucaaaaguaggcauacugacagcagagaaaaagaggaaacuguucuuauaauuauucauguccaucuuacacagguugaaaaagugauauaauaaaggaaccaaggagaaaauucagaaggaaagaaaaaauugguaaguaacauauauaaguaauacuucacuuuuucauaggucagauuucugcaaauucugcuuuguuguuccuagcugagagcucacaguagauggaaaaggguccauaaggcacugaaagagcugucacaaagugcaguacccuuauucuguuggagaggucuucauuugcuuauguugacaugaaauucuaauaauuauggcuuccugauuuacauccuacaacagauuuaaaaagaaaauuaggagguaauggugguuuauugaaggagcugggcacaugacaguacugaucagugaaaauauauagcaugaugucagaaaaaacuagcucaaaaaggauagcaaucugggaccauuuggugacagaagggcaaacaguccuguagaccuacuguagcccuuggaggcaucucagguuuacaggaaaauauaacugauaaucauaaucaugacuuugaacuauaaauaaaagugguuuucccuguaggaaauuauauaauucacaauggaaacacuuuuuauuuuuuuuuuuugagauagaguuucgcucuuguugcccaggcuggagugcaauggcuugaucacggcuuacugcaaccucugccuccuggguucaagcgauucuccugccucagccucccgaguaguugggauuacaagcauggggcaccaugccugacuaauuuuguauuuuuaguagagacaggguuucuccauguuggucaggcuggucucaaacucccgaccucaggugaucugcccaccuuggccucccaaagugcugggauuacaggcgugagccacugcgccuggccgaaaacacuuuuaccaaacacuaaguguuauaguggagccaggugcaguggcucacacuuguaaucccuugagagguuugggacuugggaggcugaggcugguggaucauuugaggccaggaguuugagacuguccugggcaacauagcgagacuccuuucucuauaaaaaaauugaaaacacggcugggugcgguggcuuacgccuguaaucccagcacuuugagaggccgaggcaggcggaucacgagaucaggagaucgagaccauccuggcuaacacggugaaacccugucucccuaaaaauacaaaaaauuagcugggcgugguggcgggcaccuguagucccugcuacucaggaggcuguggcaggagaauggcuugaacccaggagguggagcuugcaaugagccgagaucaugccacugcacuccauccagccugagcgacagagcgagacuccgucucaaaaaaaaaaaaucgaaaacaugcaaaaauuaucugggugcagugguucaugccugaagucccagcccucugggagguugaggcaggaggauugcaggaguuuaaggccgcagugagcugugauugcuccacugcagccugggugacagagcaagaccuugucaauaaaauuaaauuuuuuuaaaaaccccaaguuuuuuugguauuuagaaggaaagcauuuuaaagccacauuuggugggggaaagacaaauuugggaaaauguaauuauggggaaccccuauuccuuccuuuauacaugaaacuaucauuguaauauuuuuaucuuuggcauguuuuucauuuugauuuaacauguuugaagcaguagcuauuuuucaguugauaacaagaaagggaaaauguuuuuauucucuucccacaguuaaaauccaauauaaacggugcccaguggcacugauccuaguggcaguuacucuucuguaaauagugccucccacaauggauauggguuuggaggcagacagagcuuaucaccucagauuuucauucugauuuuucauuggggcaauaugaacccccuccugaaugacaguaucuucuuaucuaaaggacuuugauucuuaaugaaugggcaagaaaagaccuucugguuugugaagaaaaagaggcaacaauagcaacagcuuuccuccaagugauuauuguagcaaagucaagccugaaacaauggagaaugaaguuaugccugacucauuuuguuauuacacccaaaugaguucauuguacagaaugggccuuuuugacacgugucuaaugauauuuugaugcaaaugaaauaauacacauaaaaaaugaccuguuuacaggaaagacugauguauuuguugauaacuaccagugacaucaauucucauuucuuuauuggcaguuacaguauuugaauuuaggguuagaccuuaaaggauauauccagccaggcauggugguauaagccuauaauuccagcuacucagaaggcugaggcaggaggaucacuagaacucaggaguuugagaccagucugggcacaagaagacccugucuuaagaaagaaaaaauaaaagucuaggccaggcgcaguggcucaugccuguaaucccagcacuuugggaggccgaggcggguggaucaugaggucaggagaucgagacccuccuggcuaacacugugaaaccccgucucuacuaaaaauacacaaaaaguuagccgggcaugguggcaggcacccaucguccuagcuacuugggaggcugaggcaggagaaugguggcgugaaccugcgggaggcggagguugcagugagccaagaucgugccacugcacuccagccugggcgacagagcgagacuccgucucaaaaaaaaaaaaagaaaaaagaaaaaauaaauaauaaaaaauaaaaggcuauaucauuugacaagccgucugaucagugaaucuguucuggaaacaugaucagauuuggagcaaagacccuucccucccuaccaguuugagacagcucauauuguuggaacuuaauucuguucaaucccucccccaggagguuccaugcucacuggucuuauuauauguaagucuuugacaaugaucuaagaaaagcugaguuaaaaaauuuuuuuuuucuuugucugggggugguggcuuaugcuuguaaucccagcacuuuggaaggcuaagguggacgcaucacuugaggucaggaguucaaaaccaguguggccaacauagugaaaccccaucuuuacuaaaaaauacaaaaaaauuagcugagcaugguggcgggugccuauaaucccagcuucuggagaggcugaggcaggauaaucacuugaaccugggaggugcagguugcagugagccaagaucacaccagugcacuccagccucagugacagagugagacuccaucucaaaaaaaaaaaaaaaauuuuuuuuuuucaacacaaggucucacucugucaccgaggcuggaguacaguggugcaaucacagcucacggcagcuucaaacuccugggcucaagcgauccuccugccucacccucccgaguagcugagacuacagguaugugucaccaugcucagcucaaaagcugacuuuuaaauaaaccuuuuuauuaguuuuauugacuugaaaaauauugcuauaaaauuuuucuaugguuuucaaaucuguuccaguugucagucuugucccuuuucaccaaauaccucuucaguaccuaauuuuuuuuuuuccaagguggagucuugcucugucaccuagacuggagugcaguggcgugaucucagcucacugcaaccucugccucuuggguucaagcaauuucuucugccacggccuccugaguagcugagacuacaggcaugcgccagcaugcccagcuaauuuuuuauauuuuuaguagagacgggguuucaccguguuagccaggauggucuugauuuccugaccucgugauccgcccuccuugaccucccaaagugcugggauuacaggcgugagccaccgcgcccggccauaccuaauuuuuuucuaagagacaggaucuugcuauguuagcuuggcuggccuugaacuucuaggcucaagugauccuccugaguagcugggacuacaggugugugccaccaugcccagcuaguaccuaauuguuaaugcuaccugauaugauuggaaguuuuuuucuguauguagcauaaaguuucuauucugccaauacaaguauuuucuuucauucuguaucuuuguugauuuaguguuuaauuucagauuuauuauuuaauucuuaacugauauguaucuucaaaacaaauacagugacucauuuauuuucuuccuacucuuucuuaacuauaucugacuuuuaguugaauaauaggugggguagcucaggccuguaauccuaaugcuuugggagacugaggugggaggaucucaugaagccagggguuugagaccagccugggcaacauagcaagacuccaucucuauaaaaaauuugaaaauucacugggcaugguggcucauuccuguagucuagcuagucaggaggcuaaggcaagaggaucauuugagcucaggaggugaagguugcagugagcugugucugcaccacugcacuugagccuaggugauaaagcaagacaucuucucauuuaaaaaaaaaaaaaaaagggccgggugugguggcucacaccuguaauaucagcacuuugggaggccgaggcgggcggaucacgaggucaggagaucgagaccauccuggcuaacacagugaaaccccgucucugcuaaaaauacaaaaaauuagccgggcguggcggcgggcaccuguagucccagcuacucgggaggcugaggcaggagaauggugugaacccgggaagcggagcuugcagugagccgagauugugccacugcacuccugccugggcagcagagcgagacuccgucucaaaaaaaaaaaaaaaaaggcuuggcgagguggcuaaugccuguaaucccagcacuuugggaguccaagguagguggaucaccugagaugaucaccagccugacuaacauggagaaaccccgcuuugucucuacuaaaaauacaaaauuugcugggcuuggugguguaugccuguaaucccagcuacuuuggaggcugaggcaggagaaucucuugaaccugggaggcagagguuguggugagccaagaucaugccauugcacuccagccuggggaacaagaguaaaacuccaucucaaaaaaaacaaaaagguauuuaaauuucuuuucaccuuuagaaacaagaaguacauugugugaguuguaguuuuucugacuuuaauucuuuuccuuaaguaaaauauuaggacuauaacagaagauggaaguuaaaagucaagucagcauuguuguucauuuuguuuguuuauuuguuuuguuuuuuauuuauuuuuuugaaauggaguccugcucugucucccaggcuggagugcaguggcaugaucucagcuuaccgcaaccucugccuccuggguucuagcgauccuccuaccucagccucccaaguagcugggauuacaggcgugcaccacacacccagcuaauuuuuguauuuuuaguagagauggggauucaccauguuggccagacuggucuugaacuccugaccucaggugauccacuccccucagccucccgaagugcugggauuacaggcgugagccaccgcaccuggccaguuguucauuuuuaagaguuaauagcagccgaugugauggcucacaccuguaauccuagcauguugagaggccaagguggaggauugcuugaggccaggaguuugagagcaaucugacaaacauagugaaacccugccuauauuucuuuucuuuuuuuuugagaccgagucuugcucucucacccaggcaggcaugagccaccacgccugguuuauuucuuuuuuucuuuuuuucuuuuuuucuuuuuuuuuuuuuuuugagacugagucucacccuaucgcccaggcuggagugcaauggugcgaucucagcucacugcaaccuccaucucccggguucaagcaauucuccugccucagccucccgaguagcugggauuacaggcaugucccaucaugcccagcuaaccuggcuuauuucuauauauuauuuuuuucuaagaauaaacaaaugaacaaaaacaguuaauaucauuggaauaacaugcagguccuaaaauaagaaguauguaagauguguuuauugaaauauauauaugguauacuggaaaaaaaaccccacaaaauauuacacaaauacugguuacagcuuacaguagccagccuccaagaugccccccagugaugcucaccuccuaauauucaugccuuuguguaguccccuuuuacaguucgucaggguuggucuguaugagcauuagaauauagggauaugauaguguaugacuuccaaaacaaagucauaaaagacauuacugcuucugcccugcucuucuuggauugacugcucuggaggaagccagccacuggguuauaaagacauucaagcagcccuauggaggaucuacacggggagcuacugagacuuccugcccacagcuggcaucaacuugccaaccauugagugagccaucuuggaggugggucuuccaggccuagucaagccuucagauugacugcagccccagccuacaucuugacugcaaucucaugagagccucagagccaaaacugucuaauuaaaccacucucagagucccaaaccacagaaauaaugagauaggccgggcgcaauggcucacaccuguaaucucagcacuuugggaggccaacgcagguggaucaccugaggucaggaguuugagccuggccaauauggcgaaaccccgucucuacuagaaauacaaaaauuagccgggugugguggggggugccuguagucccagcuacuucggaggcugugacaggagaaucacuugaacccaggaggcagagguugcagugagccaagaucacgccacugcacugcaaccugggcaauagagggagacucugucucaaaaaaauaaaaaagggaugagauaauaaauauuuuuauugcuuaauacauguauuuauuuacuuaauuaauuuauuuuuugagacagggucuugcucugucacccaugcuggagugcaguggcaugauucuagcucacugcagcuucgaacuccugggcuuaagugauccuucugccucagccucccaaguagcugggacugcaagugugcacugccaugccuggcuaauuuuuucauuaaaaaaaaauuuuuuuuaauaggguuuugcuguguugcccaggcuggucucaaacuccugggcuccagugauccuccugccuuagccucccaaguguugggauuuacaggcaugaggcaccaugcccagccaauuuuuuuuuucuuuuuuucuuuuucuuuuuuuuugauucuucagcuaagacagcagaagagaugauuuaucguaugguuguuauacucggccacaaguaaacacagaaauaguccagaaugucccagguccagggcagaggaccaacaugggcaguuuugguuaugagcaaggugggucucagaggugaucagcgaucagagggcggugaaguucuggauccauugagacaagcucuacacaauagcaugcagucccacaacuuguaccagcauccccagcaucuggcauuccauguuucugcuccuguguggccuccacggugcaacaagcuagcgguuuacuuggaccucugccucaucuuucuucuuuugugcuucagacugcacauucgcuuuuuccuccacuuagcucucaugaugcagagguuuccaagaaaauggcgcuaaggcugagagaaacccuagcccauuucuauugucaguuuuuauugaauuccaccuuggacgcucuucuagguucuuggguuacaccaguaaacaaaaagauuucugcucuugaggagcuuauauucuaucagaggaacacagacaauaaauaucaguaagcuuuccaguauguuagaaugugauaagugguguggaaaaaagaaaaguggaucagaguaaggggaguugagaaagcagguagaggugggagcaugugaaggugagagguuauaguauuaaguagaucucaauaagaaagugauuuuuaaacaaguauuugaaggaguugcaggaauucaucaaguggauauauaggaaaagaauuucuaggcaguggggacagcuuagagcgaaggcccuaaggcaggggcaugagugaauaagcgcagaggucaguguugggggagaguaaggugaaaacuauuaguagauggggucagagauguaguggggauggaagcagaaggcuauuuucaggaccuuguuucucugaaauggggagccagugcuggauuuugcauaaaacagagacauacucuaauuuauauuaaaggaugacuuugguuguuuguuaaaaggagacaaacuccaggggagugaggauaaaagcaggaagaucuguuaggacaauauuagcaaaucacaugaaagaugauaguggcuugggcgaaggugguagcaauggaaguggucagaaauggucggauucuggaaauguauucaacagcaggaaauuaagaucuucaaaaucucuugauuagcugggcacaguggcucaacccuguuaucccagcuauucaggaggcugaggcuagaggauugcaugaggccaggaguucaagaccagccuggguaacauagugagacuccaucucuacauaaauaaauaaauaagcucuugauuuuauguaagaaggucagacugcuguaagacuuucacauccugauggaagucucacuuuccagccucaucucagaccauucucugcucuacacucgccuccccacucccauaucugucuuuuccaagagcccuguuagauaauccuucuuggguggccuacuaguuaagacuguggcucuggaauuaaaccaucuggguuugauuucuggcucauuucauuuaacuacgauguggucuuaagauacuuaguuucucuaagcucaguuuucucauuuauaaaaugggaaucuuaauaauagcaccuaacucacagagcaguaaugugagauuaaaugagcuaaucuauguagaauacuuaacaucaugcuuggcaucuacuaagaucuccguaaauauugguuacuauuuuuuuaaaaucucagauuauguuucuuugaccacaaucuuuauccucugcauuaaaugcuaacccucuucuucuauauccucuuucacuaguuuucuacuuuuuguuucucaaauucauauaaaaaauucuugaggacauuggcuuuuaauuauuauuauuugagacagggucucacucugucgcauaggcuggaguacaguggugccgugcaaucacaguucaccucagccuccacuucucaggcucaaaugauccucauaccucagccuccugaauaguugagacuacagguguguaccaccaugccuggcuuuuuuuuuuuuuuuuuuuuuuuuuuuuuuuuuuugagaugaggucuugcucucucgccaggcuggaguguaguggcaugaucucggcucacugcaaccuccgccucccagguucaagcgauucuccugccucagccucccgaguagcucggacuacaggugcccgccaccaugccuggcuaauuuuuuucuuuuuuuuugggauggagucuugcucuguugcccaggcuggagugcaguggugcaaucucggcucacugcaagcucggccucccagguucacgucauucuccugccuaacccucccgaguagcugggacuauaggcacccgccaucacacccagcuaauuuuuuguauuuuuaguagagacgggauuucaccguguuaaccaggauggucucgaucucuugaccucgugauccgcuugccuuggccucccaaagugcugggauuacaggcaugagccacugcgcccagacacacccugcuaauuuuuuaauauuuuguagagauagcauuucacuauguugcccaggcuagucucaaacucuuggggucaagcaauccucccacuuuggccucccaaagugcuaggauuacaggcaugagucaucauaccuggccucgcuauuuuuaauuuuuauacggauagggucucacuguguuguccaagcuggacuugcacuccuuggcugaagugacccucuuuccucagccuccugaguaccugggacuauggucacgugccacuccauauggcucuugaggaaauuuuuaaaugaaaucaaacgauacuuuuccuaucaucuuuuucuaaucucucuggucuuuauacacaucuggucucuauuauuucuguaguuauuucuguccauuuuucaugauugcuuacaugucauuucauuuuuuuuguuguuguuuugagacagguucuugcucuguugcccaggcuggagugcaguggcaugaucucggcucccugcagccucgccucccagguucaagcaauucucccaccucagccuccugaguagcugggauuacaggcacaccaccacgccuggacaauuuuuguauuuuuaguagagaugggguuucaccauauuggccaggcugguccugaacucuugaccucaggugauccacccuccucggccucccaaaguguugggauuacaggcgugagccacugugcccagccauuucuuuuauauaugcuuauauauauauuuuuuaaauugagacgggguucagucuugucacccaggcuggaguacaguggugcgaucucaacucacagcaaccuccaccucccagggggcucaagcaauccucccaccucagccucccaaauagcugggacuacaggugcauuccaccaugccugacuaguuuuuguauuuuugguggagaugagguuucaucauguugcccaggcuggucucgaacuccugagcucaagcaaucugccugccuuggccucccaaagugcuaggauuacagacgugagccacugugccuggucucaaaugucuuuucuugaugcguuuccaaauccucuagggaguuaguccuguguuuuuguuccuuuaccuuuuuuuuuuuuuuuuuugagauggagucucgcucugucgcccaggcuggagugcagugacgcgaccucggcuaacugcaaccuccgcccccuggguucaagugauucuccugccucagaccccugaauagcugggauuacaggugcaugccaccaugccuggcuaauuuuuaaauuuuugguagagaugggguuucaucauguuggucaggcuggucuggaacuccugaccucaugauccgcccgccuuggccuccccaagugcugggauuacagguguaagcuacugcgcccggcccuuuaccuuuuuuuuugagacggagucucgcccuguugcccagucuagagugcaguggcuugaucuuggcucacugcaaccuccgccugccagguucaagcaauucuccugccucacccuccugaguagcugggauuacaggcacgcgccacugcgccuggcuaauuuuuguauauuuaguagagacgguuuuaccauguuggucagucuggucucaaacuccugaccucaugauccgcccaccuuggccucccaaagugcugggauuacaggagugagccaccgugcccggccuaccuuuguuuuuuuuggggggguggggggcagagucuuacucugucacccaggcuggggugcaauccugugaucuuggcucacugcaaccucugcguccugaguucaagcaauucucguuccucagucuccugaguaguugggauuacaggcgcaugccaccacaccuggcuaauuuuuguauuuuuaguagauaugggguuucaccacguuggccaggcuggucacgaacuccuaacuugagguaauccacccacuuuggccucccaaagugcugggauuacaggcgugagcuacugcgccuagcuucuuuaccauuuuuaugcuuaguuuaaaaaguuacgguuauuuuuauauaugucugccaccucugccagacucagcaucuugaauaaaaagaucuguuuuccucaccuuuacuuuucuggcaccuagcaguuaguaggcaucaguaagcauuaguagaauuaagcaauugagugguccugacaaggcuccugacugcaguccuuacauguaacuaccagauucguauuuggauacucccuaguucaauaucuucaguggcuuccuaucaccugcagaguaaaguccaaacuccuuagcugaguauuugguguccucuacuaugugaccucaaucuaucucuucaacuuuauuuucuacuauaguuggucaaacugauccauucacuguuccucaggggcccccaucccuuuuccacauccgugucuugauucaugguuuuauuccugaaaagcacuccuugccuguccuaauucauuucccuccucaggacccuccucagauacgaccuuuuucacagagccuucuccaucaucccagcuuugaaguuucagagcauaguaacugugcugcuugacacauuuucacuuuauagagguaauuuauggacauguauuuuuuuuuuccaacuuaguauaguuucuuaggguuucuuaaaguuucuaagaugauuuaucuuugugugcuguacuuguaagcagcaguaagaaauugcuaauuucuggaauggcugucacugucgguuacuacagguugaaugaaggggacaaacgcagaaaugaagacaaagacaaaaggaucuguuucgaaagaaggggucagggagcuccuugcuucuagugagcaaaggcagcccugagcuucuaccgcccuucguauuuauuagauagaaagagcagggagggagagguaacaguuggucagcugcuagauuuaucacagguacacauaauugcuuucuuuguacaacaggcuucagaugcuccuauagauaauugcaaggaacacugcgcugggggugugacugcccucagcaccccuucugguggcagacgcaguuugucaguuuuccaacauccugcuuucaugagaacaguuuucuguuugcucauauaaccuccaauggcauacugaguuggucacgacccucauucuuucugccuguaacacauggccaaaugaaugaaugaauauaggaacaaauaggcuucacaugcccuauccauggucuaguuuggaggggaauugggaguuggacauguaauaccuaggccguaguggaacacugggaaaggggguacuccuugcccuauugcuucugccugcauauuccauuagccuaauuguaccaaguccauuugggauucaauuacugguguccagcauguuccaggccuaauauuaauaccugucuuugguaauacaaaagauaccaugcaccacccaccuuagacauccuucagauagcaaggugugucagggcuguggcccuuuguauuauaaguuauauccucaaauaaggcauugcucacuuugcugcagccuguccugaacuuagcuuauuagaccuaccuugguuuugcuuggcuuggcuuacuuaugcacugggugguuuaacuauauugguuccauaguucagcuuacuguuuaaaaauuucauucuaguuacauuuuaaacuugccuuauguuuaauuuuuaacuuguuaaggcuagcuuugcuguggagcucagaugaauugucagugggagcuuuuacauuucacucuuuuuggaccuuuugguggaccuuucuaaucaccuauccaauuuuccacuguugugagauacuguauuauuuuauccaagucaaucaauaaugauauuugcuuagggagucaacagaaagacauaacuaacaaucaaucucacuaugggaaaggaaaacaaguccacuccuuuugaaaucugauucucugcuuccagagccauuuucccucacucuggcugucuuuauucugguacaccucuauauuccagcuguaccaagcuguuaauacuugaaguucucagaauccuccuugugucauuuucccaggauaauuccuaccucucaucccucaagaagcuucccagucccaucccaccuucaccuuuccccuuccaagccaaguuucuugucccuuaugucuguuccuagagcacuuugugugcauuucugucagagaacuuaucacaguacauuacagucguugguuugcuugucuggguuuuguuaguuuguuuuuugagacagguucuugcucuguagcccaggcuggaaugcagugauauaaucaugguucaugcagccuugaccucuuaggcucaagcgauccucccaccuuagccuucugaguagcugggacuacaggugcaugccaccaugcccagauaauuuuuuuauuuuuguagagacagagcuucacuguguugcccaagguggucuugaaauccugaccucaaguaauccuccugccucgaccuuccaaagugcuaagauuacagacaagagccacugugcccagcccuguuuucuccaguaagcugaaauuucuucuauaucggauuccucuguauauaucaagaaucuagcacagugccugguauauauuagauacucaguacaugcuuauuaacuagacaggugaaugcccagguuucuaaaguuuuuuuuuuuuuuuuuuaagagaccaaguuauguuccauccagguuucuaaauucugugucagggauggaagguauugagaagugcuauuaacuuuucuauuuggcuaacaaaaacacagaaaugaguugcugagcagcuuccgcccuaugagcgauaauccuacuaguuggaaguuaacuaugauaaaaguagaugaacgaauuguguacucagagaaaaagagaguaagggaggagggaaggauagagaagggagugaguuagcaaaaugccacacuguuaguugcaaacuggcacaaaggugaaugcgguucaugaggcucgcuugauuaagaagagcugaaacaggagcaaagagcaaaaggcaaccugcagcgaaagcaaggacucagggaaccggcagacacaagcaggugagcacaugaauggggcccagguccucugggauuguggucucucaggcuuccggggacauggaagaagggaagccagagugugacguucugggaaagcugaguggggaggauucaugucuacuccagguauaaagagacacaaaagaccauagaaggagauggagauagugacaaacacuggcuggcaccagagucucaacaaaaagaauuggaaacagggcuuuguuggggggugaauaagagauagugagcaagagaaaaugagaagaccaacugugaaaggaguagauuuaaauguacugacguauacauaccucccuagucuacaaaaaguacgccuaucugcacuauuuugaguagcauauaaaacuugacacauuuggauaaaugucaccuuuauauaacaaauguggggaaaaccuucacugaagcuuggaauugugauuuuuuucaggggcuggguaauuuuuuggaaagcagucagcuauuauuauuauuauuauuauuauuauuauuauuugagauagagucucucucuaucacugaggcuggagugcaguggcacacuuaacaggcgugagccacugugcccgaucagcuguuacauuuuuauuaaaugggugagaucuagugccugaguuacuguauuauuguuuaucccuuuggaguauucauucaacaucuacugugugcucacaccaccauuccagcaccaggaacacauaaaaaacaaaacagauaaaaauuccugcuuacgggccagccaagguggcucaugccuauaauccuagcauuuugggaggcugaggcggguggaucacuugagaccagaaguuugagaacagccuggccaacauggcaaaacccugucucuauuaaaaauacaaaauuagccaggcgcggcggcacaugcuuguaauccuggcugcuugggaggcugaggcaugagaaucgcuugaacccgggaggcggagguugcagugaggugagauugcacaacugcacuccagccugggugauagagcaagacucuguauuuaaaaaaaaaaaaaaaaauucugccuggcuauguauaguucacauaguggguaaagguggcaggaaacaggaaauaugaaaauaaacaaaaguaaauuauauaauguguuagaugguaaaaaguccuguggagaaaaauaaacagaaaaggaagauaggaaaacaugauguggucagauggguuauaauuuuaaauaagguagacaaggaaggucucacugagaagcugacauauuugagcaaagauuuuaacauagugaacgagcaagcugugcagacucggguucuguaaaauaggaugucauucuauaaauguaagacuuuuuuuuuuuuuuugagauggagucucgcucugucgcccaggcuggagugcuggugcaaucuuaucucauugcaaccuccgccucccggguucaagcgauucuccugacucagccucccaaguaguugggauuacaggugccugccaccacgccuggcuaauuuuuguguuuuuaguagagauggggugucaccauguugaccagucugguuucgaacuccugaccucaugauccacccaccucggccucccaaagugcuggauuacaggcgugagccacugcaccuggcacauuaguuauuuuaaaauggcuuacauugcucggugcggaggcuugugccuguuaucccaggacuuugggaggcugaggcgaguggaucaccugaggucaggaguucgaaaccagccuggccaacauggugaaaccccaucuuuacuaaaaauacaaaaaauuagccagguguggugguaugcgccuguaauccuagcuucuagggaggcugaggcaagagacuuucuugauuccaggaggcagagguugcagugagccaagauugcaccauugcacuccagccugggcaacagagugaaacuccaucucaaaauaaauaaauaaaguuuaaaaaaauaagacaaugccuaaugccauuuuaaaauaacuaaucuuaaaagugcgauugcaagugguuuagaauguaguuacugagagcugaaaggggcauucuauuuguucauccuuugcuuucucuaaaaucuauuguuugguuuuacacugaacaacuaguaugacucugcaggguuuuuuguuuguuuuuuuuuguuuguuuuuucgugaaaacagauaccuaggauguuuuuuuucaccuuugaaaucucuggaagaaaaacaaauauuuacuuaauagaaauagaagcuggagaaguuuuucaaaaacuacaaugauauauuaauacaaaauuugggugaccccugaagaaacugcagucacacagaggaaggaaagcugcugccuagaaugccauuaauucacuuucugagggaaaagagggacccagaguuggacaaagcaaggaucuguuaacacucagagacucugaagaguuguuucuguuucgaguuauuuaguuugaucuacaugucuagcucauuugcuguaaaagaaucagccagagugugaaccuggccaggcagcuauccuguaucagugguugauuuccugggaugaaguuuccuuuguuugggauuguaaaaggucaaacaauuuugucuguuccucuccuaaccaauagcucuuauucuuaacuacaggauagaaguucagccuugaauaguguucuaacggaugguuccagcucugcuuugguaguaccuaagaccaaaucuaguuauuuuaaauauuuuauuuauugagacagggucucacucuguaccuaggcugaagugcaguagugcagucacagcucacugaaccucaacuucccgggauccagagauccucccaccuccagcuucccaaguagcuaggaccacaggugcaugccaccacguccaacuaauuuuuguacuuuugguagagaugggguuucaucauguugcccaagcuggucucgaacuccugaccucaaacaauccacucaccuuggccugucgaacugccgggauuacaggcaugagccacuuuacccagccuaaauauuuuaaaauuccaaauauaguuaacuuuguuuuauguauuuauuuugagauagaaucucacucuaucucucaugcuggagugcagugacacagucucagcucacugcaaccuccgccucccagguucaagcgauucucguacuucagccucccaaguagcuaggacuacaggccuguaccaccaugcccggcuaauuuuuguauuuuuagcagagacgggguuucgccuuguuacccaggcuggucucguacuccugaccucaagugauccgcccgccucggccucccaaaaugcugagaugauaggcgugcgccaccacacccagcugcaauuaacuuuaauuugcuuuuuuuuuuuuuuuuuugagacggagucuuguuccgucgccuaggcuggaguucaguggcacaaucuccgcuugcugcagccuuugccucccagguucaagcaauucuccugccucagccucccuaguaacuggagcgacaggcaugcgccaccacgccuaauuuuuuuuuguauuuuaauagagacagaguuucaccauguuggccaggcuggucucaaacuccugaccucaggugaucuacucaccucagccucccaaagugcugggauuauaggcgugagccaccacgccuggccuaauuugcuuuauuuuguguaauaugucaccuguggggagggagacauuuugauaaacccuagauacucaacaaaguugagaugauugagaauccuuaaucuguacuccaaauauacgaaguauuuuguuagagcugaagggccugggaaaugggaacuuuagaaucagaucuugucacuuaaccaguaaacuaugacuuacauaagagauccagagaugaaagcuggaucagaagacccaaaacuguuuggugcaaaguacauaaagugcaagucaggaagcuuuaccuuagaggauagauacggcauuauucauuaauaccggaagaaaauggcagagaaaacguuuauauacauacauauauaugaaaauauuuuauauauauauauacuuuuuuuuugugagacggaguuucgcucuuguugcccacgcuggagugcaauggugcaaucucagcucacugcacccuucaccucccggguucaagugauucuccugccucaggcucccgaguagcugggauuacaggcuauuuaaaaaaaaauuuuuaaauaaacauaaaauuaaaauacauagaauauauuuuauauguaaauauacagagcaggaaaauuagccagcagacagcuggcaaugucuggagacguuuuugguuaucacaacugguuguggguggaggggcgggaugugcuauugaccucuaguggauagaggcuggggauacugcuaaacauccuaccuuacacaggacagcgcccacaucaagcccuaauuguuuuuuuuuuuuuuuuuugguuauuguuuuuuuuuuuuuaagacagauucuugcucuguccuccaggcuggagcacaguggugcgaucuugacucacugcagccuccgccucccggguucaagugauguuccugccucagccuccugaguagcugggauuacaagcaugcaccaccacaacuaacuaauuuuuguauuuuaguagagacggggguuucaccacguuggccaggcugaucucaaacuccuaaccucaagugauccgccagcauuggccucccaaagugcugggauuacaggugugaggcacugcuccuggccccuaaauguaaacagugcuaagauuaagaaacccugaccuugaggaacuccaguuuuccuuuacggaugagaucauaggacacagucugagcuuugcaggaggccagauacaaaucaccaaaacaaaaagcacuuaauuguuuuuguugguuucucauuuaauguccauccagaaaaaaagagggggaaaaaaguugcuaguaaagcaacugugaaguauggaugccauuauuccauucaacacuaccaagugauuuuuuguuuuuguuuuuguuuugagacacagucucacucugucgcccaggcuggagugcaguggcaugguuucggcucacugcaaccucugcuucccgguuucaagcaauucuccugucucaaccuccugaguagcugggacuacuggcgcaugccaccaugccuggcucauuuuuguauuuuuaguagagaugggguuuuaccauauuggucaugcuggucucgaacuccugaccuuacaugauccaccugccucggccucccaaagugcugagauuacaggcaugagccacugcacccagccacaaauguuuuuuaucacagguuucaauaauauucaaacucaugauaauggcuuuguugcagaaugauggaaaaaaacccuauacauuuaaaaaauuauuuuccaguaaaacaaauccggcugggugaaguggcucaugccuggaaucccagcacuuugggaggcugaggcagguggaucucaggcugaguucaagaccagccagggcaauauggcagaaccccaucucuaccaaaauaaaaaaaauagccagguauggaggcacacacguguaaucccaacuacucgggaggcuaaggaggaaggaucacuugagcccgggaggugaugauugcagugaaccgugauugugccacugcacuccagccggggugacagagugagacccugucucaaaaaaagauggggagucagaaaagagggagggagaaacggauauuuauguucuaaagggaaaaucaucaaaauggaaagaagaaauuagacucaacaauaggagcagaguggcagagagccuuugaguaugugagagccacccuacaauuauuauuuuuuauuuuuagagacagggucuugcuuugucacccaggcuggagugcaauggcaugaucauagcucacuguaaccuugagcuccuggacucaaguggucuuccuaccucagccucccaaguaccugggacuauaggcaugugccaccauaccuggcuaauuuauuuauuauauuuauuuauuuuuuuugagacgaagucuugcucuguugcccaagcuggaauguaguggggcgaugucugcucacuggaaccuuagcuucccagguucaagugguucuccugccucagccuccugaguagcugggauuacaggcaccugccaccaagcccggcuaauuuuuuuuuuuuuuuuuuuuuuuuugagacugagucuugcugugucgcccaggcuggagugcaguggcacgaucucggcucgcuacaaccucugccucccggguucaagagauucuccugccuuagccuccccaguagcugggauuauaggcacccgccaucaugcccagcuaauuuuuguauuuuuguagaggcgggguuucaccauguuggccaggcuggucuugaacuccugaccucaggugauccgccugccucggccucccaaagugcugggauuacaggcaugagccaccgcgccuggccuaauuuuuguauuuuuaguagauacaggguuucaccauguuggccaggcuggucucaaacuccugaccucaggugauccgcccgccucggccucccaaaguacugggauuacaggcaugagccaccgcgcccggccuaauuuuuguauuuuuaguagauacaggguuucaccauguuggccaggcuggucucgaacuccugaccucacgugauccaccugccuuggccucccaaagugcugggauuagaggcaugagccacugcgccuggccuguguauuuuuuuguagagacagggcucucgcuauguugccaaagcuggucgugaacuccuaggcucaagcaauccucccaccugagccucccaaagugcuggaauuauaggcuggagccacuguuccuggcccccacccuauaauuaaaagcaaaguggcugggcgugguggcuuaugccuguaaucccagcacuuugggaggccgaggcggguggaucacgaggucaggaguucgagaccagccugaccaacauggugaaaccccgucuguacuaaaaauacaaaaauuagcugggcaugguggugggucccuguaaucccagcuacucaggaggcugaggcaggagaaucacaugaacccgggaggcagagguuucagugagcugagauugcgccacugcauuccagccugggcgacagagugagaguccgucucaaaaaaaauaaaauaaaaaaaagcaaaggucauuauguuaagugaaacacgccaggcucagaaagauauauacugcauguucucacucauauaugggagcuaaaaaaguugauuucauggaaguagaauagaaugacaguuaccagaggggcugggaaggcuagugggguguggagagauuaggagaacuugguuaauggguacaaacuuacaauuaaauagaaggaauaaguuauaguguuugauaguucaguagggugacuauaguuaacaauauuuuauuguguauuucaaaguagcuagaagauuugaaauguuuccaacacaaacaaugauaaauguuguaauagauauccuagauucucugauuugaucuuuacacaucgucugcauauaucaaaauaucacauguauuccauaaauauguacaauuacucuguauuuuuaaaaaccaaagcaugggaaaauauaucuucaauuccaauuuccuuuuggaacuagauacccuucggaaaaggugcuaagagcccacaucacccugguuuagcuuguuguacagguuauuagaauagggaaggaacaccuugggcccaggagugaguguuucuucuuuuacagguguaacuaaaaaagcuaguuggucuaacuugugugucuuuguccuauaagccucugcaggugugcgagcaggauugcuucugcaacaaaagccuccacccagccacaucuugggaaaagaauggccacuucuuggggcacagucuuuuucaugcuggugguauccuguguuugcagcgcugucucccacaggaaccagcagacuugguuugaggguaucuuccugucuuccaugugccccaucaaugucagcgccagcaccuuguauggaauuauguuugaugcagggagcacuggaacucgaauucauguuuacaccuuugugcagaaaaugccagguaagugcaacugggacccuuaguagagucuguaaauccacacuuuagcaucuccucccagaaacaaauaugcugagaguuuauuaugugaauuacagaaucucacaccuaguggaugucuuucuucagagaacuuuggacuacaauugaacaugugguuuauuuauuuauuuuuauuuauuuguuuuguuuuuauuuuuuaacuuuuuuuuugagacaaggucuugcuuuguugcccggucuguagugcaguggcaugaugacacaucacugcaaccuugaccuccugggcucaagcaguccuuccaccucagcccccugaguuguugagacuacaggcuugugccaccaugcccagcucauuuuuaaauuuuuuuauagagaccugcucaggcuggccucaaacuccuaggcucaauugauccucccaccucagccucccaaaguacugggauuauagguguaagucaccaugcuuggccagaacacaugguuuaauucaaugugaaauuagaagagagcugggcugucuguagucugaaacccauguguucaaaaagaauaguuauaauuuguucuuccucuuuaaacaugggauacuccagggauccauaauauucagaauauggggagugguuuugggagaaggaucacaugagaauuucacugccauccuuggacaugaggcuaggaaucccugaagauuaacuuuuucugaauugucaguguuuuuuccucaggucacuuauggagccuggggaaagguggaggaguuagguguccaccagagaaaugguagcagaaauggacccucagagguugcucuaguccuucuuuccaguacuccugcaagacauuccucacaacuaggaucauuugggauaacuucagggaagucauaggaaaacuuacagagacagagcccagcaucugaagcagccuaacuuuugguaaccagcucucucuucuguuuuguuccauggacaaaauaggacagcuuccaauucuagaaggggaaguuuuugauucugugaagccaggacuuucugcuuuuguagaucaaccuaagcaggugaguuucuuaugauuugauguuuagauucucaaugccuugauaacuugaccacaccacugcuguuaaauauuucaugcuauucacuaaugagauugagaucaugugugagaucagcuuucucuccucagcuaaucuccuggauaaaauuaauuacauuucccacgcucaugagggcuggguggaagaaggcuagaaaauugguugugguaaugcaaggaugacacuagcuuuuaagagauuacucccuauguacuuacuguuuaaaauuuugaguugaagccaucaguuguauuuguucauguaagcgcagaagauaaacaugaaguucuguaggguaugauguauaaacauggcaguugaaggcauggugagcagugaauuccauuucagagugccuugaugcaggauggaaccauaucuauacuugagaaauuaggcaacaacccaugaugacaaaaaucuuuggugguagaagaugaauagagaguuuguggcgacuauauuucacauuugagcaucuacaacauacuacauccuaugugucugaggccauguugaaauaaaauagaauaaugcagaauguuaaacuuggggagcaaauguaaagguauuuauuguucauugucacaagaauaaucauuacccaaaugcuugauguuaaaaaugauuugaguuuggagaacugagaggauauauggauauauauacauuuucuucuuuuucuuuuuuuuuuuuuuuuuugacggaguaucacucuguuacccaggcuggagugcaguggccugaucucggcuuacuacaaccucugccucgcggguucaagcaauucuucugccucagccucccgaguagcugggacuacaggcaugugccaccaugcccggcuaauuuuuguauuuuuaguagagacgggguuucacuaugauggccaggcuggucuugaacuccugaccuugugauccgcccaugucagccucucaaagugcugggauuacaggugugagccacugcaccuggccccgagaggauauauuuucuuaguucaguagcacauggauagcaaaucuacuagaaaaauuuggagcuguucaaaagaaacuaccaucagaguaaacaggcaaccuacagaacgggagaaaauuuuuacaaucuacccaccugacaaagggcuaauauccagaaucugcaaagaacuuaacaaauuuacaagaaaaaaucaaacaaccccaucaaaaagugggcaaaggauaugaacagacacuucucaaaagaagacauuuaugcagccaacggacacaugaaaaaaugcucaucaucacuggccaucagagaaaugcaaaucaaaaccacaaugagacaccaucucacaccaguuagaauggcggucauuaaaaagucaggaaacaacaagugcuggagaggauguggagaaauaggaacacucuuacacuguuggugggacuguaaacuaguucaaccauuguggaagacagcguggugauuccucaaggaucuaggaauagaaauaccauuugacccagccaucccauuacucgguauauacccaaaggauuauaaaucaugcugcuauaaagacacaugcacacauauguuuauugaggcaucauucacaauaucaaagacuuggaacgaacccaaauguccaucaaugauagacuagauuaagaaaauguggcacauauacaccauggaauacuauguagccauaaaaaaaggaugaguucauguccuuuguaaggacauguaugaagcuggaaaccaucauucugagcaaacugucgcaagaacagaaaaccaaacaccgcauguucucacucauaggugggaauugaacaaugaggacacaggguggggaacaucacacaccggggccugucgugggguggcgggagcagggagggaaagcauuaggagauauaccuaauguaaaugaugaguuaaugggugcagcccaccaacguggcacauguaugcauauguaacaaacaaaccugcacauugugcacauguacccuagaacuuaaaguauuaaaaaaaaauaccagggucagggguauauuugaauaguaaauaaauaaauuaauuaauuaaaaauaaauaauuaaaaaagaaaaauuaggagcuguugaaagcaacuauauuauuagaaacugacuuggcauuuagaaaaggugaucguguuguaguugcuaacaauaaugaucaaagggcagucagauaucagaauagaaguucauucagggaaauaguggauuuaaaauaaugguuuucauuuauuacaaauugagcaucuacugugugccauaugaugauacaggaauaagccugacauguucuuuaggagaucaucaaaaguauggcaucauuacugccacagcuugugugguaaccacaugcacuaugccucaugcacacaacaguuuaguggugguaggcagcguaucuaccaucccacacuugaggaaaccaagucccaacaaggccaagugaccuaaguuaggccacagggcuagcaagcaagucuucugacucuaacuccuguuuucuucacucuaccauccuaaagcugauuuauauauaagaaacaugaaauaaucagccaggugcuguggcgcaugccuguaaucccagcuacucaggaggcugaggcaggagaaucgcuugaacccgggaggcagagguugcagugagccgagauugugccguugcacuccagccuggguaacaagagcaaaauuccgucuuaaaaaaaagaaaaagauaaucaacuaaaaugaucacaauauaaaagaauaauuuggccaggcacgguggcucaugcuuguaaucccagcacuuugggagggugagguggguggaucacuugaggucagguauucgagaccagccuggccaagauggugacacccugucucuacuaaaaauacaaaaauuaucugggugugguggcauaugccuguaaucccagcuacuugggugacugaggcacaagcaucgcuugaaccugggagguggagguugcagugagccaagaucacaagaucaugccacugcacuccagccugggugacagagcaagaaugucccaaaaaaaauaauaauaauaauaauaauuuuuuauuaggacugucaaaaugaaauggauucuccuuuuuuuuuuuuuuuugagauggagugucacucuguugcgcaggcuguagugcaguggcauaggcuugacucacugcaaccucugccucccagguucaagcaaugcucuugccucagccucccgaguagcugagacuacaggugugugccaccaugccuggcuuauuuuuguauuuuuuaguggagaugggguuucaccauguuggucaggcugaucucaaacuccugaccucaaaugauccacccaccuuggccucccaaaguucugggauuacaggugugagacaccacugcgccuggccuggauucuccuucaaagcggcccacuucucuagguuucuccugcuacagagcagagagagguuggagcccuaugccaccucccucuucuugcucccacaaaguauguugacagaauagaccagugccagccacuaaauggaucguucaucagaugaacggguuaucucuuuugaagggugcugagaccguucaagggcucuuagagguggccaaagacucaaucccccgaagucacuggaaaaagaccccagugguccuaaaggcaacagcaggacuacgcuuacugccagaacacaaagccaaggcucugcucuuugagguaaguuuuaaaacugcaucuuggaucauucugcccuuuucccuauaugaauacuuuaugaguuuuuagccuuuuggaaugugaccacuaccuucaguauuccaccacugccaaagcauugugaugacucugaccacuuguuauagcuaguuguuuacauuuuuaacuaucacucuuaaauguauagagcuuuuccuaaaaaauuuaaaguacuuucuaucuaggauauucuucauucuuuuuauuuuuauuuuuauuuuuugagauggagucucacucugucacccaggcuggagugcaguggcgccaucuuggcucacugcaagcuccaccucccagguuaaugccauucuccugccucagccuccggaguagcugggacuacaggcaccugccaccacacccgacuaauuuuuuguauuuuuaguagagacgggguuucacugcguuagccaggauggucucgaucuccugaccucgugaucugcccgccucagccucccaaagugcuggaauuacaggcaugagcugcugcaccuggcugauauucuucauucuuuuagauuuuuaaagcagaaucagaagucguuucuaaucaacuuuauuaagauaaacuuacauacaauaaaauauaucuauuuuaggcugggcacgguggcucacaccuguaaucccagcacuuugggaggcugaggcagguggauugccugaggucaggaguuugagaccagccuggcuaacauggugaaaccucaucucuacuaaaaauacaaaaauuagcugggcauuguggcgcacgccuguagucccagcuacucaggaggcugaggcaggagaaucgcuucaacccaggaagcagagguuccacuaagcugagaucacaccacugcacuccagccugcgcaacagagcgagacugcaucucaaaaaacaaacaaacaaaaaauuauauauuuuagguguacaguuaaaugaguuuugacaagaaauagaaauuuccucaugcucuuuuauagugaguuucccucaccccugaaaccaaccaaucacuaauuugcuuccugucacuauaaguuuugcuuauucuuuucauauaaauggaauuauacaguuuuuauuuuuauuuuuguauaucuggcuuuuuuccucucagcauaaaguuuuugagaagaauaauggaacuuuaaaguuugauuuuuuuuuuuuuuuuggaaacagagucucacucugucuuccaagcuugagugcaguggcacgaucuuggcucacugcaaccuccaccucccagguucaagcaauccuccugccuuagccucccaguuaacugagauuacaguuaugugccaccacacccggcuaauuuuuauaaauuuuuuuguagacauaggguuucaccauguugcccaggcuugguuucaaacuccugagcucaggcaguccaccuuccuuggccucccaaagugcuaggauuauaggaacaggcaugagccaccacgccuggugaagucauauauauauauauacauuuuuuuuuucuguuacccagacuggagugcaguggcacaauguuggcucacugcaaccuccgccucccagguucaagcaauucuucugccacagccuccagaguaguugggauuauaggcaugcaccaccacgccuggcuaauuuuuguauuuuuaauggagacaggguuucaccauguuggccaggcuggucucaaacuccuggccucaaacuccacccaccccggcuucccaaagugcugggauuacagacgugagccacugcacccggcccuaagucauauauuucaacucccuucuuauucagaucaaaaauuuaaguauagagaguuuuguuaaauucaguauuuuuauuuuuauucuuauuuauuuauuuauuuauuuauuuuuugagaggcggagacuugcucugucgcccaggcuggagugcaguagugcgaccucaggucacuacaaccucugccucccagauucaagcgauucuccugccucagcuucccgaguagcugggacuacaggcgugcgccaccacucccagcuaauuuuuguauauuuuaguagagaugggguuucgccauguuggucaggcuggucucaaacuccugaccuaaggugaucugcccgccucagccucccaaaguacugggauuacaggcaugagccauugugcccagccaaacucaguauuuuuaaauuuuauuguauauauuuguuaugcaauaaacauguaaguuaauaaaauuuaaauuucauguugugaagaauauaagcagaaucucauuauaacaaaaaaucaggcucggugcaguggcucaugccuguaaucucaacauuuugggaggccaaagcaggaggauugcuugaggccaggaauuugagaccaguccagacaacaaagcaagaccccuauuucuacaaaaaaaauuaagucccggugugguagcucaugcccaaaaucccagcucuaugggaggccaaggcgggcagaucaccugaggucaggaguuugagaccagccuggccaacauggugaaaccccgucucuacugaaaauacaaaaauuagcugggcaugguggcucacgccuguuggucaacuacucaggaggcuaaggcaggagaauugcuugaacuugggaggcggagcuugcagugagccgagaucacgccacugcacuccagccugggcaacagagcgagacucugucucaaaaaaaaaaaaagauugaaacugaaaaucauaguaggccaggcgcgguggcucaugccuguaaucccaacacuuugggaggccgaggcgggcggaucaccugaggucaggaguucaagaccagccuggccaacauggugaaacccugucucuaauaaaaauacaaaaauuagcugggcaugguggcaggcaucuguaaucccagcuacuggggaggcugaggcaggagaauuacuugaaccugggaggcagagguugcagugaaccaagaucgugccauugcacuccagccugggugacaagagugaaacucugucucaaaaaaaaaaaaaaaaaaaaucauggcaaaaaaggacucuguauuacaggcccuaaauccauuuuccuuugacugucaguacagaggacuuaagucacuuauccaaggaugagcagccuaauaugucucugugagaaccugaauccugauuccugauuuauuccucauuuauucaacauaagagugcuuacugggccaggugcaguggcuuacgccuguaaucccagcacuuugggaggccaaggcggguggaucacgagguuaggagaucgagaccauccuggcuaacacggugaaaccccgucucuacuaaaaauacacaaaauuagccaggcguggugguaggcaccuguagucccagcuacucgggaggcugaggcaggagaauggugugaacccgggaggcagaggcugcagugagcugagauggcgccacugcacuccagccugggugacagagcaagauucugucucaaaaaaaaaaaaaaaaagugcuuacuauguacuggguacuggugaaguuacuggaauacauucagcagggaaccaaaaauacaaaaauggucuuugcacuccuguagcuuacauucuacuucaggaagacagaaaauaaacaucugaacaagucaaaagaaaguuauguuagguucugcaggugcuauggagggaaaaaaaaaaagcagggaaaggcagguagggaaucuguugauagugugggggaaaugcuauuuuaaauaggacagucagggaagaagucuuugauaaaauucaguugaucagagaucuuagggggaugaagaagcaaguuacacaagacauuugugggaagaauauuccaggcuaaagaaacagcaggugcaaaggccagaggcagguaugugcuugguauguuaggaacagcauccaggaggucagcauagcuggagaggaaagagcgauaugagagguaaggaggcgguaaccucagagaggcaggguuaagggguguuuaucauguaggaucucaaaugccaguguaaucacuuuggcuuuuucuuuuucuuuuuucuuuuugagacugaauuuugcucuuguugcccaggacggagugcaauggcgcuaucucuguucacugcaaccuccaccuccuggguucaagugauucuucugccucagccacccaaguagcuaggauuacaggcaugcgccaucaugcccggcuaauauucuauuuuuaguauagauggguuuucaccauguuggucaggcuggucucaaacuccugacuucaggugauccgcccgcacuuuggcuuuuucuauaagaaggaagccacuggaagguuuuuuguuuuuuggcguuuuguuuuguuuuguuuuguuugagacagagucucacucuuguuacccaggcuagagugcaauggcgcgaucucggcucacugcaaccuccaccuccuggguucaagcgauucuccuaccucagccucccagguagcugggauuacaggugcccaccaccaugcuaauuuuuuuguauuuuuaguagagaugggguuucaucauguuggccaggccggucucgaacuccugaccucaggugauccaccugccucggccuccaaaagugcugggaugagagguaugagccaccaugcccggcugccacuggaagguuuugagccaaggaaacacaugauuugacguccauuuuuaaagcaccguucuggcugcuguuuugagaacaaacuguaggaugggggagaaaaguggagaaggcaagagcagaagcucucuugcugugcuucauccuguucacuuaucugucuuuaaaaguuuguuuauauauaacuuaacugguuuuuccugguugaaacaggauccagaggucauuaugugguauguuucauccaucagaaaugagaacagcaaacagacuagcguucuuccuauccuauuuggagaauucuuuuuucuuucccuugauaauuauauaaacauaagacauuaacacccauaucaauggucuguauuauggagaggcaagauguuuuugcaagaucgucauucccaucuccugaaacaggauuccuuaagucuagaucuggagucuccccaugcucuagagacccuagccaugugccagaaucugacaggagcugguagcagaguaccucagcccuuaggugugaacuucaccacagcagguucaugucagcucaucuaaggaauggagugggaaggcuccuccuaguuuccaguguauguccagguagaguuuaucagguuuaaaaaguuacaggauccugauuugagcuggcaggguuaaauauaugccuuuccauagguccaguucaccuauacauuuagaugguuugguuuagcuuuacuuaaagucaaaggaaucucuguguuuguguuuuugcaagaaacugguaauggcuugccuaguuucuucucuaguuucuuagggcaaaggaaugaguuuugccaaaauuuuaucuaggaaaaauggaguaguuuucuaagucuuacaggacacugucaaaauauggaaaucuauuuuauugccuuagggaauucuuuuuuuuuuuuuuuccuuuuucucuagguaaaggagaucuucaggaagucaccuuuccugguaccaaagggcaguguuagcaucauggauggauccgacgaaggugggagagguguugauaugcguuccagggggagaggggcaggaucagugaaagaucuaacuaaaggaacuggggccaggaauaaacagaaggaaugagauagcaggaaauagaagacagggagaagggaacaugugcucuagacauggaauuuagagaggaaaaaaaaaaaacaagguuggggccaggaaagagaaaaaaugcucugggaucuaauccuugucuuucuuucuuuuuaggcauauuagcuuggguuacugugaauuuucugacagguaauacauccucaaguuuaucuuuagagcuuaacuagcuuuuacaugcauagucagaggaguaaaagccuuuucuuucauucuguauuguuucuucuucuuuaaaaaaggaaaagaggcuggguguggcaguucaugccuguuaauuccagcgcuuugggaggcugaguugggcagaucacuugaggccaggaguucaagaccagccuggccaacauggcgaaacuccgucucuaccaaaaauacaaaaauagcugggcauggugguguguaccuguagucccagcuacucaggaggcuggagaaucacuugaacccaggaggcagagguugcagugagcugagagccgagauugcgccacugcacuccaggcuggaugauagagcaagacucugucuccaaaaaggccuuccaaaaaaaaaaaaaacaccugccuugaaggccucugcugcaacaagaguccuuccgaguugacauucaccugcagccuuggggcuggggagcaguggaguauguauggaauaccuucaguguaugauaagagcaagagagacaaguguugggcugcccaggaugucgaggcuauuuagagcuggcucucauuugacaggucagcugcauggccacagacaggagacuguggggaccuuggaccuagggggagccuccacccaaaucacguuccugccccaguuugaggugagucauuuaaugaagaucugguuagaagugcacuuggcaggcguaucauggugccaagaaagaggcgccccauuuucagccagcagcucuaccacgcuuaggcagagucaagucaauuaauaacuaggugaauguucccuugccaucucacuguucagaaucccuucguuuccucaagccuagugagauuagccccuuaaucugucuucaucucugauuuuuugcugggagggacgggugguggugugaacaucuucagguaauuacagauccugaauagucuuuuugcuuuuucugauuugcagaaaacucuggaacaaacuccuaggggcuaccucacuuccuuugagauguuuaacagcacuuauaagcucuauacacauaggugaggacggggacagggaagaagaauauuucauguuguaugauucuccuaacuuuccaaagcauucucaaaucuguuauuguaucugauuagcaaaaacaaagucugugccaauucccuaaggccuaucaacugaaacccgguccacuuacaaagccggaggagccuaagaggcuucuccauucuuggccucaaaagcauuaauauaugacuuaagagucaaaaguuuucggcugggugcaguggcuucaugccuguaaucccugcacuuugggaggccgaggugggugggucaccugaggucaggcguuugagaccagccuggcaaacauggugaaaccccgucucuacuaaaauacaaaaauuagcuggauaugacagcgcacaccuguaauccuagcuauucaggaggcugaggcaggagaaucauuugaacccuggaggcggagauugcagugagccgagaucacaccacugcacuucagccggagcgacagagcaagacucagucucaaaaaaaaaaaaaaaaaaagaaucaaaagcuuucuguagggagaggacacuucaagaaggcucaggcaaagcuccuugccagcuccuuugagcuggccuucagagguucagaauccagccuggaaugugaucccaguuggggcuaggagcuaagcuaaagagagcuuuucugggaaugguuccuagugugggacccuaggaauugucacugucucuggccuuugaaugauaacuguggggaauucuuacugcauagccuugauccaaacugugcagaaauuaccccuuguugaccacaggagaugaauaugucacagacagaacaagguuuucaucuuuccagagggacacaggaacaauguuacuuuugaaagagguagcuuuaggcuagagaacuucaggaccagcaugaaauuagucaauccuguauuuuacaguuaccugggauuuggauugaaagcugcaagacuagcaacccugggagcccuggagacagaagguuugucuggguaccugugcuggggggggauggugagggugacacagauacuccgcuugcuucuucccuuccuugauagccauucuaugaaggaaaagauuauguugaauugggaggcaaauguuguauaauggaccuaauaauggcaaacuccuuuucuaguuuauaaguucagaaguuuugauguauauuauuagccauuuuuagaaugaggucuacuuguucagggguaacagccuaugucuaggcagcugaagugucugcagaaaucccaggcuuuacgaauacauucagcaggagcuugcucaagcccugagcuuuacauuggaggcacaggaagcagagucuguucuacaugcagguggaacaacagaguaacuccauugaucucuucacaggucaggcagaacuggguucagucccaguguugugauaugaggcaaguaaccuaucugugccccuuuccucacauuaaaugagaauuugcauuuaaggcacuuuguacaguaaucuguuauugggaugacaucuauuuugcauuucagaguauacaaaacaucuucaaguauauuuaauugaagccucucagcaaccagugaggaagguagcauagcauuucuuuccuguuuuuauaaagguggaaaguugcuguauugaagguuuuggaucucuuugagaugugaugaaagccauggaccccucugacaaaagcacauaugcaugaaaauuugcuucugguuucaggggguucaccaaccccacaaagccuaucuuugaacccugaguuaaggauuccugucacaggauguugucauggaauuaauuucauaggauuuuaaggcccagcccccauggugauucuuuuccaccucacuggcuucuugcuugccuuccucccucucucucacuuacuuaccucuuaccuugugcccuggauucuuucagggacugaugggcacacuuuccggagugccuguuuaccgagaugguuggaagcagaguggaucuuugggggugugaaauaccaguaugguggcaaccaagaaggcaagugauguuuuuucacugguuaaaguuacguuuacaauggaagcucuggaaaagucccaugggaaacuuuuuccagaacucaagagaagcuuaucuuguugcagggacuuauuccaaagaucuuggcaugccuccaaggacuaaugugaagugacagugaacaaagcagcugucauucugcaucagccaagugucauggacccauuagauaccugcccuuagccaagugcuguggugcacaucuauuguccuagcuacuccaaagguugaggcaagaggaucacuugagcccaugaguucaaggcuauagugcgcaaugccacugcacuccagccugggcaacagggagacccuaccucuuacaaauuaauuaagaagcauauucuaagccuaggucuaaugcagcagugugaaagccuguuuaguuaaugguuagcuauuuaaauuauaguaaaacuuaaaaccaagacaagaaugauucaucuucuuauaaaagguauauaccugaauaucaaggaaugaaccugaauucccagugaaggaagcaggcgagcccuuuagcuacuugcuuacaaaugcuauggaauguaaugcuaggcagcagcacaagguuggccaugaucuggugaauacagauuaggcaggagagcggccauggagaaacagacuggugaggcugcagacguuugcucaucuuuguuuugacgccucuugucccaagccucagccuucuccugcuuuccuugaccuuccugcuguucccucauugucuccagcagccugccucagagaguguccccuucccccagcgucguucucaccuuaccccugugcaccuuugccuggcaggggaggugggcuuugagcccugcuaugccgaagugcugagggugguacgaggaaaacuucaccagccagaggagguccagagagguuccuucuaugcuuucucuuacuauuaugaccgagcuguugacacagacaugauuggugaguucaccccaggugucaguccagagaggaagguggauagggcugugguggggaaggucaaggagaaagagcacuugaggugcuuugucggggugauuacccaccucuuuucuagucacucgaacaaaaggguggaaaugacuuagagucuuuuggaggugagagaugaccaaaacaacuauaugaggucuuuuuuuuuuuaacauguuuauugagguauaauuggcauacaauaagugcacauuuaaaguauacaauuuaaguuuugucauguauacacccaugaauccaucagcacauugaagauaauaaacauauucaccacaaaaaguuuccuccugucucuuuauaacuuuucuucuuaucacaaaagcaguguuuuugccuaacugugaaaguauauguaccugaucugucauggccugagagagaugaauuaauuuccuauuauuguggggguuuuguuguuguuguuguuuugguuuuuuguuuguuuguuuguuuuuugagacagagucucacucuguuacccaggcuggagugcaauggcaugaucuaggcucacugcaaccucugccucccggguucaaccgauucuccugccccagucuccugaguagcugggauuacaggugccugccaccacacccggcuaauuuuuuuuuuaauagagacgagguuucaccauguuggucaggcuggucuugaacuccugaccucguuaucugccuuccucggccucccaaagugcugggauuacaggcaugagccaccacacccggccuauuguguuuuaugggucuguuuuuuccauugugguuaaauauacauaacauggaauagauuguaaauaaguaaauuagguugcauagauuacauuauguacauguguauauaaugaaugaaugaaugaauuuccuuaugcuuccuugaaggcguuuugauaucagauaaucuucuguuuuauuucagauuaugaaaagggggguauuuuaaaaguugaagauuuugaaagaaaagccagggaagguaagugucaggggaagcccuugaagguaagccugugagacugccugccuacucuagugaccuaaagugaccuaaagcaccucagucagcucagaaggccuaucagaaggcuaguuuccuuucugagucuuccagucuuugcuaaaaguuaaaagcauugggugguagccaggcaugguggcacgcaucuguagucccagcuacucagggcgggaggauugcuugaggccagaaauucaagguuauagugcacuauaaucacaccugugaacagucacugcauugcagcuuaggcaacauagugagaccucugucucuaaaaaaauaaauuuuuuuucagcuuuaugcagcauagaauuaugggcaagaauaugggaauacaagagguuuuaggaggccgggcacgguggcucacgccuguaaucccagcauuuugggaggccaaggugggcggaucaccugaggucaggaguucaagacagccuggccaacauggugaaaccccaucucuacuaaaaauacaaaaauuagccaaggaagguggcaggcgccuguaaucccagcuacucgggaggcugagguaggagaaucgcuugaaccugggaggcagagguuguagugagccaagguugugccacugcacuccagccugagcaacagagugagacuccaccucaaaaaaaaaaaaacaaagaggcuuuagggcuuuagggaaauggugaagaccuuuuuuuuccuucuacauuucuugcuuucuuuuuuaaauugaaauaguguuaucaguguuaaugaaacacuaagcaucaaaagacaugguaaauagccacagaggcuuccuugagaggaucaaaacuaccaagagagcuaggcacagugguucgaccuguagucucagcuacuugggaggcugaggcaggaggaucgugugaacccaggagcuugaggcugcagggagcugugaucaugccacugcacuccacccugggugacagcaugagaccuugucucuaaaaaaaaaaauuaauaaaaaguuuuuaaaaauuaaaaaauaaaauacaaaugaucuuaucgaguagcccacaguaggguuaaaugauauuucccugucuucugggccucaccauuaauaauagauaagggauuuagaacuaagcccccacaauaggucauagaaacuuagcaaauaaacuagagcccauguaaaugugaauagauaaucauaccagagaugugcaaguucuucagaagcugcggucuuacagaggcagucagugcagucuagucucugagaugccuaagcauuaaccaaagggagacuucugcuuugcuuauucuucuucucccccuaccuuuuuuuuuugagacagagucuugcucugucacccaggcuggagugcaguggugagaucucggcucacugcaaccucugccuuccagguucaagcgauucuccugccucagccucccgaguagcugggauuacagcgguacaccaccacgcccugcuaauuuuuguauuuuuaguagagaugggguuucaccacguuggccaggcugaucucaaacuccugaccucaggugauccacccgccucagccucccaaagugcuaggauuacaggcgugagccaccgcgccuggccccuauuccacuucuuucuaagagaaaauccuacaccucucaguuaguugcaaacuugagcuccacuguuuacucucucuuucagugugugauaacuuggaaaacuucaccucaggcaguccuuuccugugcauggaucucagcuacaucacagcccuguuaaaggauggcuuuggcuuugcagacagcacagucuuacagguaagagacaggacaccagagucucauaacagcccucuuuuguggggguugagaaggaguaagagcuuguucaguaaucagaguagcuagaagugaaauuaugagguauuuuuguuugggcuauggacaagguacugugcugggcaccaugaaugugggaaauuaucucaaugcaaugguagccuccgaguguauuaccaggcaagcuaucgcacaggucacagaacagaaagacuagcagcccaaauuaagaugccaagucacaugguuuauuuauuuauuuauuuauuuauuauuauuuuuuugagauggagucucgcucuuguuuccugggcuggagugcaauggcaugaucucagcucacugcaaccuucgccuccuggguucaagcgauucuucugccucagccucccaaguagcugggauuacaggcaugcgccaccacuccuggcuaauuuuuuuguauuuuuauuggagaugggguuucacuauguuggccaggcuggucucgaacuccugagaacuccugaccucaggugauccgcccaccucgaacucccaagugcugggauuacaggcgugagccacugcacccggcccacaugguuuauuaaaucaguuuagaacucagggugagaagcaaggggaaagaguuggagaggugaacacagaagacacggugcaagcaggaugcaagugccacacucucugaaucuuggguuccauuuguccuagguuuauauguccugccugucucugcugcuaauagagugguuacacauacuagagcugaaguucggucaugggagcacaaagacaaaaggugccugaggccaccacacaaacuugcccuauuuggagaggccccaggggcacacacacauggccauuugcauuagcucagucauuagccuauaagauggguuuucuuuggcagaggacaugagagaccaagagggugucaccagugaguggcuuauuuaaggccucaugaacacugaaugccucaugcauauguaaugugucauauauauuucaugugugccucguauauuuaaugccucuugaaucuuaggucuuucuuuguccuccugucucucuccaucuguuucaguaccugcaggcucuacuuuaucuguaguaaguuauuuauccccaguuuugggcacagugucuaggcucuauuacaucaggucaacacagaacaaucaacugguuuauagacuuuuuugguggugguagcaucuuuauccaacaaaaacuuauguagaauaucaguaauacagccgggccugauggcucacgccuguaauccuaacacuuugggaggcugaggcgggcggaucaccugaggucaggaguucgagaccagccuagccaacauggugaaaccccgucucuacuaaaaauacaaaaauuagccgggcgugguggcaggugccuguaaucccagcuacuugggaggcugaggcaggagaaucacuugaaccugggaggcagagguuccaaugaggagagaucauaccauugcacuccagccuuggcaacaaagagcgaaacuccgucucaaaaaaaaaaaaaaaagaguaucaguaauauaaaacugguaaaaguggaacuauucugguugaagcagagauugggggccugaaacuccucuaucauuuggccucccuuuuuccuucgaagcauuucuaagaaaccccuaaaauucugaagaaaacaaauugauaaaccgauaaacacuaaucuaauccucuucuuauauaguugaggaauuugggucuaaaguuuugcccaaggucacuaagcuaauugagauauguacuggcuuagaaugucuuaaguucccuguuugauuauuuuuuucuuuucuuuuucuuuugagaccaaguuucgcucuuguugcccaggcuggagugcaauggugcaaucucagcucacugcaaccuccaccucccggguucaacugauucuccugccucagccuccgaaguagcugggauuacaggcaugcgccaccaugccuggcuaauuuuguauuuuuaguagacacgggguuucaccauguuggccaggcuauucucaaacuucugaucucaggugauccacccgccucagccucccaaagugcuagaauuauaggcaugagccaccacuccuggccuuuuuuguucguuucuuuuuuuuucuuuuuuuuuuuuuuuuuugagacagggucuugcucugucacccaugcuggagugcaguggcaugaucucaguucacugcaaccucugccucccggguucaagugacccucccaccucagcccucugaguagcugggauuacaggugugugccaccacucuugucuaauuuuuuuguagagacgggguuuugccauguugcccaggcuggucuugaacuccuggccucaagcaauccaccugccuuggccucccaaagugccaggaguacaggcaugagccacugcgccuggccccauguuugguuauuauuagugcuuaggaagaggcacuugcuuacauaguaggaguugagaagcuugguuuguucuuuccuaccccuagaucuauucucaccuccugaccaugcucuuucugccacaucuauuaucauuacaaguugccuuaucugaaauuagugaaucagaaaauaaagcaggggauacuuuguguaguuucaacguuagggaaaguucagaauacugucugucuaaacuaucucucuagaaggccugaugggccacaaccugggccagaagcauucaguucagauaugagaaugguggguguaggggcaauggccaaugggccauggccggaaggaaauuguuacagaguagugggaagccugcaaagacuggcuucuguccguuuugccuugguuugcccauguggauauucuuugccaauauuuucugcccaagagcugugcuugcuagaguuggaaacuggaugaaaaggugaagacuuuuuuucuucucaacagcucacaaagaaagugaacaacauagagacgggcugggccuugggggccaccuuucaccuguugcagucucugggcaucucccauugaggccacguacuuccuuggagaccugcauuugccaacaccuuuuuaaggggaggagagagcacuuaguuucugaacuagucuggggacauccuggacuugagccuagagauuuagguuuaauuaauuuuacacaucuaaugugaacugcugccuaaccacucaagaguacacagcuggcaccagagcaucacagagagcccugugagccaaaaaguauaguuuuggaacuuaaccuuggagugagagcccagggacaggucccuggaaaccaaagaaaaaucgcauuucaacccuuugagugccucauuccacugaauauuuaaauuuuccucuuaaaugguaaacugacuuauugcaaucccaagacccaucaauaucaguauuuuuuuccucccuauacagugcccugcccacccuuaucugcacccaccuccccugaaaaagagagaa

SEQ ID NO: 192375 - RNA, 13442 nt, Homo sapiens
ugcagaagacaagacaaacgaguuuuuauuuauucaagaguaaauuuccagguguagaaagaggccacaaguuaauguuguuaaaaaaaaaauuaaacaucugcuaaccaagugcugcauuuaaugaaaccaccuaagacagaaaaagagacaugagacaaccacugagaaccagccacccggagcucaguuucugcuacagagcaccuccucuucaacgaaucacuggauaccauuggagagcaagucacuguuguugaagcagcagagcuggaggugcugucaagagucucagcagacucauuggccagaugcaccgaacucaaugaggcacuuagagaugagaaaccuguggauguaaugucccagcucaguggaagugguuuggaaccuuuccuccacugucagggcaauaacccuagggcaaguuaucagacauuccuaagcaaccuccuucagguccugucuggcuggaccuuccuuacuccgacagaaaaaaaccaaugaagacaguuaaaucaaucucuacagucucacucucucuucuuuccuucaaccuuuuuuuuuuuuaacaaaggauauuacaaaggcaacaguucugagcucucaggaaauagggucucagaugcuuuuagagguugagaggcauaaaacagcagucuugaaauuccuuuuaucuuauggcacugauuuaguuucagucugauuucuccuccacuuucuucccuccacccaugcccucucacccccagauagacuuacgaucuguacugggauuucccagcagaagagacuuugguuuuugucauccugaaguugccacuccaccaccaguuuuaucuggagaaagagaaaaauaauugagaaaaaugaaaauaggaccugacuucuauccauaauugguuuaacuaugaauccuagauguacaguagcaaacuuccuaacuccucauacuuuuuuucuuaaaucaugagggcugcuuagcaugugggcacagcuuacagccuuaagagagugaacaaaguuauacuugugauuugaugcuagcagcaccacauacuaacuugguuaauuuaucaaauguaauuucuaaagcauucucuucucucuuagaucaauggcauauaaaugaagugauacgguuugguuauuugucccuuugaaauuucauguugacaugugaccuccaauguuggaggugggccuggugggaaguauuggaucauggaggaagaucccucaugaacggcuuagcaccguccccuuggugaugagugaguucucacugacuucacaugagaucuggcuguuuaaaagagucuggggccucccccuucucuuucuugcuuuagugcuggccaugugacacgcuggcuccccuuugccuucuguccuaacaguaagcuuccugaagccucaccagaagcaggugguggcacuaugcuucagguacagcuugcugaaccgugagcugaucaaaccucuuuucaaguuacccagucuuagguauuccuuuacaacaaggcaaauggacuaacacaugaaggcuuacaugaauaauuucacauuuaagcaauuucucauguauuuggcaaucugauccagcuuuuucccaauguaaccaugaagagcagagaguaaaaaaaauuuagauucuuagguauaaggaaacguucuuguuagcuagaaauggaaaugucaaagcacaaaagauggccuagagaagucuguagcuguaugaauaauuucaaggaugacaaccuuuuguagcaauauacuuucaguuaacgcccuuaaacugcuuucuaauaauguacuucaucagaaaucccugccuugacuuguuacacucauaucacgugaguggucccuuccaauucuugauaacucacugacacucugcagguccuuucuuauguggacauuagcuuacuugucacuaguuacuaccucucuuuuguacucuaauguuucuucacaauggaacaugugaguggcacugauauucagguucuugaaacuugccuugugaguuuuuccagacuaguauacauuaacuacugcuucauuuagugcuuaagcaguuugagcuauuuuucaaauuaaauguaacucauuuaacagacaauaacuaccauacauuaaguaccuacuacguaucaggcucugacuagucacugcauacguaacugagguucagacaugcccaugguuauguggauauucaucuacuaaucugucccugaccucuaaggucuccaacagcccuuaagcacagacauccuauauuugagucucuuuagaauguucuuuaauuacuuaccuuuccuagaaaauaaauggccagauauugcuccugaguucuacuugauuucaagaaaugcggcucuuuuucuucauggaaaaaggccaucccucuauuuccuccauucuuaucaagauacauaucuuuaauacagguccacugcagcaggaucuaccuuaugagugcuugguagaaaaagagguaggugcagcagggaugggucagaggugaagguggggauuggagggcagaaagaaggcuggaaaaagcuaccucucugccauggagcuaacaaacuacugcucucuuguuuuguuaagagauuaauggagaaaccaggauuuucugaugacaauguuaagacaacuuggaucuuuaauuauuugguaccuggcuaaaaucuuuuaacauugcacaggcuuuggaguuauaagacccagcucaaaaccugggcuccacugcuucuuaguggaguggacucuguucauauugcauaacuucagaggcucaaauuucuucagcuguaaaauagagauaauaucaccucuacauaggauggucaugagauccaagugaaauauuguauauaaaaauggcaucagccguugcugugcagagccgaagcaggagccgcagcugggaggagggaggagggaggagggaggagggaggaggagguggaggaggugccagacugggggaaucaucaguauuuaaacagaccacaucacgggugagcuagugguccuugguucaggagguguugggcagucugcucugaugguucaguuuguucagggaauuuuuguugaaaaauaugacccaacgauagaagauuccuacagaaagcaaguugaagucaacugccaacaguguaugcuuaaaauccuagauacugcaggcacagggcaauuuacagcaaugagggauuuguauaugaagaauggccaagguuuugcacuaguauauucaguccacguuugacuuacaggaccugagggaacagauuuuacugguuaaggacacagaagauguuccaaugauuuugguuggcaauaaaugugaccuggaagaugagugaguaguuggcaaagaacagggccagaauuuagcaugacagugauggaacugugccauuuuagaauaaucugcaaagucaaaggucaauguuaaugaaauauuuuaugaccuggucagacagauaaauagaaaaacaccaguggaaaagaaacagccuaaaaagaaaucaugucugcugcucuaggcccauagucagcagcagcucugagcuagguuacaggaaugaagaacuauugccuaauuggaaagugccagcauuccagacuucaaaaaauaaauuugaagaggcuucuccuguuuuauacauuaugugaagaauuuagaucuuauauugguuuguauaaguucccuggagaaaaaaaacugcucuguguauaucucuuggaaaauaagacauaacagaugugaaaauauacuugacucuaauaugauuauacaaaagagcauggaugcauuucaaauguuagauauugcuacuauaaucaaaugauuucauauugaccuuuuuaucaugauuccucccuaucaagcacuaaaaaguugaaccaucauacuuuauaucuguaaugauauugauauugcaguagauaacuuuuuugaaucaauuaccucauuuuauauuuuaaaaauuauggaauauccucugucauuauauucuaauugaaauugugcauaaugcuuuggaaaaaugggucuuuuauaggaaaaaaacugggguaacugauuucuacgacuuucaaagcuaaaauauacaauauacuaaaccaacucuaauauugcuucuuguguuuuacugucagauuaaauuacaguucuuauguaugauuaaauuuuaguauauuaaaaaacaaauggcaucauuaggcccaggcuaaccaucaggucauagugaaagaaugaagagacacagagaaaaagaccugcccuaccuccugaugccuaacaccgcaccuaucuccuuucccucgggcuucuucuucaucauagagauaaggggcccuuuacccccaucucugcuucuugcccacugcccucagaacucuaauccagucccaaggccucccguguccucaauaaugguaucacuuacagagggauauucgcuuuucacugguaguuuauucagguagcuauaggucuugucuuuuuggauagggcaguuaauuccacucuuacaaccaucaggcucaggaaugggaaagggaacugggacgcccaucaggaugccaugcaccacggccuugcugcuuuuagacugaauaucuaagagaaaaaaagagaaucagauggcaaagaaaauaaccuauuuucaaacucuaaaucaaaaauucagaaauaaucccaagcaacagcauuccuagggucuauuucucuugauaguggugcuugguacuagcacagugcaagcauucacuccaaacacaauuaugcaaaaaaaaaaaaaaaaaaaaaaacaaucagcagaaguuuucuuugcucuuaaccuugcucuucauggcccuucacaguuucuuaggagaaucagagauaccuggauaaacaaccuuaucuaacaaggcaacugauuuuuggcaguaaacuuucuguuugcuauuuauaucagcuucuguccaaguauauugugugucuuaaaugucauggucuguaacaacagugaaagagguaacccuuuagcaggguaagauuaggcuggaucacaguagcucccaccuguaaucccagcacuuugggaggcugaggcggguggaucaucugaggucaggaguuugagaccagccuggccaacauggaaaaacccugucucuacuaaaacuacaaaaauuagccgggcgugguggcgcaugccugucaucucagcuacucaagaggcugaggcgggagaaucgcuugagcccaggaggcggagguugcagugugcugagauugcgccacugcacuccagccugggugacagagcgagacucugucacaaaaaaaaaaaaaaaaaaaaaaaaaaaaaagaaauuggguaagauuagaaagacaugcaauucuuuauaaacuuuacccuccacaucacaagauggccaggaggaauaaagguauuaaaaaaugagggcaaucagacuuaugaguuauuaggguauuuuggagacccagaaaauugguucuguuucuuuccuucugucuggguuggggaugacuuguucagaaggcuuuuuuuuuugguuuggaacaauagagaggccaggguauaguccagagaggaaacagggagcuaguacuuagagcugucuuuaggcuuaugaacaaaagaugacaggaacuuugagguuucuuauuagacugucuagucuaguuucacaggacagaaaaugaggaaaagauucaaggaacaugcccugcuuaguaauaaaagauuuuacauuugucuagauucuuaaaaaucucaaagugaugugguacaagaaagcaaaaaguuccaaugauauuucuugaauauuggagaagaaagcucagauuucuuggcuauuucuuggguccccaguggguucccuaaaucuuaaggaggcuguuaaguauuaguugcaccuuuauuuucaggugggauguagacuuaauagcugaaaggcauuacugcuuaaaacaacauuuuggaggaguuccaaagcuuaaagaauugggguccauacuaauacucugcagucuguagcuaaacagagcugacauucccaucauagccuacuaugcaauaugggucaagacagaaaagccaagcugucuucucuaaccugugaacacauggacaucucccuguuugcuuaaagggagucugggagccauggacccugcaugagaaggguguccaagggcacagugaacccuagcuuugcaugaggugcaaaagaaaucauaaaauucaugacugccaauuccccuccccuccauucccaugcuuauuccaacacuugauauuuagguuaugcuguaacaugaauuugaguuaagagccacuuuuacgcacugcuggugaaggugacauugacgcuguaagacuguccuuugcucagcuggcaggguuggguggggcaugggcucacauucacuuccuuuauaacuccauccacagaaccugcaaaagaaaaaugaauuggaauaggagaauaggaggagaaauaagccagcuaggcugcccaccaccuaaugggaaggugcucugcucucccauuuagggucaacucauucuccucggacuguuucccaggauggaaucuuuaagaauaaugcccaauuagaagucagaaucuugauucaucuugcugcuaaaaucauagccuuuaauucagaugauaaagaagcuaguugguuuuuugaucaagagaaaguuaauauuugucaaacuaaauaauaucaagaccauauccauaaaugaucauauuaaaggaauuaaacuucaaucagagaaauuccaaacauuccuagagucuuaucucgcauucuuaaugguaagggucacaguuuaaacuuaaaccuugaagacguuugcuucaaccuuccuuuggaugaaaauauuccuauuuucccuuucuuuuucuagcauauagauuagcauguaaaucugaugaaaguuguucacuacaggaacaacuacauuuuuuuuuuuuuugagauggagucuugcucugucaccagguuggagugcaguggcacagucucagcucacugcaaccuccaccccccggguucaaaccauucccugccucagccuccugaguagcugggacuacaggcgagugccaucaugcccggcuaaguuuuuguauuuuaguagagacaggguuucacuauguuggccaggauggucuugaucuccugaccucguggucugccugccuaggccucccaaagugcuaggauuacaggcgugagucauugcacccucccuguuuuguuuuugugguuuuuuuuuguuuuuuuuuuuugagacagggucucacucugucacccaggcuagaugcaauggcacaaucucagcucacugcagccucaaccgucccaggcucaagugauccuccuacuccauccuccugaguagcuagaacaauaggcaugcaccaccacacccggcuaauuuuuguguuuuguagagacaggguuucaccauguugcccaggcuggucucaaacuccuaggcucaagcaauuugcccaccuuggccucccaaaguccugggauuacaggcaugagccaccgcaccuggccaaaaaccgcacuuuaugcggaaacagcuagaaagcaaauguagagccugaaacuccgcggaggaagaucagaaaugaauuacaacaucuuucuaccucaaguucuacaugagcaaacacugauugagggagucugcuauuauugcuuggaaagucugccagaucccaaaacagacugaaccuuucuugaaucuggcuucaagaguuuuuaguuccugaaucauucauuuuuagacucuauggaaauuguaccuugacuagcaagaaugaaggaaagcagaggcaucugaagaaaacaucucacaacaaugguauuuaucauccuuguuuuagggguuagaaaccagaagagcaaagauuacugagauuuguccaaggucacauugccuggaaggggcagaucgaagacucaaugggugggccugacuuggaagcccuuguuaccggaaccugaaagaagcuuuaaauacgcagccauguugaugaauggaaggacaccccaaggaaauuugcaucugagaacuacuugaggacucuggaugaaggucugucucaaacucaacuuuucagguuucuuaauucagcaucgccucuuugccccucaccaugauucucuuucuaucguagagguucaaccccuauauccucugugauuuucagugaugaaguaucuucuauccagauuuuguacccuuucucccaaacugcugguaaauccuuugcccaguauuuugucuuccuggaaucccuucuuucuuucaccccaacuugacuuccuagagaaauaagcagcacuauuaaagguauagguaaaacgaugaaaagugucagaauaucagucuuggcuuuuaaaauuaggcugauucaagggugggcaugguggcucaugccuauaaucccagcacuuugggaggccaaggcagguggaucaagagguuaagaguucgagaccagccugaccaacauggugaaaccucgucucuaauaaaaauacaaaaauuagccagguaugguggugcucaccuguaaucccagcuacucaggaggcugaggcaggagaaucgcuugaacuggggaggcagagguugcagugagccgagauugcgccacugcacuccagccugggugacagagcaagacucugucucaaaaaauaaaauaaaauaaaauaagacugauuccagaagccuacucacuuccgaguaagcagacuauggaauuuaagaggaacuaccacuuaacacugaacagaggagugacccuaaacagaaaaaccaccuaccaucucugaacuaggaaugacccuuaagagaggaacuaccucccacuucugaauugggaacugcaccauuuucacugcacuucugcaguuucuucaaugauuuaguccuguucuuuaaggcccacuuaugagucaugaaauauuuuggcuccaaaaacaacaggaaguaccuuaaaucuugacuaagguuguuaagaucuggauuuuuuccaagaaucaaggggaugaagaggaguacagagguuaaggucuuuauaguuucaguacaagcuuagggcacaaguuaagcuuaacuccaaauagcacugacucacacagccaagauggcagaagugccagcugcauuaaagaagaauacugcuaccugagucuggguuucauuuccucugaaauauuaacuuggccuaggucuauauagcugcugggaaugauacacuugcaaauacugcauauguuaaaaacauaaggaugagaccuaagaagguacuagaaagagucagaaauaggauuuaucccugggaauccucaaaacaaauacauauuuuucaaaauuaaaaaauuuaagaaaagaaauuggauucaucugacuuguccagguuguuucuaaguaguuucaaaaacugauuuuaagcacacaucugcaaucuacagauguauacucgauuuugggaaccugcguucuuaaaauaagugugugugugugugucuguguguguauguauguauuuuaaucucagucuaaccaaggacaaaaguacuuguauacaauaaaugcuugaccaaaaaagguuuaaauaaagccuuuaaaaaucccauuuccuccugccccagagacugggcaguugaaugggagagaaugcaggugaacugccugauaacagugccuguaacaggguaaguuaaguucugccauucagccaucauugcugagaggcagacucuggugccggaugccuggguuugaaaucucacuaucucugcuacuuacuguauagccucaaggcaagauacuuuaccucucuggagauaaugguguagcugagcuaacacaaauacagaucuuagguaaguguuuggaacauagugauacauauauuuacuauuauuaucauaucuggauuuaguccaugaguuuaaucuagaauagcugcuccuggguagguuagcaaguucccuucugacacaaaaacuggaccucucaccucaaauauacuuuguggauagaaauuauguuucuagccaauaggauggacucuuucugucucaaaaguggaaugcaugaagacagaggcaaacugcagguugagaguacauuaucugcuaugcagucagucaccagauuagcucaguacuauaaaaguaugauaugaacucagaaaucuaaguagauguucuuugcugccuguaccuacccuuggguggaacagucucuuuaacuaucaucacacugaccaacacugcuccagcuaggucaguaaauaguaccuugcaguccuuuaucccucagcuugcuucuccaucauugcaaaguucuuaaacugcacacacucuuaagcauccaaaacaguuugagaaacacucucuuccacuccaacccauuuuuggugaauagggaaaaaagaaaucccgaacuucaaucaacaaucuauugaaaaucagugcuaauguuaaggcuuucaauguccagcuuccaccugcuucuuucaaggcugagucacauaaucuaguaggaaguaaguaaaggguaguacuuauagcucuuucauccaguuuucugaugacaagagguucuuagacuuccagugucaauagaacaaacuccucuguucuaaccagcaaacauuacaaaauuaguuugcuugguccacuuucucacuugaggaaaucccacgccagggaagguggguguagaguggaacacaaaaaucuuugaugugggcacugaagucuuuauaucauauuucccaauucaaaaguaaauuauaaaucuguaacugaaacccuucuucccuuuaaaagcuucuucccauagguguacuccugcuuuuucaaauaaguagaauaauuucuggauuuauuucccuucuuuuuuuggaaacccaaaguggcucacaaagacccacgguuuccuaccacuuacugggugugagaucuugggcaaguuacucuaugugcuucgcuuuccucaucuguaagacagcuugugaggauggaaugaguuauuuuauuuuauuuuauuuuuuugagacggagucuugcucugucgccaggcuggagugcaguggcgugaucuuggcucacuguaaccuccaccucccggguucaagcgauucuccugccucagccucccgaguagcugggacuacaggugcacacuaccaugcccagcuaauuuuuguauuuuuaguagagaugggguuucaccauguuggccaggauggucucaaucucuugaccucgugaucugcccgucuuggccucccaaagugcugggauuacaggugugagccacugugccuggccggaaugaguuauuaaaauuaauagugucuucauccaaacgcuggcuacuaaguuuaauggagggaaaggcaguaauuugaagcgauaauagcuuucaagugccagucuccuaaaucaauggaauagcauuuaaguguuaaucggccagcacuccauuccuuaaucaauccuguccccuaauccccaacuuugcuuuugucucaacaugaauuuuuaugacauaggggaaaaagauuuccaucuauguuuucaacacauuucauugagcaguuacuauuaccugggcacuggauauaaagcagcaaacuuaugaaaccgccuuugcaaaaauccugaggaaauuaagacagugaaagagaucaggacucaccuacccaucuuccuucuaaccucuaaacugucuuuguucauuccuggguguaggcugaacuagucuuggagaggaauuuauaguuuaaacucugaaacgaaauggauaauagcccuuuccugaaaaaccccuucuugccuggggaccggucugccuuuguaggacuaacaaauuagcuacgaguuuaggggccacgccgccucuggcuguaagagucugaaccuccccaaauugcuccugguaaugauaucacuauuguaaaaccuaaggucagugcuugagauauuuugcagauccugcauuccgaugcagcaaaugacaccacccagaggucagcaagaagaacucacuucgacucuccuaugauuuuaucuucaaccugaccaaucagcacuccccacuuuccaagcccauacccgccaaauuauccuuaaaaacucugauccccgaaugcucggggagacugaucugaguaacaauaaaacuccggccucccccacagccggcucugcgugaauuacucuuuucgccacugcaaaucccaucuugauaaauccgcucugucuaggcaaugcgcaaggugaaccccuugggcgguuacacuuacucuggcuccccauucugcugcgugacuuuagguaggcuacccaacaucccuggaauucaaugauugauuauacgaucuccgugcuuccuuuccacucauagaucuuacaaagucaguuucaugccucuuucauugacaguucuaucucucuaucuccaccucugaacaacauugcucgaguuucuguuccgacaauucuauagacucgacucaaugaaggcacucagaauuucuaccaccuguuguauuuuccaacaaagauuccaaccacagcggcgagagggaguuauguaucacaagcugugauuagagacacaaugagauuuauacaaggaaaaacugauuaagaaucacaagauuccaaagcccaaaggaaguccuauuuguaacaauaaaugaugaaaaaggggaauugacuuuugacuugucagcaaaaacgaaauuaaaagaaaagcaaaaggaguuggaagggggaggcgggauuccaagauacaaagcauaaauaaaaagaaguucugugcuccaccccuccaccagagcuggauacagcccuucuguuguccgcccuacaaacuuuaggaaacuucagcaaaaggcccaccuccuggaguucccaggaaccccaaaacacgcguucuaaggaaagaaacaaaguugugcgcggucggguuucauggaggccggcgccuucucccccgacccagcccauuccaguuagguaggguccaaggcucagccuggccgcccgagggauccgcccagcccagccccaggggucucagcgcggggguccggcggggccuuccacagagggcgcgggaaccuugggcgggccuggggcucaccgcaguccuugaacugcaccgguucggccugggcagcggugcugagcgccaggagcaggaauguagcugccaggaaacgcaucgcggauaacgaaguuccaagcucgggaaagaagcagcggccgcccgcggucacaagacaaaccugucggggcgggcccggggaggagcccagucaggcgaccuguc

SEQ ID NO: 192376 - RNA, 10235 nt, Homo sapiens
uagaggccugggcuucaguuuaauucacgccaaauuucagcgcgggcauucuuuggagucacacacaacaaaagcggaugagaaaaggcacacagccuuccccgugguguuacggugagcacgccaggcauuuuaauccgcauucucaucucagccucacgacugccccgucacauagauaacaguauuccugcccacccugcuccccgcaucucccuacuccaccccacaugcgugugacagaugaggggacugagguggaacaaguuucagcaggaaggcagauccagggcuagaguucgagucucccaucuccucaauuaagacucucguuuccaggccucuucagcccacccagcuucugcuccuguggcccugugccaacggggcaggauuugggagcuaggcccucagcucaguggguguaucuggcugccggcaggggugagacaccuggaaggccuccaagaccagcagccucuuguugauggagcugaugguaggguagggggugagauccaccuugaaucuguaguagagaaacaccugcuaagcuaagguuuucagggacacagggagacugcccugaugcagcagggggagcagagaggcagggcuggaugaggucgagggagcuguccagggaaggacgauggggcagcccuuauucacaggggauggguaggucuugugcaguaucauuuggcaucuguuaccuacuguuccuauuucuuugugaaccugcuauguguaaggcccagugcuaggcauuuauauauacagacucucuucccccauguuguaagcuucuugggggcagggaaugugccauacguuuccauaucccuaacgccuagcaugaugccuuccagagaggugcucauuugugcccuaccaaaggguucacggaaggaugcagagguagagcucacuacugcucacagacacaccacauuugaggacaucaggcaggugcucuuggggguccaccaggugagccaccuccucuuaggagcuggggcuaucuauacagguucaucugggcuguggugggcguaguaggagcacugccccaauuucuucugcccucuuccaggcagaaguggcuauguggccuggcauggugggcuccuuggcugguuggcgaagcgucugcaugagaugcuaucucgccagcugaguggggccugacugugggcagagccacgagaagggaggguggcggggcucucucuuaccuuucagcauuugccaccugaggcaccaagcacagaucagccauggucaccugaaagaggucccgguggguucccaucagggugcauaccccagagucaguggcuggacuggguguguccacugcgacucuacuggggguaccaacaaucugcuucggcucuuucacccaucccaccuccaauucuugucugcccuaggccugcaugagucugucccccggagcugaagugcccucccaggccaugcuccaguugcccugacaaccaacucuguggguugagagggccagagaagauggauugccuugacugcgcagacaucaucuagcacaaucccucaacugaugcuggcccgccucauccucucacagccagucuucuaccuugaguaacucccucuuaagacgguuuagugggagugagcugaggagugccccauggcacagagaucccccugcagacgccuucucaggaagcucugagcuugagggaggucagcaugagggaggcagccacuguggcugggccuggggaggucuggggacagcuuaccucgucuccuacacaguauaugcccgcugugcucuguaggaucugcuccagggcuguggggaggccacauaaacaucuuauucugggcgcagggaggggacacaaagcuuucugggccuuggccuccauaguuaugaaaugggcgcccaacugagugacagacugggcauggcugcuggugagaauguggcagccaggucucgagagagcuguuagggaugagcugcuguuuccugaggcuccgcacagacaaucaccauuuccccacucgaguggacaagcccugccacuggccacggugacagcucucacucugauggcuggcgcugugcuggccuugguuucccagcuggaguaggcagugaagcugaaguugggccauccagcuaugaagggcugugggcucagggaccgagguucccagaagugcuggagcuaaggucuggaugcccacccagcccauugccuccccaguccugcccucauccaugcaacugucaggcccaaagcagccugggaggcugguucagauacccaggccccugugugcgagggccauaccucuaagaggccacuguggggcagcucacagaggugaggacucaccguuaaagccacaagugauggcguucugggcccaggucagcugcaucuccucucccacuugcuucaggacagacagguucugugcagcccaaagaaaaucugugauugcgcugacagcugggugggggcuaccccuucgccaaacccccucagggaaguucacuucccaucugccccuggcuggaugucuaucccuucucccccaggcuccaugagccccuuccuucaaccaagggcccugagguuggagggagguagccaucccagcagccaccuuugcaggcugccccaguggccucaaaaagccacgugauucugucagagaugugcaagaaucccuauucaugugacacaggacgcggccauggcuguggcaggugugcccacaacucgaggccugucucccucacuucucccuugcauggucccuugugaggagagggagugugaaagaggguggggcugggaugagggagguccacaagaccggcuuccagagauuuccagccuggcuccaucuuggcaccccuggagccauuuucccucuguuuccucauuauaaaauggagaugucugucugcuccaacauccuuuguuaaagcgacaugcggguagagggcauaggcaugcagggauucugacuuaguccccacuuuguuaugaccuaccugugggacuccuaagucacuccaccuuucuggggcuauuuccucauucagaguagaagcuggcacagaugaacuguuuuuaauacuuaguugucuguuuuaacagugacacuuaaaaaauaaaauccuacaaguaucccaguauaugacugagauagcacagaugaaacggaagcugcucugguuaaaggcaggaggccuggacuggggccugcucagucucuccccugccauucuggcccuuuccccaccccaagcaccuguacaugcguccuuggaaacuagagcuucucggaacgcagcgggggacccgcuggggggcugaauucugagauugcgaucuucacccccuucuuucacaugguccaggucagaggcccugagaaucccccucccucccuugacacccccgcccccacacugggcagcucacagccaaugugugaguguaagagugugucaggugugcaagggugcaaguguacaagugccacaccugcaggggcuggaugccaccagcgaugaggucagaaaucauacgcacgcuggcccucuucuuuggguccugaggcagaagucgcggagugggacgcaucuccucuagauacucaaugauggccagcuguccagaggggagcagugaggcagggagagggcccaggaccccuggaccagaggggacagggccagcaaacuccuccuucuccucuuccagcaccaucacuacaccucuuccccccugcuucugcucagcucaagcccuauaagccuuuuuggaccuuaucaugcagaacuugguucuccaugugcuugaaucuucccuuauuuuccuaaauaaccucgcacccuccccacgagucuuguauugagccucuccuaugugcuaggcaccuugacuguacacaggcgaggaagagaugucaggcgcucucauucagggcacugcucucaugagggcccucccccaggcccugcacucacugacuggugaauggugauuccaucaaucuucaggguuggcaccugcuucauaggauucagugccuggaaguccuuagaaaacuguggagacaaggcccuggugggcuggguggccuggccugaguuggccagaggaaagccaagcaagcaggagaaccccaggccugccacccacccccaucucccuucccugggaaggcccuaaauccuaggcccaggguaaucccugggggauccaugcagucucccaaagcccagcugcugcugagccauaggcuucauccuaacagccuggcuaugggcuuucccugcaucucacaccguggccaccaaggcagcuccuacccuagucagccauccagagggcccaguaugggguggggacccacuagccacccacccucccagggucaggcacuggagagcccaggcuaggguacacagucuggaccugggcccuucccaggccuccugcuacugcacaccuugccaccuugucccacaagggagagccagcagccuccugcagugauaguccacaagacacagguucacuucucuggggcagagccuccccuuuuuccccugccuggugccuguucaaggccuccaauucccacauuguggucugggcacagccuucuuaccuguuggcccccauccuuuaugagauugaugggcaccgucucguagucgaugccuuucaaggccagagcuaggagagaccgcacauagcggagucaaagaacagccucucgccguacucuuaaaggaaagagcccuucuaaggugacauuaaggccaaagagggggaggcuucucuaacacuucuggguggucaaggcucaccguggcacuauccccuucucucagcuuuccuugucaccacgugcucccuaccccagaugcacgaugcucugccucacucaccccugaacucuuagagaccucaagaucuggacccccccaauggggcccucaugcccccuggauggugauaaagguguaugcccuggcacucugugggcuccuggaguucagcaaggcuguguuguguuuaacucugcccccccagggccuuaaacaguggugaccagugucuugguugaagacaugcaauuacucccucaagaaggcaacuaagggccaagggaaggagcucagguggccacacacagcacacacagacagauggcacucuuguucuguuggagaagaaucucuuccaaucuauucucucuguucucagggcuguuuacuagagauucuagacaggcaucaggcucuuugguggccucagagcauuugccgugacuccagucaccagauuuccucuccaucccuuuugauaauuuccccuggcaagcugaggguaaaaaaaacuugggugggucaacacuaguggagaagacugcgugcgugugcaugcauguguguauuacacacacuugggcauucaaguauggugauggccaaucucagggaagggcaaaggaaugaggggaggaggaccagacaugucaugguguggagagccugggcaauaccaggcuccuccuaguguuggucagcuccagucuggggagugacaguguuuggggcuggaggagacaccuggaggagggaaggccaaagcacacaggccguacagacagcaccuauauugcuccggcuucuggcucagccagggcagagguacuggcgcccagggauggguucaucuucuuggaggaaaguuucuccuggcacccagugcucuugcuuacugaucccagcaaauaccaagugacuaugggauggaggaggggucacggaggauggcuuugccuccacacucuggaggcaagcuucuuggguucaaauuucaucacagucauuugcuaacuguguggcccugggcaaguaacuuaaugggccucuggagccagacuaccugguucaaauuccaguucugccucuuaguaacugaaagaucuugggcaaguuacugaauguugccuguuuuuugugccucagcuuccuccucuauacaauggggacaguaauaauaguaccucccuccuaggguugcugagguuuaaauggaaucaggcacacaaaagcacucagcacagagcuuuuccucaguacaggcugcuuugguuaugaccuuugccaaaggcuguguuaagccaagggagggaagggucaaacaaggacuagccacagggcccuuguuucugcuuuucugaagccuccgaggcugaugcuggcccguucuguuugcuuugccaguucaaauaaaauaagaacugagaagggccagcuguuccccugccaguuaccaggggcauguggauuuugugacccugcuuuaaacaugguugccaaggggcuuuggagagcaguguugggagaagugucagucccaagggaaaaaacaacccccuuccucccacccucacccuguguuuccgggguggagaugccaugcagggauggggguucuaggagccgggggaugcugguugcugggggugagguccucucugacagagcaacccuuccaucccaggccagcuuugcacccgggcuuauccgccccaguccaccccacuccagcacucauccuggaggaggcacaucucuuaccaauucgaacucuccaugagcaggagcuucggaaauaggaauagaggaugggcugaggagagagaggaugaaggcgcguguuaacccaugcugggugggcuccagcuugggaggagucaaccauuucuuccuguccugccaggccuccucucucaggccugcaucugugcaaaucagggcagacuccaagcucucugagaggcucaugaggucccuuggcuccaaaauuaugcugguuugagcuccugagguccaagaggcccccaaaggggcagcuagccugagagugccuuccauaccuugccagacucugucaugguaucguggugacccucagccucccaggaaauguccccucuggcacagcuucugagcagggaaaggaaaccuaaagggguggauuucaggagccaauggggaagcugggcuacccaggcauugggggaacuuugacucuggucagaaagggcauuucuggccaggcacaguggcucacgccuguaaucccagcacuucgggagccaagguggguggaucauuugaggugaggaguuugagaccagccuggccaacauggugaaacccugucucuacugaaaauacaaaaaaaaaucagccaggugugguagugggugccuguaaucucagcuacucaggagguugagguaagagaauagcuugaaccugagagguggaggucacagugggccgagaucgcaccacugcacuccagagcgagacugcgucucaaaaaaaaaaaaaaaaaaaaggcauuuuuuuccaacucgcaggaaguuucuuacgcuccugcuggggccagguuugguguccccccaacagagcguggccugguuuugaugcaguauuuugagugguggagcgggcugggagcuggcaucuggagucuggaccuggugcaggaaccagcucugcaugaccuuggacaaaccucugccuuuuuaaaucuucggcucccucauuuguaaaacaaagguugcccuaaaaugauggcagggcauccucuagcaaugcagcaagacaaggaauucuaauuuuuugacgcuuugguacauaucuccuucaaccccaccucccagcaguccuccgggcucucggcuguccccauaaaaacagcuggcagauaugcucacucaccccaaaggugaggucaaaagcuggcagcucacuggggcccuaucuggcccucagaauuucuguuugcucaacacaguaguuuaaaauguuucaaguaguugccaauguuuaaaaaucaggacauuucauucuaguauggugggucaugccuguaaucccagcacuuugggaggcugaggccagcagaucaccugaggucaggaguucgagaccagccuggccaacauggcgaaacaacauggcuaaacaaaaauuagccaggugugguggugugcaucuguaaucacaccuacuugggaggcugagguaugagaauugcuugaacccaggaggcggaggauacagugagccaagaucgugucacugcccuccagccugggggacagagcaagacuccaucucaaaauaaauaaauaauaaaauaaaauaaaaauaaaaaucaugauauuuuauauacaacaccuguuuguuuuuuuucuuuaaaaaaaucuggagacagauuuggguuccuaaauagcagcaauugaugggaacagacuaauggcccccaucaaccagcguaugcgcucucaggucugccauggcccauaucuggcccacuuuucucauuuuuguuaccuuugggcccuugggggcagcugggugugcgaucucuacuccaagguuuaaggggcucaaaguuaauuucucugguacuucuucgggagccagcauuucaaaguggaacccaggaaagacucgccagugauuagcacucaugaaucuucccaccaaaacauguguaucccuauggauaggggagaacuugaaagaacuucucagaugcccuguuuacuaccccucugacuauagacauuucaccaaagcucccucuccccucugccaccccuagcauauuaagcugcucucugaacuugcuauugccaucccuguacuaccaacucagucugcuagauggcaaggguguaagugggaaccuaggcccuuccaagaugguucccaagcccagcagucccagccuguccugaagguaccuuuuguggagaaaguaaagaugguccuggcacagaaagcaggugaugggcagaaagugucuuucgaagaggaggaauuggguggccacaacuggaucuuccuuauuuggagaugcaacucccuuuccuuaccuagccaggcuacagggacuccuggugccaagggacagggacugcuggugaccacuagaguguggcagacauuaauuagcuuagaaucccugaagaaaugccuuaccuaauggcuaaaugccuuuggauuacaccuuuggaucuguacuacgagugaccagaagcaugguaaaugcugcugcccuccgucacgacccacaagcaggaaaccugaaaucucuuaggcaauuucugccuucucuuaccagugauaacuauguaaaccaugccccguuccuuucugcacuuguagaacuaaacuuuaagcccaaguauccaucucaucagcacuccuagaagaccuguguuuccaauucaaauaugcauucugauuacuuuagcagauuuuauuuuuaaaccaugucuuacacaugauuugagaaaaagacuccuaaaaucccauuuggaagagggaggacuauacauuauuaacgugacgcaaagucccaucuaacgugccaccuuccuuagugccacaaaagugguucucaaacuucauggcacguuaagaaccaucuagaccgcuuauaaaaacaugcagauucucgagcccguuccaccagagaugaacagaguggcucuggagcaggccccgggaagaacaugugaaagccgugaagcuccccaggugauugucaugacugccucuccucgcucggggccuuuuuuuuuuuuuuuugagccggagucccgcucuuucgcccaggcuggagugcaguggcgcgaucucggcucacugcaagcuccgccuccuggguucacgcuauucuccugccucagccucccgaguagcugggacuacaggcgcccgcuaccacgccuggcuaauuuuuuuguauuuuaauagagacaggguuucaucguguuagccaggauggucucuaucuccugaccuugugauccgcccgccucggccucccaaagugcugggauuacaggcgugagccaccgcgcccggcccggggacucuuaaaauacaaacauuacuggaaggucaccuccugcuagggccaagagaagagcaugaagggcugcgagaaauugggaggcuuggggcgacguuuggaagccuuaguggagggaggggucuguuauggggagcagggagggcggagcagaagugaagcgcgaccggacagcgacuccacccugcuacgcacucccuaccaggaccgccuccucuggcccaacccucccgg

SEQ ID NO: 192377 - RNA, 60258 nt, Homo sapiens
acucaaaauggcggcggcggcgucagcaucagcggccuccugcccguaucuaucguggcggcgacgggacccgccucccugggcgccggagucaugugacccacacaauggcugaguggcuacucucggcuuccuggcaacgccgagcgaaagcuaugacugcggccgcggguucggcgggccgcgccgcggugcccuugcugcugugugcgcugcuggcgcccggcggcgcguacgugcucgacgacuccgacgggcugggccgggaguucgacggcaucggcgcggucagcggcggcggggugagcggcaagcugcggggauacgcggggggcggcaagagcccgccccguggggccagccccacaagcccccgcggcguugcccugcguuuccaccggcuccacucuccgccgcauuccccuagggugccagucagcaggcgguuggggcgggcccgcugcggggcuggggcgggugcuuucucguuuaacacgaaccagacaggcaguuagguuugaacaaaugaggauccggagguccagagaguauaggugcagagaguaaagugacaggucuaaguagugaaguagccggggcuggaacccucgucccaggcaguggggcacaggcugucuucaucgcggagauggcagucggggagcgucgcuccagaaagggccagggagugcgggagcguccgugugcgaaagagaacgccccagugggaugcuuuggcugugucucucccuuuuggaggaguuggugggugguggagucguuaagucccgugcaguuguuagugcaggguaagaaugggcuccuccagagaggguagcgccgaauaggauuucguuuggaggcaggacuggugccucaaggucucuuuaaaaggaagauaagcgagcggccugaaacuaccggguacucccucugggcccaugggcuucaugguggccgaccuuugggugagaagguuuuuguuuuuugguuuuguauccgaaauuacaucuagggcuaauguuucuugaaaauguuaagguugaacucggauuuuugggguugaguuggauggagcuugcauccuuacauucaacucagaacaagcuugaaugccugcugcaaggaugaccuggucuguagugugaccacaagauauaaccuucugcuaggggaaauuuuuuucccccuggaguuagcugauccuuuuugauuuuuauguuuucauucccuaauuugcaaucucuccagccgugcugauguguauuucaggggaaaccugugggccgaugaguuaaugcauuuauucuuugcuacuacuauucuccuuuuuauguuuuugggcuaaaccugaaacagccaauauuucauggagugaggccccaucuuuuuuauagcuuuacuugugauacuauaucuaggguaagagcuuaccgaaaaauggaagucuuuguuuccauuagguuuauuaagcccaguuuaaaauuacuaagaugagaagaaucauuucguaauucaaaguaggaaacuccuaccuaaucugauagaauauacaauuauuaguaucccuauauaguucauuacuccucauaggaacucacuaaauaaugaaaauucuugcaacauuauauuugcauaccacuuuaaacuucuuuguggaguccuugguuccuagcccagguugugccaguaaguguuuagagugcugucauuuaaucuucaugucagagagggaaagcgguaugguacaguaaguaguuaagaauguagggccgggcacgguggcucacgccuguaaucccagcacuucgggcuuccgaggcgggcggaucacgaggucaggagaucaagacuauccuggcuaacacggugaaaccccgucucuacuaaaaauacaaaaaauuagccagucuugguagcacgcgccuguagucccagcuacucgggaggcugaggcaggagaaucgcuugaacccgggaggcggagguugcagugagccgggaucacaccacugcacuccagccugggcgacagagugagacuccguucaaaacacaaacaaacaaaaaaacccaaaaaccaaaccaaagcgaaacaaaacaaaaagaauguagacuaaagagaagauugccaagagugucuucuggguucugccacuucacuguguggccuugguggguuaucuauuauaacuccucucugccucacuuucuuuuuuugggauacaguuauaccugcaugguaggagcgccgugaggauagaccuaaaguacuuaggaugaugucuugcacauuacuaauuuugguuaauaaccauuuucagggauuagggaggaggaaguuauuucaaggccacugaaugaugaaauguccccaaggcuuuuuccugggccuguaaacaguuccaggccucauucaggcagugugguuaguaaucccgugauuugcuauugcuagauggugcauuuuaacauuugguuauauugccuuugacuuaugcuguuguguuagguguggcuauagguuugcaauaacaugauugguguguuugccuaaagccgauacuuucucuguuaaaugugggagugcauagagggcaaaagaaacccuagacagcaaaacgcacaguauuaauggcguagcguaggacaggaagcauuguuuaccuagggucaaggauauauuagugugccuauacaguguucauuuaaagagugccuauuuuaauauuggagccucugcuagguuguaagcucuuugagaaauauguauuuuaaaaaauuuguguauauaacacuugccuuuauugagaacuuacuaugugccagguaaugugccaaguccuuuacauacaucuaauuuuagucuuacagcaguugaaugaguaagauagcccacuuuacaauaauuugccuaugauuacauagcuuauuaaugaugaaaucaggauacaaacuccauuugacucaaagacuccuauuuauguugccaguaccagugcaacaaaagacccauaaaauauuuaauaaguguuuauugaauaacaaagaaugaggauacaaacuugaauaagauacaguccauguccuuaaggaacuaagaggugagucagaaaaauaaaggagugccgggguucaaaguguuguaauaaagauauggaccuggugccaaaggagaggcgcuuacaucaaaucagugagcagggccagaaggcauccuuccuucaaauuccagagguggaauuugagcugaaaggugaauuggaguuguccaagagaggauguggggugcauuccaggcauaagaauagaaaacguuguuugauacaucuagguagaaggugugagagugauaagggauaaaguaucaggguuaggagccaaauaauuaagggauuugggugcaaaauugagcgauuugaacuuuauccugaaagcuuuugggaaagggacggucuuagcauguuuacauggaagaguuucgugauuacauuuguauuuugggaagguuacucucguaaguagcauggaagauagaauacagggagaggcagaagggauguccugagaccacuuauacuguucucauaagugaggagggccuggguaagucagugggguugaagaguagaggagggauuugagagcuauugaggauaucuuggugacugaggguacaugggaaguuuggacaaaagguggcccaaguuuaugguuucggcaaguguugguuacugagacagcaaguucaggaaaaggagcagauacaugcaaaagugcuauguuugguuugggauauauugagguagauggaaagaguggcuagagagcagcuccauggguguuugccucacugguagggacuggggauguuuugggugugacagaguagauaugggcacuuaccagaaugucagugguagcauauaugagaauauaaaauagaaaguugaaccccauaaaaguauuuugucccaaccaucauacauacaccuggcaaagugucagcaguuugaaccuaggacugucugguuuacaagccugaggcuacuguuucaugccaaaaaccggccucuuuuuauuuauuuuuugcuuauauugccucccaaaggauagauuaugggucaguuacugguuuugugauuucuuuuuucaaauaguuguaugccgugguccaggcaugauccaguauuggucccugcgcugucuacccuugucuuuccaugcauucugaugccacucuuguguuaaguuuucuuaguacagccuggucuggagauuauugcuaguuauucuuaauaguaacagguagaauuuaugaggauggggaaaguagugcuuccuuucagcauugcugcuugugauguuuuuccggaagauguuaaggggaaaaauuaccugacauucaucccucccauuuuaguccugagauauuguugucaaguggucucaagauagaaaaccugaguuucaagauaaguuugugaucaugagguuagcaagcuuaccucccaguuagcccucaugccagaagaagagaacuuuuuuagcugucggacagacagcagcccuacuugcccaaugauuggcacagaaagggcagacagacaacuugugaggaacuuuuccucagccugaccuugccugaggcuaaauauguguauaccagguggugugcgugaacacuguagacagauauucaugacuggauuucuuuuauucauacuuuugaaaacuuuuuuuuuuaggcaaccucccgacuucuaguaaauuacccagagcccuaucguucucagauauuggauuaucucuuuaagguaaugaaaacauaauuauuucaugguaccugugauauuuuagaaauuggauggugaauuucaccauagaauuuauuagccucacaauucuaguuuuugaaaaaauggcacauuacuuuuggaauaaauugcuauuugaaguuuugcuuuuguuuuugcgucuguaaaaccuaaggcaguaauuaguaauugucuugaagcuucauacaauacaacacuauguuaauacuguuacuucuuuucacagccgaauuuuggugccucuuugcauauuuuaaaaguggaaauagguggugaugggcagacaacagguaggagaauuugggagauaggauuucucccaucaacauuuuaaucuauaccucagcauauggacugugauuucagaauauguguaaacaauaccaacacuuuugagauugauuguugcuuauuagaguuuuccucauuuuuuaacuguaauuauuuaaaaauauuauauagaauaugacugguccaucaaaaacaauauucaaacuucaaauugcuuauuuaguugaaguaaucgguaguaaacaaauccacaguuuucuaaaaccuauauauacaggacagagcauagggacaguuuugaauuuuauugagcaguuagaaagauuuuaauuucguauagaacaaaaaaaguguuauuaacuuaaaauaugugguaaaaaugauacagcuuuuuuuucuuuuaaaaacaaaacuuaucuuuaaucacuaaaucuucagucuucauugucacuauuuugauuggcuuuauguaguccauguuaucaacuggcaguuuauaggccuuuuguuuccaggaagaagaaaagaaauucucucuaugauuagauauagcuuauuauuuacagaacagauuccauuauaaugaacucuagaguauuacuuguauuccugcuagugauuuggaaguaacucuuuguugaacagauaugucuauguggugguauuaguguuuauguugaagaaaaagugcaaagcaaaaacaaaagaaacccccauaacagaaacuuucuucaagcuauugcguuuuacuguuaaaaccuuuuaggcagaauugacaaugauggacuaauuucacuugcugaagcuaaauuagagguagagguacauaaacaggcaguucuugugaauucugauguuuaccuuuaagaagaaaugggcaagggccucucggaaggcccuacuuagcaagggcagauguuggugaacugugggaauauacgaggacuuugauagcaauuaccuaccucagugcuaagacaauguaaccucuacuaacugcagauguuaguauagaauuuuguuauuuuuagaguggauauguauacucauuccuuuuuuuuuccucaaaacucuuccuauaucaagacauauuauaggcuaaagguguggguucugagaacagggcucacgaguccagggauucauauccagcguugaaaagcugaaaguugagguaaucagaacuuaaaguuggacauggggauuugaaaacuacagagagaucaaaagcccagaagcaugaauacugggaauuuuuaguuauaugaggugauaacauuucucucaguacugcuuguaauagaagguugugguuuuauuaagacuuuuacaaugcuuaagauaauaaaaaaaggaugaaaugauaugcuuuuaucauccauccuuuaguuguguaagauuaugauuuccccaacuucaggauuagaacuggaauacugcuuuugugaagugugugucugggguggggguggggagugagaugguccuaggaaguaccauucauggaucauuacuuccguuuuugcucuccucuauucagacggcacugagcccucccacaugcauuaugcacuagaugagaauuauuuccgaggauacgaguggugguugaugaaagaagcuaagaagaggaaucccaauauuacacucauugguaagaaaugaaguuugcaauguuucuucagucucuuuuccuuuaacuuuuaaauucugaaucguguugguggaaucucuauuaauacggaaguacucauaaugucauuaaugcuaccaguaugcuaccagcagcaaagcaugugccaggggugauccuuucuuugcccuuguauauuauguugaauccuuauaauaccuguggaguaaggcaugacucuuuccauuuuccaggaagaagcaguagaagcuuaggaagauuaugccacugaccuaaggucauagacaguuaguaaauggcaaaaucgguguuagcaccuaauuccauguuuccuaugaugcuaaacuacuuuccuucacaagaucugucaucaguauuuauaaaaggguaacacuguucacaaaaauguauauuacaugcaguaguacaccuaacuaguuacaaaauuguauauugcauguaguagugaacccuauuuuuagaaaagguacauacaaaaguguuuuuuguuuauuaguuaguuuuugaacuucaauaaugugcugguuacuguucugggacucaggaagccaaucccguccccaauuccugcaccuguggggcuuagguucuauugggaggaucauuggcuaguugcuuaaaugggacuauguacauuucacaguucugugagaauguguacagagcuugugaaguauuucaaacaucaagagugaugggauacuuucaucauuugaaaugaauuugauuuuuugaaacaggcuuaaauucaaacuaaguuaaaugaaauuaaugauucauuuuaaagaccugauuucuaguuauuuaaaaaauaauuuucucaacaaucagguuaaugaaaaguaauauuuucuaaguuaaaagaaauuaggaguaaguauguucuuuauaaaugggcuuuuguaagagauuccagaaaugcugugagcaguaaaagcaucacugaauucagcacauauccacuagacugcuuccaaggucagaccucauuuaaauguagaaaauauggcaugcuaaaccauguccuaacaaagacuugguaggccuucagauugcauuuagcauuucauuguuuucaagaauucuauuacuuuaaugucacauuucuuauguaauacacuuggguguuccuccugaguuuagaaaauaagcauuuugucauuuugauuuuuauuuuuuucaguggugaacuaguuugguaauauauuuauugcugaggaacuuaacuauugagccuauuuuaauauauuaguagcaaguuaaauuuagaauuauaauaaguacuuuucuacucuucuuauuuuuuuacuuaaacauaaucaggauuauuggaagaauauggacuuauuugauguguaucacuuaacaaggguauauuucucuauggagucauugucauuuauagugauauaagaacaaacuaguuuugcuaaauuagauugccugacugauuaauauuuuaaggacccuaaauuguaagaagauguacaauugaaugauaaauuuguguuauacauaacucaagaguaguuuggcauaagccuuuuagaauucuuugauuugaccucaaagaacagaaguugaauauugaacauuccaacagugaguggacauguuaaguuaaaacauaugguacauuucuuucuauugguaagggucuuggagagagguguuuguauuuguuauuuuucuucuucuuggaaagaacauuugaaauuaugggaccugacucuagggaucaauaaggaauuauagugucuauagauuggaaaggauuucaauaauuuuuauaugguauauaaacuuuccuuuagucagaucuguauugguuuuuugcuaguugaaugcuuuucuuaaaaaaaauuuguuuuauuuucaauagcgccagcaccguuauaccuccucuaccuuugccuccucccuucucucugcaggguugccauggucauucccuggauggcugggaaaagguuucgacuggccuuaugucaaucuucagcugacugccuauuaugucgugaccuggauugugggcgccaagcguuaccaugauuuggacauugauuauauuggaguuaguaauauauuuaaaauaugauucaguuuuggacauuuguuuguaauuuagaaaauaauuugauucugugguacuuuuugacuaaccauuuuaugccaugaggcuaauuuguucuaauggugucugauaauaacacaaacuaaguaccugugaccuuuaauugcuccccuuugcccaucccaguguucccacuuuugaaaacuguguugaguguauaccuccuuccucugagcuggguuuuuuuuuuuuuuuuuuguaucaacccaacucaaauucuccuucaaagcuuucccugcuuucucugguuccuacaacaguguuguguuuccuauacagcuuaugggggguuagucucauuuuauccucuuguugucuuaagccaaagauuggcaaacuuuuuauuaaagggccagagcauaaauaguuuuggguuugugggccaaaaggcaauauugaggaucuugagguaaauauauagccauuuaaaauguaacuauuuaaaacuaaaaacacuuuuagcucucaaguuguaaaauuacagaugaugggccagauuuggcaggcuggcugaaaucugcguucaccugucacaaacuguuaguuaacaccuuuuaaggauuugaaaaguaugaaaaaugauaucauguccagcuugucucuuggcuggguggaggcaugccccaggcugcaucguaccccacagggccuuaacacacacauagugggucuccauaaucauuugcuuauuaauauaccaucaguuaaaacuaauacuuaaacauuuucaugcaaucaugacuuagauuaucagcaaacaauuauugaguuccuacuguguugcaggaacugugacuguaauauuugagggcuacuaagauuaauaagcucuuguguucaguaagagaaguagaugcuggaacauauaaacuguaauacuacaugaugauacagggcaugaggaugagccaagggcuggaggaagucagaagaaagaauauacuaguuuuugcuauccuuuuccaaauuaugacugaaaaauuaguuuauauuugagaacuuuccuuuuuuuuuuacacugucacccggauuggagugcaguguugugaucuuggcucacugcaaccucugccuccuggguucaagugauucuccugccucaaguagcugggauuacaggcacccgccaccacacccagcuaguuuuuuuuucuuuuuauuagagacgggguuucacuauguuggccaggcuggucucaaacuccugaccucgugauccgcccgccucggccucccaaagugcugggauuacaggaaugagccaccacgccuggccggagaacuuucuuaaaugucaggacauuuauaaccuguagugagacuaaauguagguuuggucuaauagcuuucucuuaugguacagucacaaguaaugggugauucacaucuuguuuagacucaugauaacaaaugcuaugaugaggagguucauugauaaacucuuuccuguaucauuggaguaaaaagaccugcaccuggauucuagaaucgucucuuguuauuaacaguuuucucaacuguggaguuauggaaguucuuucaauucuaaaaccccaugcuucaugacucuaaaccuaauagauguauauauguuccuuuuauccauccucauucagaguugcuuuugugacuaguguauuacugugauucucuguguaugcuuaaaaauaugccuucuauacaguauacauauuaauacuuggcuuucagggaucuugucauaauuguuguaacaguuucccugucuauuaguucuccaaugccuaguauaguuucuggcacacauuguacugucaguauguguugaaugaauuaaugaauauuccauuguugaaaaucuuuggaauaaauuacuuuuugaaaaauacccacuaaauauuuuaagguuuuuaaaaauaauauuuuaauuuuuaaaaaguugugcuaucuuauaacuaucuauaaauucuauggcaggauaucccauaaaguuaaaaaauggcguaucagauaauaugaaagaugaugagagaaaugguaucguaacgauaaucugcuuucugacauuuuguaacuuucaauucagacuuuuuugacuuuuuguuuugcagauuuggaaugagaggucauauaaugccaauuauauuaagguguguacaacuuuaguaucuuuuuguuuuuaacuuuuuagugaauaauuccuuaugguuccuaacacagaaaauaguaggaaauuuguguuggaaauaccguauuuuuuauacuacaguuauuuauuuugcugguugugacauaaaauucaagcaaaaucuuaacaauguuuauauuccugauauuaaagcauauguaauucuuugugagccccgaauuaccuuugucuaaagaguuguguugaauuuuucuauuuuaaaauucauuaguuuuggaauucugauaaauuuuaugaaacaauuauaucauuuuagauuuuuagaacuucaagaaauguagcuuuuuuucuuugucuuuugucaaaacuuauggcauauauucuaauucuuguuuucuauuggaguguguuauaguacauguuucucuuugugauuagcaaagagguagcaguaacaucugccaauuguguuauuuuuguuccacuuuuccuauuuaucuccauuuaauucucacaaccuuaccuaugagguaacuacuguaauugcuauuuuccaggaaaggaaaaacagaauaauaacuucugccauuggaaaaaaaauggcaguuucacuuuucagguggagcuaaucuuuaguuuacuuuucacuuccuuuugucuucuuguauguaucuuuucucuaagaaauauaauuuugggacaguauuuuauuucaaguuuucaaaaauuuuuauauuaauuuuuuuuuauuuccauagguuuuuggagaauaggugguauuugguuacaugaguaaguuccuuagugguuauuugugagauuuuggugcacccaucacuggagcaguauacacugaaccaaauuuguagucuuuuaucccucaccuccuucccauccuuuccccgagucccuaaaguccauuguaucauucuuaugccuuugcauccucguaacuuagcucccacuuaugagugagaacauacgauguuuuguuuuccauuccugaguugcuucacuuagaauaauagucuccaaucccauccagcuugcugcaaaugccauuaaugcauuccuuuuuguggcugaguaguacuccauuguauacauacaccacaguuucuuuauccacucguacugauugauggguuuuugggcuauuuccauauuuucacaaauccaucaauccugcuacuggguaucuacccagaggaaaagaagucauuauacaaaaaagauacuugcacaugcguguuuauagaaaaaaauuuucuuugaauuggauguuuuauguucuuaaguagauaagguucaauacauuucuuucaucucuucauucgguuaaucauagagcauuuauuugcucaacacugguuugucaggcauuguguguaugguuauaauauaaggauagagaauacuguuuucugcccaaaaggauuuuuuguauuggggagggugguuauaaagucagauauagacaauuaaaaugugucauaauuuggaaugugucaaauaauggaauaauacaccuacaggguucuuaaaaggcgcacagaggagaugacaccucucccuggguugauuagggaagucuuuuagaggaggugauguguaauuugaaucuucaagaacggauggauaggaacucuccacuuugcuaaggcaggggcauaucaugugcaaagaacugaagauugagagguaaagggauaugggggaaaaacaagucaugaaagauggauuagacaauggaggaagagugggggcacugacccccaucaguaagcuaauguauucacuggaauaauggcuuuuuuuuuuuuuuugacagagucucucucugucacccaggcuggagugcaauggcgccaucuuggcucacugcaaccucugccucccggauuuaagcaauucucugccucagccuccugaguagcugggauuacaggugcccaccaccacgcccggcuaauuuuuuuguauuuuuaguagagacggggauucaccaucuuggccaggcuggucuugaauucuugaccuugugauccgcccgccucggccucccaaagugcugggauuacaggcaugagccacugcgcccagccaauaauggcauauuuuaauuaaucuguaguuguaggcguggagaaggcauagauugagaagaucuauugcagccagagcuagguacucaagggcaauuccagguugaaguaugcugaugggagugugguggugggagcagauugggugggggagguggggcaguggagcuauuaauaagauuggagcacagggauuguaaguggaaagucaugccugcugugagcacaggucugauaagagcaguaaggggacagagcagaagccaaguuggugcauguauacuggauaacucuguaaugagguagaugguguugcuacagcaucuucauagugaaaggugaugaacuuuuuaaauacccaaauuugacauuucaaagcuuaaguuuuauuuucuugugauuguacacaugucucucuuguggucauuucauuugagggaaacauuaaaaguauuacgguuuccauuuucuuuuaaacuaaugaaauaagacagggcuauauuuuauguuauuugaacuuuuuuacuauuaagagucuguugcugacuccagugcauucuaauucaacuaaccugguuugaaagacuaauuguugcucuaagacauauuuucaguguuucagacaguucagacuucauuuccuuuuuuuugaaccuugaguuuucuugcaguaaaaucucucaggauacaaaaacuuuuuacuuuguguuugccauuuuuuuccagcaagauuuuauugggaucuguguuccguuuguugaaaugccuguugcaggccaggcucaguggcucgugccuguaaucccagcacuuugggaggcugaggcagguggaucaccugaggucaggaguuugagaccagccagaccaacauggugaaaccccaucucuacuaaaaauacaaaaaaauuagccgggcaugguggcagacgccuguaaucccaucuacuugggaggcugaggcagaaaaauugcuugaaccugggaggcagagguuucagugagcacuccagccugggcaaaaagagcgagacucugucucaaaagaaaagaaaagaaaaaaaaagaaaugccuaucacaaagaguucaauaaugacgaauguaggugcucagauuggauaaccuuaaugaauguauauucuuuaugggauaauaagaugaccccuggaaagaauaaggauuuguuuuuaauaguagaaauaaauauaauacaaaggagcaauuuauauaaagaugacaaggguauuguuucuuugaaguuuuuuuuuuuuuuugcuacugauauguaagauuuaucgugguuuucagugguguucuuaaguuuucuaaauugugucuggaaaaucucaucuaggaucugaggauaguggauggaaauggaagugccugggucuuuggaccuucauucacuucaaccagaacaaguucauuuccauuugucuuauaaauagagcuucuauuuaagcuuuuucuggaugagaaaguuccaaaacaaaaacauaaucugaaaauauguuagauaaaacugcucaaaagaaugcuguucguaaugacuuauggauggaaacuuauuuagaaaucauagcauguagacuuguaaauuuuggaauguuauucaaauacaauguauaaaaaaguaagcagucuuacugggauuuucuaggacuaggacuagaaagacuagauccauccguagugaaaaaugcaaauuugacuaaguugcucuuccucuucucuguaagaauaaagaggccggguggaguggcucacgccuguaaucccagcacuuugggaagccaaaguggcggaccaccugaggucaggaguucgagaucagccugaccaacauggagaaacccugucucuacuaaaaauauaaaauuagccaggcauggugccacaugccuguaaucccagcuacuugagaggcugaggcaggagaauugcugauccugggaggcagagguugcagugagccgauaucaugccauuacaccccagccugggcaacaagagcgaaacuccgucucaaagaaaaggaagaacuucagggugaugaaauucaggauugauccuccugcuagagggauagggguucucaauccuacugaaucuugagaguuggucucgguuugcuacaaaggaucuguucaugcuguagacuucuaggguguccuagaacucaacugauccaguuugaaagaugaacuuagacugccaccucuaauuuucaccccguuuucuaaaauccuauaauauaucuauuuuaagaaacugucuguugaaaaguauaccauggauuuaauuggagcuuuuauuauuugcguccuaaaagagcacauuaauuggaaauugcccuaguucagagaaguuggaaugugaagagagagcuugugaaauucuuuguucuuucuuaauuucuucaaccaguaguauugagcaucugcugcuaugugccagagauuuccgaguccuugggggcuauaguagugggcuuauuuguauccauucaucaagaacugcuugugguaugaaaucugaucuuccugauccugaguaaaaugaugucuccuuuucucugcucuugauuugcauauaggcaauccauacauuuugguauguacuugcccuuugauuuucuaguaugcccuguuaguuuugguguccuguugaguguguuugccaccuaagggugagggcucccucugauacuucuuuuagaguccucauggggcccaagcauaguacugaguaguaaaguagguacuguuugugcuuuguuuauuuccuguuaaaauuuagcuuguuacuuuuaauuuuuguggguggacaguccuacagguaaauuuuauuugcucuccuguuuaauaauggcagaauauuugaagaccguggaaaauacuuaaaaugauaaguuaaagcauuuugccaaaugguaugauuaguauguuacccauuugauuauugugucugcauaggagacuuccuggaagaaugcauagcaaaauaauggugguuauuucaggguaguaccauuugauuauuuuuguuucauccccccccccccauauuucuaugguuaaacguaauuuuaaagucaaagugaaaauccucuaaaacauuuuaccccuuguguuuuuuuuuucuuuuuacauuccuagugaaguagguuaucuuaaagguaaugcuuuuauuuuccauaggagggauguuucuauugagaaaauauaguauugaaauuaucauccaugaggucaggaguucaagaccagccuggccaauauggcgaaacccugucucugcuaaaaaauacaaaaauuagccaggcgugguggcgcgugccuguaaucccagcuacuugggaggcugaggcaggagaaucauuugagcccuggaggcagagguugcagugagcugagauccugccacugcacuccagccugggcgacgagagaagccucugucugagaaaaacaaacaaacaaacaaacaaaagaagcuauuauccagaacgcugauuuguaaagauaacuuuaucuaucuuggucauaaauucaacagcuaaaaauucauuuguauccuuucauauguucuguuucuuacuccaaaagauauuaagaaaaaugcugaauuaucaaggucuccagcgagugaaaaucauagcaagugauaaucucugggaguccaucucugcauccaugcuccuugaugccgaacucuucaaggugguugauguuauaggguaaggcauguuuuacuuggaaaacuagcaguuucugauugcuugcucuguguauugacuaucuuuuucuugccuucuccccauuugauuacauucucagaagguagcucuccuguauucacuuaccugaagcaugcauggcucauaguucauuauuuucucuuuuaaauauauuuuaggaucuuucuaugacaaacaaguauugauagcuuuuaaaaagcauguugauguuuggaauaauaaaacagggcuuuguuuuagauuaaggggcagaguaauaccuguauuuaauuuuagaaauuauaaaggcaaaguugugaaauuaguuucaaacucucagauauucugugguuggaaguucuugcaugaacacuuuuguaaaugguucauugugaucacugacaauaacuuuugucaugccuccuuaguaguauaguuuugaugccuacucuuuauuccauuucugccuuuuagcacucugggcccugaccucauuggguucauuuuuuuuaaaaagugaauuuacauuuuuucuaccaugacucaggauauaaacauuugaaaaauaggauauguauguuuguguguguguguguguguauguauguguguagaauuuguucuuuauccagugugaagacugauugaucucuccaugugcuuuauuuuuuuaaugaagaauuuugaauguacacaaaaauaggcagaauaauacaaugaauaucuauguucuuaucacucaaccucuugaacugugaauccaugaccaauucuucauccaugcgucuaucuacuccucuuccuuuccugccuacauuacuuugaaagaaaucccagacauuauuucuuccauaaaaauauuacuguguaugugucuccaaagauaaggauuauuuuucuacuuaccauaaacaauaccauuauuauaccuaaaauguaauaguuuuugauauuaaauauccauuauuaucuuauaguuuuauuugauugaaucuagauccauuuaaaauucaugcauggugauugguugauauuuaaaucuauucuaaucuuuauguucuugcucuuuuucuuucuuuuaauuuguugaagaacgggguuguuugucuuacaaacuuugugucagucuggauuuuacugauuucaaccccuacaguuuaauauaacuugcucaucuauccuuuuucaaugguuuuugaaauugguaguuuagguuagauuuagguuagguuagauuuaggcuuaauuuuuuuuugcaagauaaaauuucuuaauuauauuuaaacauuuuauacauugaaauuaaaaugaaaguuuugcuguuguuaaagcuuucauaaauaguugaagucuugaaggaaaacaaaguuguguuaaucuuaaauauauuuucuuauaaaaauauugcaugaaaauauggguuuuacuguaucuucaugaaggacuuggauauguacuucauuuuuuauugauauagguauuuuaauguaaugaauuuuccucugaguacugcuuuaguuuuaucucauagggcuguuuuaucauuaauuucuaauuuuauugcacuguggccauuuaauaccaaauguauuauuuacauuuuuuugggaaauuucucaggagcuuauuaaaaaaaaaucugaaaaaauaccuucgcuuuuuucuugacuaucucaagagcauauuuugauuuauuaagauguauucuuuauuaggauacagaauugaguuuauauauaaccuuuugguuauauuguucagguauuuuguaucuuaacgauuuuguccacuugaacuguucagggcuacccagguguguuuguuuccuuauguuaguggggucuauuucuccuuucaaucuuaggcaguuuuugcuguguggaagcuucugcuuuguuauuugguacguaaauacuggaagcuucugcuuuguuauuugguauguaaauacugaugaauguuuuaucuucauuaugauuuauuucuuaucauuagaaaaugccauucuuugucucguuuaaagcuucuuggccugaguucugcuuucuguguaacuaagagaucuaugcuuucuuuucauuaggauuugccuaauauauuuuugcccuuuuauucuuuaccuuucaaggccguuuucuuuuaugugcauugcuugcauauagcauagaguuagauuuugcuuuuuuaaaguuccucugaaaaucuuuauauuuuaaugaaugaguuaaacucauuuuuaaauauaacugauguuuguguuuucuauacuacuauauugucuuuuguuauugaaugauuuauacuauccauguacuaauacaagcuauucugcuaugugauuuguuuacuuugcacuuauuuaaggagguguuucuuuuguuauuuagcaagguuugguuuuuguucugucaauuacauuuauacugauuuauaccaguauuuucaacugagaauaauuuugccucccagacggacauuuggcaaugccuggaaauauuuuuaauugccacaaauagguagggcggugccacuggaauccgauggauggaggccacgaauguuucuaaacauccuuuaguacacaggauaguuuucccauaacaaaaaaugauccagcccaaaauguuaauagugcugagguugaggaacugcuucauacuaauacucuugguuucuucuucguuuaguuauugucuguugguuuacuaugagcaauacuaaaauuauuugauaacuucuuccucccuuuuucuccccuaccguggaauuuuaauuaccagaauuaucuuaguuuuaauuuuuguacucuuacaugaacuuaagcuucuacuauauugauuugacagcuacaaguuuuaacuguuuacucccaaauaaucugcaaacuuaguuuacauuucaccuucuuuccuucuuguccuacuucauguagcuguauuaguuguacuuuagccaaguguguaauaguuauauauauaauuuaauuacuauuucuuuuaaucucacucuaccauuaaacauauuaaaugcucaccuucaaguccuuugccaaaguuucucccucauuuucuuggauaucagaaguguaauuaucuauuaaaugucucagaaagugcuaauggaaacaauauuucuugauguguucagauguuuguugauguuuaucuaugaccuuuauacuugaaggacaguuugacuggauauaauccuuuuuuaauucucaaauauguguaaauauaucauaaaauuugcuccauuaguuauuuacauaaaauguugcuauugagaauuuugacuccagagauauuuccuuuuccuuauaaguaacgacacaauuccuuuaugcccaaagaauauuuuuauucaucuuuaaaguuuaguuguuguauacacuuuaccauuuccagauauauaguauaugcucucuuaaugucuauauuuaaguauuuucuuauuucaguaagguuuacuuaaguuauaaguuaaaucauuauuccacuccauuacuuugguuuucuuuuuagaagcaccaguuauacuuuggucuuauuugcauaugccuuuauuuuguauuucucugaauuuuucucuaucucuuuauuuauguuuucuauuauuuuauccuuacuauucuauauuccucacuguguuuuccacagugucuguucugucuuauguuccuucuaguuuagccuucauuuccaaaguguguuuuugaaaauaauucuucuauaauucucucauuuuaauuuccuauauugcuaacaauucaucuuuaaaauuuuuaauugaaguacagcauacauacauacauauauaaaaguacaaaaaucaucggauaauagcuuaaugaauuaucacaaagugaacguaccuauguaacagccacccagaaaauuaucagugcccaagaagcuugguuacugauaucuccucuuggaaagauuuuuccuuggaaaucuuuccaauaauuaagcucucuuuuugccuuaaagguaacuacuaaucugaccucugacaccauggacuaauuuugccgguuuaaaaacuuuauuuaaauggcauccuauaguagcuguuauuucagccaauauuauauaaauuugugagauuaaugcauguuguuauauauagagguaguucauauuuauuguuuagcauccaauuguuggaugcuaaauguagcauaccacaacuuaucuguguauuauuuuuuaauggucauuuagacuguuuccaauuuugggcuauugcaauuuuguucaggagauauuucuuggcucacaucuucauaggaagacuauuccucccugccucauucauguugugcuuggccugugcuauaucugcagauuuuuguuuuacaguuacaguacuuucuagggucuguuucugcugggccccauucuucuuagugacugaaaguuguucucccucaaacaaagcguuccugccuuauucaacuuggauucuacuucaaacagcuuauuuucauguugaagcucuaccauuccugauuauuugcuaccuucuccugaaauuguuauugcuuaaaccuguauuguucaauacaguagccacuagacacauauguuuaggaagcacuugaaauguggcuaguuugaguuuagguguguaauaaguauaaaauauacacuggguuuugaaaauugaauauaaaaauauuauuuacaauuguuuuacacugauuacauguuaagugauaauauuuuggauauauuggguuaaauauaucauuaaaauuauguucuccauguuuuucugcuuuguaaauucaauuaaauuuuuuccauuuauguguuuuauugugguaaagaccuuugcugguuuuuaauguggcugcuagacaacuuaaaauugucuaugugugguucauaucauauuucuaccagacagaucugguuugaacuguuacaguauuggguuugaucuccuaaugaauucacuguuuugagcauugaccccuaacuucaagccugugaagauguucccaucuuccugaguuggucuucuaugcucccccuuaggguagggucuacuccuuuugugugaguaccggccaguccccuuucacuucuaguuuccauauaccaucugcugauccugggccauuucugaugcugcgaggcuccuggggagagucccugucaccugguuugauggcaguguuaucugugaguuuuuccuuucccuuaucugguuggucaguuugguuucaggaggaguacugaggagcuucagaaacugggcugcugucauguucugccuuggccagaaauucuaauuuuuuaaaguacaaauauguuccucuguuaggauaaacuauaaaguugguuuacuuucauugaucuuaauuuugucuguuauugaaguuugaaaaauaaugcugugaagugauagagaauguuugccuacuuauauacauuaaaaauuuauauucuuuuuuuuuuuuuuuuuuuuugagacagagucucacucuguccucugucgcccaggcuggagugcaguggcgcaaucucggcucacugcaagcuuugccucccagguucaugccauucuccugccucagccucccaaguagcugggacuacaggcacacaccuccacgccuggcuaauuuuuuuuuuuuuuuguauuuuuaguagagacaggguuucaccauguuagccaggauggucucaaucuccugaccucgugauccgcccgccuuggccucccaauaaaaauuuauauucuuaaagagccuuuacauuuuguugcacuaguaauaaaucuauacauuaagaaagacccagauuuuaguauuaguucugccuuucuuugcucauaucauguaauaaaucauuuggguuuugaaugugguaacaguuucaucauuuucugaaugaaggauauaucaccuauuccuauaacuucaauaaaguuacuuuuucauuuuauaaauauaauaugcucauuauagaaaauuuggaaaauguagaaaaguauaaaaauagaauuuccucauaauccuaacaucuacugauuauugguaacaugcuagcauauuacuuuacaguguuuucuuuaauauagaaauauauuuuaaccaaauacaccaaacaugcauuuggcaacuagacaacuggaugacaacuagaugaguauuaaaaauuaacauuuggcugagguaccaaagcugaauuucauggaaauagaauggaguugugggauagaagaauaaaucuaaaguguaauuuuuugaauuuauauuauuuaaaagacuaguagccagauuuuucagguugggcguuauaguuccagaacaaugauugcuuaacccuguuagaugcuagauuucuguugguaucuuuguaguguagauuugcaauauugaauagaugccugcuuucaccugaguuuagugacucaguaaaaucuuaguggaaccucauuuuucucuaauacuucuuuuuauguucuccaguauauauuguauauuauuuucuuacucaugaaauccugggaugccaaauugauauugugcccuaauucaucuucacuagguauaaagaauuaccaaauaggauuuuuuccuaaaagauuugugaccuaaaagggaauuaaauaacuaaaaaguaaaacaaguauucacaaucauucuuuugauguuauaaauacuacuacaccaaacuacaaagauuagaauuaugauauaacuuaaucuccauuauuuugcuugcauuguuuuuuguaaauaauuuuuaaacuaaaaaguagaugcucuuauuccuacaguuauuuagcuagugugcucucuuauuggauugucaaucuauuuucuauuuuacauuuaaaauuuauuguuuuuauuccuauaaucagugucuuccacaaucaucauuaugggaguauuuuacucuugcaguaaugaauaugcauuuauacuuccaccaacugacuccccucccaucgaaugauagagugaaggaggcauucauuuucuggggcaguuucucaccugcugcacuauugauauuuucaauggauaauuuuuuuguuguagggguugguccugugcauuguaggauguuuagcagcauuuuuggccucucuucucuagaugcuaguagcaaauaucccugaccccaggugggacgguugaaaaaaaugucuacagauagugccaaauauucccuccagggacaaaaaucaucuggguugagaaccgccacugcucugauacaguaauuuaguuuucccaagguagcuuauucuuuuuauucaagaaauaaccauguguggguuuuguuuuuuguuuuuggccugggaguaaaugccaagcuaucuuucuguguucuaaggacaggaguaguggggagaguacuacuuuauauaaagguuucacuagucuuauuuuuggccuccuccucacucguuuacuauugccccaagcuccuuagcuuccccugggaagucugaaucuuaucuuuacuucauucuccucuuggaguguucuaggcuguggcccucucugcuaccuccauccuucaacaugcuuccauccaucuugugagcuccagaaauagauugaaauuucuuaucuauugaugauuuuccuuccuauccuguaugcuguuguagguuuauccccuuuuguuuucuuugcugucauuuuaauggcaugcugagacaaaagggcauaaagcagaugcuuagauucauuaucuaccuggaagcuacccaacuguuuuaaaauagaaaaccuuggagaagacucguauuuuuauauacucaacaaaucuauacguauauaagugccacgucgugaccuuuuuucauugacuuccacccuuuuuuuuucuagggcucauuauccuggaacccauucagcaaaagaugcaaaguugacugggaagaagcuuuggucuucugaagacuuuagcacuuuaaauagugacaugggugcaggcugcuggggucgcauuuuaaaucagaauuauaucaauggcuauaugacuucguaaguuauuaaaaaccuuuuagaguucuuaucaaaaaaaauuuaaaaacauaagaguuagaaaaaaauggaauuccuuauucuuccagccuagauucaaugauuguaaacauuuugccuuguuagcgucaucuauuuguauaccuauaccuaaucuauaucuaauuuucuauauuugaauauagucuauauuaaauaaagucagguuuauugagguauaauuuauauguagcaaaauacaugcagcucucugauuuuugacaagcuacuuguauuuuuaauaauuauaaaguaaauaguauauguaaggacacuuuaucucuaaauauuuuagcaugugucuccaaaacauaaggauauucuuuuacaugaucacaguaucauguuuucauacaugagaguguuuuuaauucucagucuauauucagauuuuccuaauuguuucccaaaaaugucauuuguagcuuuuuuaaagaaaaggaauagucaagcacacacauauugcauuuaaaaguuacaccccucaagucuccuuuaaucuagagugguuuccuuauuccucauuuuugaugacagugaucuguugaaaagaccaggcugguuguguuguggacugucugcuucccagccugucugauugauuccucauggcaucacuugauauguguaauuguuuguuuaaaaaacagauguucuuaagggagaacacaacuauuuuuguuccuaagggaagcauuucuuaaaugcuuugaaaaacacuugaauugugaauagauuccaauuagcuuuuuuuaaacaaugauaaauagaacaaaaacaaaccaauauuuauguauuuguugugauguuaauguggguugcuguauauuguauuuguucuuuuucuucucuuugugaaagaaaagacacuuaggagaguuugguuauaacuuaauuuggucuuaaagguaaggcaucuucauggcagagaauuuagaaaacugaagauagguacaaagaaagaagcaaaaucaccuacagucuuaugauccagagcuaaccauccuaaacauuuuuagugaauguccuccuguuuuauauuggcauguauacauuuuaaauacaaaauugagaccauacuauagaaucuguuuaaaaaacugcuuuucacuugagacgacauuaggaacuuuuucucacauuuaccuauauuucuacuucaucauuuuuaaugcauuuuaaaauauuuuguuacauaaagcaccauuucccagacuugccuuaagaagcacccgagacacucguuguuauaccuucuccuuggcagcugcccagacauugugaaucagaaucuacagggaaggcuccugguauucuguccaucuagucagugcccucaagugauucugaugccacacaaguugggaaacacugauguggaaaauauauuauuguuuauugaauauucuccucuuuuagaauuggaaguugucucuguuuuaauuaauagcuuuguacaaacugaaauguucaauuguauacaaauaucuuuguauaugcccaugacuauuuucuuaggcuguauucuuagaaauggaauggucagaaauacauagauuuugaaggguuuuguauguauuuuacaaaaugcccuccagaaagcuugucuugaguuauacaucuaucacuagccagaaaggauaccacacaucuugcaaaccaugggcaaaauuauaagaacuuaaaauauucacuaguaguaagguguuuugaaaauuaggacuauuauuucuacuuuguacugauagaauuagaaggcuuugauuugcuaagaaugucagucucuuuuuuuuauacuggaugaggacuugauaggaaaaauaaaauucuguggguaagcuuuguuuuuuuuaaucugugagggacccaacaauaccaaguucaauaacuucccuuuuguccuuggauuuccugagaagcagagagucaaaguuuuaggguuuagcaccugcucuggacuguuagggccugaucaucugagaaagaaugggccacaaagcagaucagcaauuagauccaauuacuacuuauagaugaaguggaaucauauuuaauagcaauacuacggcccagaccuuguuccauacucuuccuaugcauuaguacauuuaauccuuacaaacucacgugagagagauauaauuauuauccucauuuuacagagagguuaaguggugaaaccaugguuuaaacccaggcagucugacuccaauaauucucaauuguaaaacuuuggaacaguucagagucaaguucauaaaaauuaugucauaaaacuggggcauuaagaaggcugacuguugaaaggaaaguagguaugcacaaagccuuuauuuguauuugacucaaauuugugauguguuggguauugguaaggcaugauucgucuucuggcuauaccacaguucaguaaaaauuugcacauaauacauuuguauuuuuuaucaugugauucaccauuaaaaauauuacaauguaccccacacuggauuuuucaaaaugugaauaaauuuagacaacuuauauuuucuuauuuugggugauccuuuuauugucauuuauguagauguguauuacuaugauaaagucuuuuuacuccagguuuuuagacauuuacauuuuuaucacaaguugucuugguguuucuuuuuuaucaaaucuuuuagcacaaucgcauggaauuuaguggcuaguuacuaugaacaguugccuuaugggagaugcggguugaugacggcccaggagccauggagugggcacuacgugguagaaucuccugucuggguaucagguaugguucaguuccaucucucacucccuaaauucuucucuaagagacaaagcagaaaaaaacuuagagaagauuauauaaacugugugucuaugcguguuuuaaguauagauuuaaguuuuaagcaagauuugccaguguuuuauaagaauauuuuggguaacuagacuacucucugauuauucuaagaccaggcuuuuagaaaaguguaggagaggagggggagagagaggaaaaggaggagcuguguagugauagagacacaaauaaauaaucaucuaaggauauaauuacaaaugaugauaauugcuaauaagauuauguauuuauaaacagaguagaagucuuaagauuagcuuugaagacauuuuguucucuuauauuaauagaguuucaauuacaaucguaugcuagcaaaaucaaagggagaugauuaaaaauacuguauuauugaaucaucaaaugaauaaguaaauaugaaaguuaugugaaauauggcuuuauauuguccccuaaaucugugaaauguggguugugaaaagguaaauuucaaaauagguaacaauguaaagcucaaaagauuuuaaaagugagcacguacugaagauuuuauguuacucauaugauaugaaggauccuggcagauagaugguagauguuagaaacaguugaaaugaaaagucaacauagcacaaauuuucguaguguaagggaauuggagaugaauugucaauggaggcaaauuggguuucccacaacagggaagaaauuaauuaaauuucuaccagacaagacauaauuuacauagcucagagacaaugaacagggcuauagauaauacauccguuuuuauugaaacacaaaaguuuuacuacaguaucauucauuagucacaagggaaauugagauuaugcagggauggauggcauagugucacuuuuucaugaggagauaauaaccauacuaauagugauuauauuuuaaacaaaguaacaaaaucuauugcugaauaauguugaaacuuuucugcaguuuuuuuguaaaagauuauaaacauuuauuaccauuuuguuuuaaaauucuaacaaucuuucuaaaaagcuaauuucuuuaaagguaaaaugcuuucagaagaaaauuaugaauuuggagugaauuuguuuuuauuuuaaacuuaaauuuggugguuuucccuuuuaguugugcucuccuaagacagauuuguaaucauauuaaucauguaaucaugauauuauucuaaacuccuuaaauuguccuccaaaaaauauaagaaaauuaagguuagacuuguauauuggacuuguauauucuaauauugagaauuauaugagaaaacuaagguuagacuuguauauuggacuuguauauucuaauauugagaauuauaugagaaaauuaagguuagacuuguauaucagcgccuugaauguugaaauuguuggccccacauuaucuagaugaacuaauguacucuuaauuuugugauuuuuccaaggguugggacaugguauauugcuuagugcauuuucaggacgagcuuaggaggugaccaauaaauguacaugugguggaaauaaauauguuugaaaccauaaaguuaguuucugaaauucauuauuaacuuuuuaaaccuuuuuuugguagcuauuuuaggauggauuaaauagugaugaaccaaguuuggggggggaauaacuauuuuauucuuaaaaaaaagacugaucauauucuugaacugacagguucauuuauuuuuacccaucauuccaggaaucuucuugcaauuguaccauuuaucuagauuaauuauuuaaaaauuuaaacaugagguugacggauauauuccugcaaaauagaaaauagcuuguuuggaugaaucagacucaaauugauauacagcuuuuuuuuuuucccaaaagaaauacuauuauuaccauuuuugucuuauuuggaacuuucuguuuuucuauagcucauaccacucaguuuacucaaccuggcugguauuaccugaagacaguuggccauuuagagaaaggaggaagcuacguagcucugacugauggcuuagggaaccucaccaucaucauugaaaccaugguaaacuuuuguuguugcuauuggauuaacucacuucuuuacuauuggaaaaauaaaauauaaaacugaauacuuuuguuuuacauguaaauacauaagcauacagacagaugccaagaucuuauggcuuucauuuaaaaaauuuuagccaugagucguaaaacauagcacacaacucacugauuuguacaaaauaguuggcucucaucuuuucuccacuuuguuccuggcaguugggauaaaauuaagguuaccuguguaccaauauuuguggagacgaccuucacgaccuucccuugcccugauauguauauggaggcuguggcuuuuuccuuuuucauccucagguuguuuuggggagaccuuaagucuguugagagcaacgagcuuaaaauucaagugauugaggggcuugaguaggaagggaauaggucugacagguggacagaggcaugggaggagguaggggcuugaaagcagacauaucaaggauucaagggaacugaaugaaagaaugaaggugaaaaaacauggaagcagaagcagaagccaguggagagaagaagaagucugagaggugccaguguggggagaucucaagcuucccaaagaggucaaugaaguuccaacaagaaggagguagacagaauaggaagugcauauagucagcagggcuuugugaagaaggauuucuagcaacuaaguucccaugggagaagcaagauccaaaacagagaacagaguagccuuaaaaaaaugguguguguguguguguguguguguguguguguguguguguguguguaucauaucagguucugaaugucagccuacaguuuggccaacuccugaccauagacucuuaaaaaacaaauucuuucaaauauccuacuaucagguuugagccaggacaaacaguaaauauuccuggcaguauugaccuuuucaaaccaaaggugucuauuaagugacucacaacacaaaccaauaagccuuuuaugucuuaucguggaugaagaggauccucaaaagaggguguaaaaagaugcagcccucccagaaucuacacuucaucguagucaaaagguugagaagugauccuccaaagaccuagaaccacucccaaggauagucaaaagaaagacccagauaaccucccuacuccccacucccugucagagcuggcgauaguugguaaacuggcugcaaauagggugcgaaucacauuuuugucugguuauauucuuggggcccccaacuugaaguuggcugccugcauacacaaaacugacagcucacacaucccuaacaggugggaagucaagccagguucucaguacacaaaaugagacaaauaggaaagcaauagcugacccugggaaggaagggaucuacagguaaugagcacccaaaacuaaauuuauacaggaaucacaaaccaaacgaauguuuuucuucugcgaaucugcauuuggagaggaagggaugaggagguuuuuguuuguuuguuuguuuguuuaauugucuucucucgaucggguacuucaggcagagauccagaagagcaggccuuggugagaauucuuaaccuuucugccaccuuuuugucagugucucaggaucucaucugcaggcucuuagagugaguaggcaucucaucuucuucaccagaaacugucuucagagauaaggaaaauagggagagcaccuguugagugagggucuuaugaccugcuucagaggagaaaggagaaggucagagaguaaacuuccugcuucuacauuuuucucaaauuauuucacuuuaaaauauuugcggggagugugucuugaaccccaucauggcuguuaugacuaaugguguggauuagcauauguguacaaguuuuucugugaacguguuuucaguucucuuggguauguauguaggaguggaauugcugggucacaugguaacucugucuuuaggauuuugaggaacuaccaaauuguuuuccaaaguuacugcaccauuuuacauugccaccagcaguuuuaugaaacuuacaauucuccacauccucccuaacaguucuuacuguccaugccuuugauuauagccauccuagugaaugugaagugcuauguuauuguaguucaauaugcauuuuccuagggacuaaugauguggggaucuuuucaugugcuuauuggcuaguaguauaucuucuuuggagaaaugucuauuuaaacucugcccauuuuuaaauugggauauuuguguuuuuauuauugagucauaaguguucuuuguucuauauaaaaauuccuuaucagaaauauaauuugcagauauuuucucccuuuguauggguugucuuucauuuucuuaaugguacccuuugaauuaaaaaaaguuuuaaauugugaugaagcccacuuuguuuucucuuuuguuucuugugcuuuuggugucauaucuaagaagcuauugccuaauucaagguucugaagauuuauauuuauguauuccuuuaagaguuuuagaguuuuaaaucuuaaauuuagguuuuugguccauuuucuuucuuaacugggguuauauguguguccaacuugauucucuugcauuuuaauauccaguugucccugcacuauuuuuugaaaagacuauuccuuuuucauugaauugucuuggcauccuuguugaaaaucaauuggcaauaaauuugaggguuuauuucuagaaccucaauuuuuuucuguugacuuauauaucuguccugacgugagcaccacacugucuuagguacuguagcugucugauaaauuuugaagugaggaaaugugaguauuucaacuuugucauauuuuuauuuuuuauugacacaggguacaauuugauguuuugauacauacaugugguauaauggucaaaucaggguaugcccaucaccucaugaauuuaucauuccuuugugaugaaagcauucaaaagccucucuucuagcuguuuuguaauacacaaaaccuuacuguuaaccgucuucacccuagugugcaagaaaacaccagaacuuacaccuccuguccaauaguuacuuuguaccuguugaccgaccucuuccuguccuucccuucccagccccacccuagugucugguaaccacuguucuacucucugcaucugugauaucaacuuacaccuccuguccaauaguuacuuuguacccguugaccgaccucuuccuguccuucccuucccagccccaccccagugucugguaaccacuguucuacuuucugcaucugugauaucaacucuucuuuuuuuuuaauucuacauguaagugugaucaugagguauuugucuuauugugucuggcuuauuucacuuaacaucauauccuccauauuccuccauuuguugcaaauaucaggauuucauucuaugacuaauaguacuccauuguguauauauauaucacauuuucuuuauucaugcauucauuguugaacacucagguugauuccauaucuuggcuauuguaaauaguguuuuaauaaacaugggagugcagauaccucuuuaacauauauauuuuauuuuggggggauauauacacaguagugggauuacuggaucauaugguaguucuacuuuuaauuuuuuuuuuuuuuuuugaggcagaaucuuacucugcacuuccaggcuggaguacaguggugcaaucuuggcucacugcaaccucugccuccuggguucaagugauucuucugccucagccucccaaguggcugggauuacaggcgucugccaccacaccuggcucauuuuuguauuuuuaguagagacgggguuucaccguguuggccaggcuggucucaaacuccugaccucaagugaucugcccgccucagccucccaaaaugcugggauuaugggcgugagccaccacgugccccgccuauuuuuaauuuuuuaggaaucuccacacuguuuuuuauaguggcuguaccaauuuacaacccuaacaacaugaaguaaguauuucuuuuuuuccacauccucaccaacacuuguuuucuuuuguuuuuuugguaauagccauucuaaguagagggaagugauaucccauugugguuuugauuugcauuucccugaugauuagugauguugaguauuuuuucauguacccauuggccauuuguaugucuucuucugagaaaugucuauuacagucuuuugcccaauuuuaaacugggcuauuuuguugucguuguuuaaguucuuuacauagucuagauauuaaccccuugucucauguauaauuugcaaauauuuccucccauuuuguaggcuguuuuacuuuguuucuuuugcugugcaaaagcuuuucagucugaugucauccccuuugucuauuuuugcguugucugugcuuuugaggucuuauuuaaaaaauucuugcccagcucauugucauaaagcacuuucccuuuguuuuuuuucuaguuuuauaguuucagguuuuauauuuaaguauguaaucaauuuugaguugacuguguauauugugagagacaggaguccaguuucguucuucugcauggggcuauccauuuuucccagugcuguuuauggaagagacuguccuuuuuccuagcguguucuuggcaccuuuguugaaaauuaguuggucauagggcaugaauuuauuucuggacuuucuauucuguuccauuggucugugugccugcuuuuagacaaaaccaugcuguuuuauuaaucguuacuauagccuuuuaguauauguugaagucagguagugugaugccuucagcuuuguucuuuuugcucaggguugcauugacuguuuguggucuuuuguguuccuauauaaauuuuaugguuguguuuucuauuuaugugaagaauguccuuggcauuuugauacagauugcauuaaaucuguagauugcuuuggguaauauggcuguguuaacaauauuaauuauucacuauauuuuugugaguuuuuuuuagugauuauucuggggcuuaccauauacaucuuaacuuauuggacucacuucagauuuaaacuaaccgaauuacaguagauuaugcugaauucccuuguugcucuguucccuuucuccuuuuguucuauuauuagcacacaugucacaacacugcgugcugcgaacucaauaggacauuguuacuuuauacauaaauuuauauguuuuuaaaccaguaacaugcuguuuugguuacuauagccuuguaguauaauuugaaguuagauaaugugauaccuccagauuguucuuuuuguuuaggauugcuuuggcuguuuggacucuuuuuugguuccauaugaauuuuaggauuguuuuuucuaauucugugaaagaugauguugguauuuugauaggaauuacacugaauauguagauugcuuugggcauuguggucucauuuucacaauauugauucuuccaauccaugagcaugggauguauuuccauguguuugcaucaucuauuauuucuuucagccauguuuuguauaauaguucuccuuuuagaacuauugguucuugguuaaguauauucuuauauauuuuuguagcuauucuaaaagagauugaguuauugguuugauucucaguuuugucauuauugguauauagcagugcugcugauuuauauacauuauuuguguacauugauuuuguaacuugaaacuuuacugaauucauuuaucagaucuagcagucauguaucaacagagcagaauacagaacccaaaaauaaagccaaauacuuaaaaccaacugaucuuugacaaagcauucaaaaauauaaauuuggggaaaggacauccuauuuaauaaaugguucugggaaaauuggauagcaacauauagaauaaugaaacugcaucccuaccucucaccucaccguauacagaaauuaacucaagauggauuaaaggcuucaaucuaagaccugaaaccauaaaaauucuagaagaaaaucuaggaaaaauucuucuguacauuggccuaggcaaauaauuuauaacuaagaccccaaaagcaaaugcaacaaaaccaaaauaaauaaaugggaccuaauuaaacuaaaaagcuucugcaaagcaaagaaucauuggaguaaacagacaacccacagaaugggagaagacauuuacaaauuaugcaucugacaaaagacuagcauccagaaucuauaaggaacucaaaccagcaagaaaaacacaaaucccauuaaaaaguggcaggugacaugaauagacauuucuuaaaagaagauaugucuauagccagaaaaacaguuaaaaaaaaugcucaacaucacuaaucaucagagaaaugcaaauuagaaccacaacgagauaccaccuuacuccagccagaauggccauuaagaaacaucaaaaaacaauagauguuggcauacauguggugaaaagagaaugcuuauccacugcuggugagaaugaaguuaguacaaccuauauggaaaacaauguggagauuuaucaaagaacuaaauugauugaucugccauucauuccugcaauccuacuacuggauaucuacccaaaagaaaagaagucacuguaucagaaagucaccugcacacauauguuuauguagcacaauucacaauugaaacauauggaaucaaccuaagugcccaucaacugaugaguggauaaaggaaauauauauauaccauauauauaugguguguguguguguguguguguguguguauauauaugguguguguguauauauauauauauggugcguguauauauauaugguguauguauauacauauacacacacacaucaugaaauacucuucagcauagaaagaaugaaauaaugccuauuucuuugaaugucucauuuuuuguguguguuguuggaaacuggaccuuauauauaauauaugguagcaacucguauauaauauaugcuaucaacucugggcauugauccucucccccuugaggcuuguuguuguuuauuuauuuacuuagugauuugcuggaguauuuuaguuaacucuguucccuccuucuuccccuccacacacuguaaagccugaaauguugcuccuuggagaaugugguuuugggcauauccacagucacccugggauuuguuuuuccaggacucugucugguuccuugaucacaccucacuguaaguuacacuaauugcugguggauuucuguauuguuuuaaacaaugcccuggggacuuaaauuguuccaaagacugauccaauuaaauuccagcucauuuucaggggugguuugaaguuaguguuuuaguuuucuucugaccacaggagauuuuuuuuuuuaaacugucacuuuuuuuuuucauuucaucauaaauuuauuuucaggcaguaugauaaucuauuaauacucggcauacucugaacuuacagaauaaguaccacucuauacuuccucauuaaugacuaucauuuuacaugagcuucuucuacaaucacagugagagaacagauugcuacauguuugcuaaauacauucaguaaggcacucaaauccuagacacgaacuaaccacagaacgcucuuccccgcuuuaauaaauugaaacaugaucucauuuccuucguuuucaaugcuuuuuauagaaagacacgcuugucuugaacuugucuaaacagagguuuauauaaacuaauccauuaucauguauaguuguaaucaaggaaaugauuucacauugacgguuuuuagguagggauaaguaaaagcacugcagcaguuucugagggaaugucuucccugugguuccucauacuuaguacaaugccuggaacguagcagggacuaaauacagugaacaaaugggcaaaccuuuaauucccagggaucugcuacauauugccuugacugguagaucauuucuccagaagaaaggaagaaaccaaaaaacaaaaauaaucuuuuuaaaccucacaggauuuucuuagaaaaaaguuuuaauugaaauucucuuuguaaaauguauuuaauaaaaaauccaaagcaaaaacccuaucguuuauuuacuucaaaagacaaaucauuucaguacuucuuccuugaaaugccugccauuucuuccucuggccucagaaaagggcaucggcuccaugcuuuacagugucaggauaaaaauccaggagggagaaaucuuguuguaauggauagcugcuuucaucuaacacaaaaaggcucugaaucuuugauacacaagguucugcgcugacugccgacaaggaguguaacaggucugccaugaccaucccauaggugaucucugaggaaguaacuaucacucuguugaggcagucugcaaaaauguugagaagaaucuucucuaucagcuuugagucuacacggauguaaacaucaugucuuccaucaacuacagucauuaaagcuggccuauaguauauuuucuucauaguaaauggcaagcagcuaaaacauuguuuguagauccuguucuuaucuguuucuaguuccaauccauauuuugcgcagccaguauauaugauguugggaagagaagaaaagaaauacucuucagagaacugugagcauuuagagcuaucuucugagcugccguaauaggaaaugacagcucugaaaucugggcuuuaauuagaaccacuccugaacauuuauccucuagguggguugcuaagucugauaucuuccaaaaggaaggugcacuuuuuugaaauuuugcuuuaaauguaauugcccuuacaucaucaucaaacaagcacucacaggaugaccaaggcauuguaugcgauuuuagguuuucuaguguguaauugcgcugaacaaaaagauauuuaaauucccaaauauaaccuuuuuuccuuugcaguugaggguaccaggcugcuccaggacuccauaauacaagcacauaauguugaucuugggccuguuccacuguuaacauaacuuuuucugcuucuguccucuauaacuguauacugccucugucaguauagugaaaucaacaacucuuaguauuguguggacuaauacaucaggcugaaggugcuccaauucuauaaagucuauacuguucacccucugaggcugccucggaggaagaucucugagguaggaauguuuugaggacaccugugccaguaggucuugaaguacaacaucacuaacuacacuggaauauucuucaggcugaauagaugaauaacucccaagauuuaauaacugacugcuaaauguugauuguaguacugucucgccaacccauugguccucaugaauaacaacaucugcgaguaaaauuauaucuccaagaaacacuguauaugcccaaaaugcugcaguccucuacagaaaaaccuucuuaguuucugauugaucaauuacuguaacuguugcuaaaggcacuuuagagccagaauuugguccgaauuuuauguuuauuuccuucacaugacauggagauagcaccaugacuaaacaaucauacuucuggcuuuuagaaucacaguuuuuuauuaaugacuuuuuuuaauacccuuaaauucagacacauuccucugauccauuucuacaacagaaucuccugcauuagaaaucaacuucauuuucuuagcuacuugaaggacucuagauagagcuucagacuggcccacuuuaucuucagaggugcagcuucuuuuaauagcacuuuuguggaagguguuuaguugggaacacaguauuccugagcuacacaacucaauacguaucucauuugguggcaguucaucuucagaacugaaaaguucuugagauccuguauuuucuucaggaccuuugucagaguuuaugugaauguggcuauuuucuguuuuaggaaaaacaggacuaaaauguucaagagaauaugcuugguuuuguccacuuucauaugcuucuguaaaaucaucaaguugaauggaauucucuucagauauucuuaucuucccguaacuugccuuugguucagucuccauguuuacauucccuuuauuuauaggacuccgcccuuuaucuuucuuuugagcuaaaaaagcaaccuggcuggagguaauuauacagagaaauuccguaucaguugacauuuuaaggucugagaccuuccuaacugcugcuucagacuucagaccuuggcuuaucuacuguguucaaggaaaauaaucccaaacacugguuuuguauuucaugauauucuguuggcacacacucucuuuguaccacuucaggcccuauauuaauuuguuuaguacuacaaaccaaauccaacauagcugcacauuuguggucuaacugaaacaaauuugagugaaaguucugaccacagauaucugacugauguuuaggcuguucaucuauaauuuuauuuucacugagaagcuuuugauacuuuucaguuaaaugcagaacuaugcuuucaaauccacauauuugcauauuagagcucguuaccucacucagucuagaggagugaaucuucugggauucuauauucuguguuucagaaacagaauguacaaaguaaucuuucacaugaacaugucuauucauacaguuugcuaaguaagaaaugaccacuaagaucuggagaccaauagauucugggacuucauaguuuucaagauuuuugugcuguuuuucauccuucagauauaaagaauguugacuguauaaaagcugaauuuuuuuccgggggucagcaacggacauuaaagaaacuguguguugugauacugucauuuuuaguggagcaacaggauacuaggcugggugguucucaacaggauauuaggcaggguugugguuuagcuuaugccuauagugaagccacugguuucuuuuuucuuuucaccaaaaccuccauuauuuuuuagaacaacauuagucuuaaaccucucuaugcucugugucaaauaucaauuccuuuaagaaaagguuugaagcuauuucaugccuugccucucccccuagguaaaucucuaaucucuaguaaugucaccuuucuuauuguugaaguguauguuuucucuuaaccugauuuuuuauuagucuggcuagaaguuuuucaacuguauugaucuucucgaagaaucagcuuuugguuuuauuauuuucuugugguuuuuaaauuuguuuuuguuuaauucuucuuugcucauuauuauuuucuuugccuauuuugguuuuuucuuuauuuuuauuuuuacuuuuuaaaaaaauuuuauuuccacaguuuuuuggggaacaagugguauuugguuacauaaguucuuuaguggugauuugugagauuuugguucacccauccccgagcaguauacauugaacccaauuuguaaucuuuuaaaauuugcuccuauuuuucuaguaucucaagacagaagcugaacucucaaauccuuucuugguuucuaaucuagguauuuagugcuguaaauguccuccuaaguauugcuuuaguggcauaccacaaauugugauauguuguguuuucauuuucauaaagcugaaaauucuaauuucucuuuuuauuuuuccuuugaucuauugauuauuuagaaauuugauaguuuguaaauauuuuugacuuuuccagaagguuuucaguuauucauuucugauuuaauucuauagugguuaaaaaaguacuuugugugacuugaaucuuccuguauuuaugaggacuugcuuuauggaucagaguaugguguaguuuggucaguguuccaugugcgcuugaaaagaaugugcauccugcuguugcuagauggaggcauuuauagauggcauguuguuugguaguguuguucaaaucucuuauauccuugcugauuguccaucuaguuguacuaucaauuacuaagagauggauauugaaaucucugauuaugaaaguaauuuuuuaauggucugcaaagccugaaauagaacuguguacuauaaguauucugugacuguggaaucucuuaaaguagggauuaugucucauacuucuuuugaucccagcccauaguugugacuauuuaguaaacagugauggcaaugugagaacuauguuacauauauuuagcugaccuuaguguguauuugauaucuauauauacuauauauacacacacccauacauauauauauauauuuuuuacuucuuacaugagaacgaaaguuauauuuagaugagaugucuuuucagugaaaacauccuuacuuuugcuuuuuauuugauguauuuuaguuggaaaacaguuauaacaaaaaauuaaucuguaugccauauaugucucuacaguuuagcuacgaauucaaaauuugauccaguugaaacgccauugaccuuuguauuugacuaggaacauacaauacacauucaguaaauauuauauuguaaaaaagucuuuaaaaaugugaaauaaacucauauuuguuaucuaguauauguaaauuucuguuaaucuugggcauuaacuguugaacuuuuuuuccccuaagguagcuuauacaucauuuggauaauguaugugauuuuuuuuuuucagagucauaaacauucuaagugcauacggccauuucuuccuuauuucaaugugucacaacaauuugccaccuuuguucuuaagggaucuuuuguaaguaaauauguuuaacuuuauuuuaguuuugauuuaagaauuuauauauucugucacaggccaguaguucuuaagugaagccuuauauuaugaacuuuuaacaguuugcauaugaauugacagaggcccuggugucuucugucuuccgacuugcuuuaaucuagcaggacagaagccaguaggagguaaaaugcucugugacuuugaggaacacuuacaaaagucacuugcaagaaaguuguucuuggugguagaagcauuuuauggucuagggaacuuucaagcauugauauuuacaguauacuaugccaaaaauauuguuuaaaaguaccagauacuugcuauuucugugaauuguuagguuugaauugacaaacugcaguacccuuucugauuacuaauggcauaagaauuguuuuuuaauaccagaaaguuauuuuaauuuagaaguuauuacacagguacaguaaugaauguuuuugaagcaaagacacuguaauuuuuuuaucauuugccaaaauucuuuaguguuuagagaauaaaguauuugcuugaacaguguuuuccuauuuuuaaaaauauuauuauuuaauauuugagguguuucucuugauaaauagagauaauauugucauugguacauucuugcugguacugauuuuggaaauccucaaagaggaugugaugaauuacucagccaugcuuuuuugucuuuucuuuacagagugaaauaccagagcuacagguaugguauaccaaacuuggaaaaacauccgaaagauuucuuuuuaagcagcuggauucucuauggguaauuuuaaaguaaauucuuauauuuuggguauuccaacaguaaaacaguaaaagggcacagaaaugucauuaauuaagaauuuuuauuuuuauaaguuuguguguuuauagauguguuuagcucuuagacauuuaguuugucuugguggauggugacgccaucaccuggcuucccagguuggaaauuuaagucccauuugagacucucugucuuucccacucacccucuguaucccgccaguggucaaguauagacaguuguauccacacauuucucuuacucacuccuuauucuccauuaccaccguuacuucuuguuucaguucuucauuaucgcucuccuggauuucagaaacugccucuuguuuuuccagucugacuuuccaggucacccaucacacugcuacagagugaaaugucaaaaaugcagaucugauuuuugugaccacugugcucagaggaccucagugauuauuuucuuagaaguuaacauuccuuaguguagcacauggcccucauuauccucccagaagguagaagacuggucuucuuccuagagauguguccuacuaaacuggccucucuucacauacuaaacuuacauuuuucaaagcauagcaugccuguuuauuuaccucugugacuuugcacauacuguguucuucaccuagaauggccucuccucaacuuugucaucuuuugagacucaauucaagugucuuuuccucugacgcuuccucaccagucuuagcucauauucaccuagggccaugugcuuaccuaguuaaaugcuuuuccugcaccacuggacaccuugaagacugagccuugccuuauuuagcuuuauaucccaggugcuucccacagugccucauccauggugcuuucuggggaaagguuucaaagaacgaauuggcccaaacaagcacauuauuucacuuaauugacacaagucuaccacuuuuucugguuauuauuaauguucugauaaccaacuagucacuaacagugauaaaacaccuuauuauguauuaaguucugaaaaaaaaguucauacuuuuuguguaacaaauugcuaggaauggcauaauaaaauugauuuuccucauaagaaaaauaaugucauuugggguuauucuucaaccugaauauaacggucagguauuucauagaucugaucaucaauuuaccauuaaaacaaggauaauaacuccuuuuauucaaaauagaaaaaaacuguucaaauuucauaaaaggauuccagugucuucagagaucuacauuuagcauagaacaacuuugauacugggagcguuuuccauuggucacacacuaagcuuagcacuuuaaaagcauuaucugguuuaauccucacagcagucuauaagguauguauuuuuuccucauuuuguagaugaggagauugugacuuaaagagauuaaguugccaagaucguaagugugacauaagccuaacuugcuaguugaaauauauauugaucauaaaaugagcaggauuuuucucucuuaauuguaaaaggauuucugugauuaacagcugggucgacagugauauuuuaugaauuuuuuuaccuuaguaaauuacugagagaaaaaagcaggucucuuaguugcauguaucgaauauauccaagcuuuaaggagcuuacuguguaguggaaaagaauaggcuaauagaaauagauuuugagauuauuuaguccuuccuuccaugaaguaagguuguuuaaaauuauaaagcauaauuuuauaaaguuuucuaaaauacuuaggaaaaaaagauuccaagggccuugauauuggugaguuuuccacaaauguuuaggaaguucuaacagaaaugauuuggacuuuucuuuaagcuaauuuuuuuaaagcuauucuguccacaugagaugagcuauaguaccugguccugaauacaguagugucuucuuuuucagcuccuugacagcgauggcaguuucacacugagccugcaugaagaugagcuguucacacucaccacucucaccacuggucgcaaaggcagcuacccgcuuccuccaaaaucccagcccuucccaaguaccuauaaggaugauuucaauguuggugaguauuuuucacuaaaacuuaacuuggucucuauauuuaacaguaguguguugauuucuaccugucaaacugggugcaugauggaguggcugucaaaagcacauucauuuaccuccuacaucucauaugcgguaaaaggagggcuaauuuuuugcauuacuuuaugguaaaucuaaauuugaggacccuguauuuuucaguuucagaaaaaaauauaggguucauuguuagaaugaaaguuauaguucugauuuguuuuuggugaaacuuaaacuuuguaacuuugcuacugccccauuagccauuacugacaucuuccuucuguguggagguuaagacacauucauaucugucuuucugcagugcuagugaacugagugcuuaugggcaguuauguuguccuuggcugauccaacucauuauauaccaucccgugcuuuuuuuuuaauugagcuuucuugguuuucuaggaagaucuguccuaaaguuguuagaaaaguuuuugguuauaggugauuuaggaaaaccacuuggaaaaaaguuagaagacauggucauuguaguuauauuccuagugaguaaguaacaaaauuuguugacugcuuggugguguucuguagguuuaugggucucacagacagggucagguggcuuuguaaucugcuccuaaaaucuguagcagcaggagaguaauagggagggagcuggcauugcuggagcaucacuugaagcuccuguuugcugcagagcugcuuguuccaccaaagauggacacuccuaucacccuuucccagucacugcuacagggucucgccucccuuucucaggaaaugaucuaguuggcuggaguauaaggccuuuuggacuguguaauggaguccucucaacuauaauacagacaacagugauccucagggggagcuuggugguuuguuuuucugcaacucuuugaaauggccucuuagauaaacccauuaauuuugugaaacacagggucuuuaaaaucuguugcucgcuugguucucuguuagcaaaagugacuuuugccuucaguaagugaggaaucugugugggauauggccuagauaaugagauugaagaacugccagcaccaagaccaauauuuugugacccugaagacuaagaggcaauuucaaaccuucaaauauaaaauguaauacuuuaugagcuacaauauaaauuuaaaacuaaguuaaauauuauaagcuaggcucuggagauacuuguuaggguucuaaaugucucaaaugagguaaugaaugcaaaaacacuuggaaaagcaugagguauaagagcuauaagauauguaaaauuucuccucuacagcauucauuauuguaagacuauaauuuaauuuaguaaaacuaaaaagggauugauaacuuaggcccaaaacugguuuuugcugcaguuuagaaguagaagaaaauuuguaaauuuuaugcuugauauaguaaaccuuucuuaugcucuuuuggcagaugauugugacgcaugauuuggaaccuugcuugacagauauuagaaauaauaaagcuaucccuuauugagcccuugccaggugcuggcuuauguaccuguuaucuuuucuuuaauucucuuguccuccugcaaaccuggaaaugaagaaacuuuagaugcagggcaguuaaauagcuuguccagggcgacagacugaacucgaauuugaaucuaggucuuacuucaaaacucaugaccuuuccucuacaccagaugccuggauuaaauauuaugcagcaucuauaugucgaacucaucaucuugauauuuaguaaugaugauacaaaaauuaauguaucuuuauuagaccuaggcccuaaacuuugguuuagauuuuauuuauuuauuuaaaagcuuucagaaguguuucagacauacuauaaaauaucagcaaggagagcuucugaaggauuugauacuaaacagagaauuucuuacauucugaacagauuacccauuuuuuagugaagcuccaaacuuugcugaucaaacugguguauuugaauauuuuacaaauauugaagacccuggcgagcaucacuucacgcuacgccaaguucucaaccagagacccauuacaugggcugccgaugcauccaacacaaucaguauuauaggagacuacaacugguaagauugauguucucaauguggaucuggcugaaauacccuuguaauauugucagguacauuuugaagugaagaguuuucaaugguccuccuauuucaagaaccuaauagauguguaauauguaauauuaaggguuguugaauaguauggugaugaccacaaagcugcaaauuguuuugcugccccaguguccuucccucauuuuugcccuauuuaauagugauuauuacaggagcaauuugauuccaguauaaaaacuaaggacuuuuggacccaauuauaauuuaauauuuguuuauaaauagacggauuugugagguauuuuuaaguuuuuguuuugcuggagaguugauuuguugaucugguguugccaucuaguggaccaaucuuagaauuacaccgucuuagccuuauuaaaagauuuaccaggugacaguagauggcaauaguaaaaagcuaaucagcuuuagucgccuagugaauuuaacuuuuuauuuagucaucugguaaagagacaaguuauauuauucacauaaaauauaaugccaaacuaaaacuuucccuuccucuuuaguuacagaauuucuaugugcugacuuauuccaccugucauguguuucuuuuucauuuuuuccuauaacuaguaugauuccacugugggaaaagaaacacauacacauuccagguuuagagcuaguacuaguaauaccaagccaccaaaaagccauauccgaagcuuggaaacuggagagggaagagaaaagaauucugaaaagagccuugaauugccugucuauggagugugcagaaaguguuuaucccuccugaagugccuuacucccaguuagaaauccugauucuagucccaagcucugacauaagucuuaagaaacuuuuaguuauccagagccccuggaacccuuauaacacuaugaagaguuauugaggugcagugaagaauuccuuccuaauuuaggaugacauuuguggcuuguguuuuuacgcagaauuucugcuugucccauugucucugagguggaaacuuuaccuagauuuuccaguuaugguaguggaguucuuggcauccuuauuugugacugauggucuuauuuuaaguccaguggcuggguuuaaguguccaaggccugggucccauuguuuugaucuccaguuuugaagucgccguauaggaaacuuuuuuuucugugacauccccuauaccccaugcacuugaauaccauagagggcucuuucuaaacucaaacucaaucuuauuucuggcugggacuccaaaaagauugagaagccccuuaauuguaguauagaagugagauauagcaccauccaaagauuuacucccccagaucuucauauauuugaaucuucauauacaucuucacaauuuaaauagcaauacucaguuuuuacuaggaucuauugcaguggguaaggagguggggacgagggauggggaaggguguagaagggaagagagugacauauucugaaaggaaaggaaccgggaaguugcaauuuugcgugucaagaaaggccugccuucaucuuucugaagcccuguuuucaucauguuauuccccugcucaggaagaugcagugacucuguccugcuaccuguguuuuccacuucuaggcuugauuuccaagacccuuuauaauuuggucucaucuauuauguguuauuuuccaguauuccacccucuauuugaggcagccagaucugcucagagauccacacaaaucccuuguucauuucuguugucuggcugcugugcccacuuauugugggaaaaggagggaauaaaaauuggguaauaguaggcacuuugauggauuucccacacaaccacuuuaugguggagauaucaucguccccaccuugcagacugagaaacugcaucuuuggaauaagauuuacccaauauuucacuuguaaguggcagaacaagggcuagaagccgggucugugugacugaguagcccauucucuuuggaguacaucucacagccucauuuuaaucaucuucuuccuaaagguaggaaaugagaaauuuguuuaguuuaucuguagugcuauuuuaguaaaucugcucucaaugagugcacacuacucacaguuuuuagacuuguguuuugaguagaacuuccucucuuauaccuagauuuagucauuuaccagcacaguaauuugauuauaugggauagauuguacuauaacuggcuacuucuaucuugauagugagcauugguuggaauccuuuaaagacaaucacaaaauuaccuuucccugcacacagaugaacucucuuggaucaaauuugccuuauguauuggcuaguuuuuguucuuucagcauuacugagagauuguggcuguggaagaauaaaccacacuuuuauuccauuucauucauuaucugugaaauugccuggcaaguucugaugcaagaaucacuuauucuggaaugugguauauagaaaaggaaaguuugaucuucucucauuccaacucuaaauagaauaauuuuauggugcugaugguauuuguagcacuuucaaacuucugaugaaccagaaaggagguaagggauguaaguaccaguguugauugccagugguuucaugcuggugauaaucuauggagagaaaacucccucugaugucagaggacauacaagagagacugggcuugaguuacuuagcauuuaucuuccuguaaaguaguccagcucugcuuagauaauuaaguguggauuguccucccuguguagcugauguagguacuucuguaauauuuuccuuuauguaguaaaauuucacugugcaaaauucacugauaagacacagaaauguaaaagccacauaauucuagaucucauuccccccagcccauuuccagaauggauuucuugguguuuccaguuuuaugugagauauauugcuugauuuaugacuugguuaugugcaggcuuucuuuuucuucccacuugcaguuagauacugaguaggaagugaaauauuuucagagaucauguugguuuggggugguuguagcauuccagaaggaaaguguuguaccugguagcauuuguaagaggaaaccuggaggagagcucacuguaaaagcucugguagucccuggacagcugaaucuuuucccaucuuugauagacugcuguggaucagugagccuagaaccaggauuuuauugcuuccuuauagacagauacuucauaggggaaaaugguccuccaaguggcauuccuggacgagcagcaucagcaucaccugggaacuuguuagacaugcacauucaaggggcugccccagauguacugaaucacgcugugggguagggccagugaacugaguuuaagaagcccuccaggugauuucagugcuguucaggugugagaagcccuccuagagagucaacucuguggucuuugcagaaaaauaauuuuagaucuuuucuccuggaguuuuaaaguuuuguuagauuuaaauguaaaaguuggccccggaauagcuuguguucucucaaaggcuccuagcauugccuucauugccucucuuuguugauggaaguuugaauaaacauuuucccucagaauuguguggaacuuuuuacuuuuuaauguguucauagacaauaguagcauuuuaaaauauuguauucuuaagaugagaaguuguuuuauuguagaaaaaaaauuuucucaggaaacuuaaaaaucauaacuauuauuguccaguaaucauuuaaagaggcaaugaaaugacuuaagucauguaacauuuaaaacuguugucaauaaagauucuugaagcccaucucugcuacaggcuuagacuuagcaaaucacauucucaccucaauuagaaguuuggaagcaugugcugugaaaugacauaucuguacuauguuacaaagggcauauuuuaaagaguacuaaucaaccguuuuauuuugcaggaccaaucugacuauaaagugugauguauacauagagaccccugacacaggagguguguucauugcaggaagaguaaauaaaggugguauuuugauuagaagugccagaggaauuuucuucuggauuuuugcaaauggaucuuacaggguuacaggugauuuagguaacugacuuuuuuuuuuuuuaauagcauaugacuuaugggcuauguuacuuugagcaccuacuuguuauuugugggagugauaaaaagaauucaacccaagguguuuggacaucuaauugggaagggauguaagcaaauaccaaauaguuuacaauuauagaaaguuauuuaauuccuagagaugggggcagcucuguggaagggaaaauaauuguacaaagcuuuuaaggguauuguagaguugaacugggcugugaggauaggauuugcauagauaguaucaaaaccaucugagguaguggugguagggagagaaugcucaggaggcaccauaaauaaaagcaagaguauacgacuguugcugcuguaccuauagaaauauaaggaggggaauugaucggcuuaaaauggaaaaaucucauuuuugaauuuaguuaauacuugaaaauagcuugacuuuucucagucaucuuuacagcccuuguguuagguaggauaauauuuuauccagaauaggugcuucaaauauguucagauugaacuguguccacuucagauugguuuugauacacaccacuccuuugaagcuagaccuuacugguagugacuuuucuugauucucagucucuugacuuucgucuuaccuuaauuuaaaaauaucucuuuuauaguuuucugcucuuugcuuugacuccauaaauaaaauaaaaauuaaagaggaaguagguaguaaggauauuagaacaagaguuacauauucauagcauuaccaaucugaacuuaccucagugauacugaaaucgaaaacauagaaccagugagguuaauugaguggccuaaugacucaaagcuaguuaguggcagaacuggaacuaggaauuuaaaucugugucugcagucccuauugucuguuuuaaaccgccuacuugaaauuuuguccuggguuucucauaggcauucaaauaacacuaauuccaaaaauuaacuuacuauuuucucccucuaaguuaauacuauuaccaugugaccaauuagacuggcuggaaauuuuauauucugucucucuugucuuccauauucaauccagucauguauaaauguguacuugaacuacagaugcuaacaccucauacuaucacugguuuuuaaguuuauuucacugguucuguugugagcucacauauaguauauggcucagaguaggaucucaguauaugcuauuaaaugcauggcuaaaugaaaaauguuuuggcuuaacucaguuguagaucugggaaugaagggacauagcucucuguugaggcugacuuuacuacauacagaugccacucaagaaccccacugaauuauaugauucugugauugagaucucaaaauuauaucuauugggauaauauuuuuguguuacagcuggauggauuauauaugcuuuaggacguguugaaguuacagcaaaaaaaugguauacacucacguuaacuauuaagguaaguauugcugauuggagucuggagguaaaaugcucuuuuguugugcauuucuauaauuuucuguuauaaaauaggagggggaaagugugacauauaaugaagagagacaaagaaucugccuuggugccgggaagccacucaucccuaggauaguuacaugugugaggguaaccuaugugagaaccaucagcaguugacuuuaucaggucacuauuuuuuuaaaaaauuuuauuuuguuuuuuaaacugaggcauaauugauagagucaauaauugaacuauuuuuuucaaguuugcuugaaccaagacuguacauggagcuuauagauguaagcaaagccauaugcauuuauuuuugaugguuaagaauaauuugguuuucaauuauaagcauaauuuuuagaaauugguuuccaugaauauuuuagucagagaaaauaccagauuaauuuuaguauaauagaaauauaaaaauguuccugagaaucacugggugaucaugaguuacugcucgacagugcuuccaagggaugcugugcagauaaauuuuuguguauaauguguuggucucucccaagauagcucucucacaauuuuguuuagagugcaguagaaauuaaaaaucagauuccaauaacuuuggaauuuguucucucaaccaccaaaaaugacagcacuaauuauuuuuuagcauuaacaauauguauauugaagauuugguuuggauguagcauagauuauuuaacuauaccacacuagccaaauuguagccauuuuauagcaauuauaauaauauucacuauuauugaauuugaagauuuuuuccaaacucauagauaugauuuguauuuccuugauaauuagggagcuugcacaucuaauguuuacuggcuauuuguauuuucucuucucugaaguugccuguucacuucuuucuucauuuuucuaucauguugucuuuuucuggcaaauuugugugaauuuaauauguauucuggauaguaacccauugucuguuacauacgucacaacuaugcucuuccuucauguguauucuaauuuugcuuaugguauuuuugaugauuauaaguuuuacauuuugauacugucaaauauuucacuuuuuauucauugcuuuuauguuucauguuuuaaauaaggccuucuuguuucucaagguuaggaacauuuuucccccaagcuaaacaaaguuuaggauuuauuuuuauguguaagucuuuaauacgucagaaauuuacuugugaauuguaaggggaaguacugaauauaauuuuuuaaaaaauggauagccaucauuuauuacaauggacuauccuuuugcccauaauuuaaaggcuaccuuuuugauguaacaaaucagcacaugugcacaugcuuguuucugaacuuuuuucuguucuccauauugauguuugucuauuauuauccaaaaucacgcuuuuaauugguguucacauucuaaaagcuuugaugauacagcuacucccuugcuuccuucagaguuuucuuaccugaccaccugauagaaaacagcgccccaucucacucucuaacuccuuucuguugcuuuauuuuucuccaaaaguuuuaucccaagcugacaucacacauauucuguuaauuguucauguguuuuccuacucccuucacuagcacauagcuccuuuagugacaggcuuuucuccauauuccucacugcuggcucuguagcaccuagaaaagugccugacagccaggcagagcaagaguccgaauaauacuugguaaaugaaugaauggauaucugguggggcaacuuccucauuguuucuuuuucaaaauuaucuuugcuauuccacuauauauauuauucgauuugacuuuuaaaaaacaaacuuucaguuacuugaaaaauggugcugguauuacauuaaauuuacacaucaauuuaggaaaaaaugacuuuuuuuuuuuuaacaauaauguguuuccccaugagagaacacaggaacaaaagcaugcuauauuucaccauuuauuaagauuugccacuauguccuucaguuuuauuuuugcaaacuuuugauuagguuuguuuuaguaauuuuaugaguuuuuuugaaaucaugaaugagauuuuaaaaauuuucuuaauuuuuuucagguacuuugcauaccugguuaaaauaucaauaggaugugaggcaucuugccucacauccuguuccuucuucuugaccccauucugugucuuguacuucugauacagccacucuucacuauuuuagcuguuucuucuggugugucuuuaauacaaugugauucauuacuuuuaaaaauuggcucuugucuugcuacuaggauggauaggacuuugcuggcuugcacccaccucacuccccuacuccuguuauuuuguguuucaucaacuaugggcauucuguuuccucuugaaucucagcuuuugccacauacucugagggucuucuguaacuaucugcacuaaaguagucugucaggcacccauugucaccuugaccuggcuuaauuuuuacaugcuacuuaucuuuuagcucucauuuugugugugugugcauaucuguccaucuccuacuagaauauaagcuccauaagagcagggaccuugucuuucuuguucaucuuaaauucccagugcauuaaacaguauuugacauauaaaucuucuuugcguaaauaaaaaaaacaaaacaucaucuucuauguugcccauauuccaaauuacagcuaaugugaggauuuugucacugacuaucagccaccuguugaauucuucucagcacuugucaggugacuugucccaguucuguugcaugguggguagcacaauggacuuugaagucuacuauauucuacuugcaaguauuuuauauugcacagcuucaauuuucccauccaugauaucaugaagaacacuuuucuuaugaagauucaaugagaaaauaaauaaauauauauauauauauaguaccugauaugugguaagcacuuaaugagucaaguuaauauuuuuaggaguaggaguguuuggaaccagacagaccagcauucguauuuccucacuaacacaugcugagacuucuagcaaguuauuccaccucuuugaguauccauuuccuuaucugcaaaauggagauaacuucugugagguuguuuugaggguuaaauguguuucauucuuauauucaacacauuuuuauuaagccccuacuguaugcacuuuacuaaguccuagggauacagcagcgaacgaaacagacaagauuccugcucucuuagagcauauauucuucuaggacagggguuggcaacuuuuucuguaaagggccagauaguaaauauuuuagacuucgugggccauguggucucugcuguggcuacccaguucggcuauuguaaugaguaaaaaagccauagacaauagacaauaaugagaaaaaaagccauagacaauggauguggcuguguuucaguaagauuuuauuuauuaaaaaaagggcgguuggcauguaggucauaguuugcugagcccuauccugagauaauaaacuuguaaauaaguuuauaaaugauuaugaagaaaaaauagagucaugagauaaaguagcucuguuacccugauucucuaaccagggaggugaggaaagaccucacugaguggguaguacuugagugcagaccugaaugcugggaagaacaauuugagcagaccaaguggcaggugcaaaaggcagguguagcugacauugugugaagagcagccuggaggcugggguggcugaagucuggggagucaggagagauaagguccuguuagacagguuuugugcuuaaugugaucugugauuugagucccuuggcucgguguuaauauugaguguuugauggcagcagaagauguucaguaagcacuucuagagcugaagauagcugugcaagucuguaguaauaggaauguggcucugaauuuggagcuagguaacuuggagugaaaaccugugacuuugagcuuuaaucuauuaagccucaguguuuccacgcauaaaauaaaagaacuaaauuaaggcccauuacguuauacuuccaagacuuaaaagcagauuuauucugguucuuggcccagugcuuugaguuuugagcucuucaccuucugagaguagcuaguuuuauaugauugacuguaguuaguaugcugugaauaugugcucauaaauguacuaucauaaagauaauaagagcugagauuuauuguuuaccaugugccaggcacugagcuaaguagaauggcaacauucggaggaagguguaauuuuuucuuucacugucagugaccaguaagucacaccuuauagaugccucccuucuuccacccgcugcacccuacuccagcaucacuuuaacugaugguuacuguuuuuccaacuuaaggguaggagcuucauauggcuuugaagugauauucuauucauggcaacaaaacacaaaaacuaagguuaauuauuuuucuucuggcugggcagaggcuccuuaaugaaaaccuuaaggaagcaaugagguagaagcagauguuuugacuccagcagucaugucugaagagcugguggcuguuagccacaccacuuguacaugugacuacuuauaaauaacuuuuguuaaauuuuaaugagcuuuuuucuaaaacuuuauaauaaugccugaaaaguuuugcauuuuguugguuuuaaauuuugguggagcacaggaaauauugagguauuccuuguacuuugggaacgauuuaaguagguagauaagaauuucuuccuagaguuuuuuccuguauuuuaaacuuuugcucaaacuuguggaauuguguuuugcugugguuaagucuugagugaguaguacauuugcuccacuaaguagugggccauacaugaucaagaaacagacuucagaggaccauuuucauaugguuucaaggaauguguuucuuucuacucuagggucauuucaccucuggcaugcugaaugacaagucucuguggacagacaucccugugaauuuuccaaagaauggcugggcugcaauuggaacucacuccuuugaauuugcacaguuugacaacuuucuuguggaagccacacgcuaauacuuaacagggcaucauagaauacucuggauuuucuucccuucuuuuugguuuugguucagagccaauucuuguuucauuggaacaguauaugaggcuuuugagacuaaaaauaaugaagaguaaaaggggagagaaauuuauuuuuaauuuacccuguggaagauuuuauuagaauuaauuccaaggggaaaacuggugaaucuuuaacauuaccugguguguucccuaacauucaaacugugcauuggccauacccuuaggagugguuugaguaguacagaccucgaagccuugcugcuaacacugagguagcucucuucaucuuauuugcaagcgguccuguagauggcaguaacuugaucaucacugagauguauuuaugcaugcugaccguguguccaagugagccagugucuucaucacaagaugaugcugccauaauagaaagcugaagaacacuagaaguagcuuuuugaaaaccacuucaaccuguuaugcuuuaugcucuaaaaaguauuuuuuuauuuuccuuuuuaagaugauacuuuugaaaugcaggauaugaugagugggaugauuuuaaaaaugccucuuuaauaaacuaccucuaacacuauuucugcaguaauagauauuagcagauuaauuggguuauuugcauuauuuaauuuuuuugauuccaaguuuuggucuuguaaccacuauaacucucugugaacguuuuuccagguggcuggaagaaggaagaaaaccugauauagccaaugcuguuguagucguuuccucagccucaucucacugugcuguggucuguccucacaugugcacugguaacagacucacacagcugaugaaugcuuuucucuccuuauguguggaaggaggggagcacuuagacauuugcuaacucccagaauuggaucaucuccuaagauguacuuacuuuuuaaaguccaaauauguuuauauuuaaauauacgugagcguguucaucauguuguaugauuuauacuaagcauuaauguggcucuauguagcaaaucaguuauucauguagguaaaguaaaucuagaauuauuuauaagaauuacucauugaacuaauucuacuauuuaggaauuuguaagagucuaacauaggcuuagcuacagugaaguuuugcauugcuuuugaagacaagaagauaagugcuagaauaaauaagauuacagagaaaauuuuuuguuaaaaccaagugauuuccagcugauguaucuaauauuuuuuaaaacgaacauuauagagguguaauuuauuuacaauaaaauguuccuacuuuaaauauacaauucagugaguuuugauaaauugauauacccauguaaccaacacuccagucaagcuucagaauauuuccaucaccccagaagguucucuuguauaccugcucagucaguuccuuucacucccaauuguuggcagccauugauaggaauucuaucacuauagguuaguuuucuuuguuccagaacaucaugaaagcggcgucauguacuguguauucuuaugaaugguuucuuuccaucagcauaaugauuugagauuuguccauguugugugauucagugguuuguuccuucuuauuucugaagaguuuuccauuguaugaauauaccacaauuuguuuccuccccaccaguuucugauacuacaauuaaaacugucuacauuuacaa

SEQ ID NO: 192378 - RNA, 52817 nt, Homo sapiens
acaauagcgacucacuggacccagcccuuagcaacggccuggcaacgguuucccugcugcugcagcccccgucggcuccucuuuuccaguccuccacugccggggcugggcccggccgcgggaaggaccgaaggggauacagcgugucccugcggcggcugcaagaggacuaagcauggauggcagccggagagguaaagggcagcugucaggggcuaccgccgccucgccccucgcuccaggcggcgcucccagccucggguccgggcagcugagugcaaggccgccccuuggggcgcuuccuaccccuggcugagucgccaguguugccuggagcugcccaggccugcgcaaaggaagagggagagccugcuugccagccucgcagguccgcuucuuugcccugaauuugucgcccugacaccaggggccccugucuccugaacucagggucgugcagccuuuaaaaccucaguagcucccaggcagaggaaccagguuuggucuuuggagucagaccuccccgggccccaaaucaaaccccucugcucuccauggagacgacccucaguuuucuuaucucuugaacgugagggucaaauacccaggccauggaguucuugaggauuaaaugcagauaauauagagaagauccuggcgcauuugaaguggucaguaaauacgaaaucucccaguaacgaacuaccucccccaaagcuacugaguaacccaggguuucuguaacuuucugugaauaggaauccccucagggucauguuaaaaugcagauuaugauucaguaggucccuuggggguggcugagauuuugcauuuauaauaaauuccaaguaaugcgguguugcuggucagcggacugcaguuuuagcagcaauccguacucaccauauacaccuguucucuacugauuucuugagucagguggacaucauguggugggguuggggguggggaaauacaaucuuaaauaucuacaaaucggcccaaaccaaauaauuugcauuuucacacuuucugagccaguaucauucuuuccucgagucaaaugaggcaaucuuuauagacuccccgccccucccaauucaguguuuuuaucuauuuaaaagacugccuuuaaaccaagcugcuagaugauuccuugaugucuuucuuugaaugagucugccuuuauuauauagucauugaucaaaauaagugcuacuccgaauguaggagauaacuauucauugaucagcaaacuauucugacacuucaccaaccuagguuucagaaaaagcaaaucaaaacgcuuuaugaucuuaagaaauuuugcauauaaacuaacauuaaacccuugcuauguacuaggaacuauuuccaaauuaucucauuuaauguacaaaaauaccuugauaggcauuagccuuauuucauagugaagaaacuaaagcaaaagaucacaaauaacuugccaagaucacagcggcagaacaggauuugaaucuaggugaagaauauaaaucugaagccaaugcauuuacuuacuaucccaugguagggaugggcagggggaaaggauaaauguaacauuuagaguaugguagauuuaguaaguugucaguauuuguuuauugaauuauuuuaaaaauuggguucaugccaaauguaaaaagguuuauauuuuuacaacuugcacaauuuaauuagcuucauuuuuaggaaauaauauaugauaaugucaaauacuguuauuuugaauuuuuaaaauaaauguaaucaccaaauaaccagggcagucagcuuucauguacuguaaauuaauaggaaaccauaaauaauuuuagacacagcuaaaauaauugagaauaaauuucuuagauuucauuaggaggugcuuuuaguuauuucagagcauaaaauauuaaaacaucuaaagaaaaauuaucuuuugucaugcucuuacuguaaucacguuuuagacauucuuuuguaaggcaagccuucuaaauggugguauaguacagcaccagacugaaaaacgguuagucuuguuuguaaucuuuguuuccuacuaacuaacuagguaaucuucagcaugucacuguacgucccugggccucaguuauuuauaaaaugggggcuuggacuagguauauauaaggcaugguuuccagcuuccuaugggggaaggugaagaaaagauugagaauaacaaacugccauucacucuaauaucaaugaccuuuaggaaggagaggagacaaccuauuaguauauuacugaaaguaacuugaaaaaaaauuuuuucccagcacucugggaggcugaggcagguggaucacuugaggucaggaguuugagaccagccugggcaacagaauuaaacccugucuccaccaaaaaauacaaaaauuagccaggcaugguggcgugcgccuguagucccagcuacucgggaggcuaaggcaggagaaucacuugaaccugggagggggagguugcagugagccaagaucaugccacugcccuccagccugggcaacagagcaagacuccaucucaaaaaaaaaauuguuuugaucuguuggucucauagagacacuuaucaaugguagauuuccaaaccuuugguuuuccagagaaaccuugccacaagaaacacuuucaucuuuccucacuggacuuucuucuggcuauuuuaaucaaauuguguaggaaaaugggcugcucucauauaccagugaauuucaccacuaagaccuucaaucucauugacaagauuuuaguccuaauaguuagagaaugauguucuuuuccuuggcauuugguuugaggcuacuucuccaugccccuuuggcucauucuggguccaguccagucaggagauagaaaccauacagugauuuuuauacaaggaaaaguuaaagaauuguuauacuuucauaaaagaguaacuauaagauguaaggggcugggcgugucagcucaugccuguaaucucagcauuuuaggaggcugaggcaggagcaucacuugaggucagugguuuguaaucagccuggguaacauagcaagacccugucucuaguauauaaaacaaauuaaugaauuaauuaaaaagauaagaaaacuguauuugguaccuagaauuacgggaaaguacucaaagaaggacaauuugaaagagaguuucucccaaagacugggguucagaccucauuagagaaggcgugauugugcacuugcccaaagcuucaucaccgaggagugauaucggaggcuucacauuccaugggaaauagacuuugauaaauugcuuagccaagucacuaaacaaacaagugaacaacaaugaaaacaagcucaggagaggauucuguaucuagaguugcugcaauauauuaccuaaaauguuaacuuuucaacaaaaagaaauugcaagucaugcaaaaaaacaaaaacaaaaaaacaggaaaaugugaccuauacacaggacacaaaggaggaaccagaaacuaugagaggguagaugaauuaaaucgucuuauuucuccccucaauucuguuagguuuuuuuuuuuccuuucucuuucuuuuuucuuuuuucgagacagggucuuauucuguuacccagacuggagugcauugcagccuccugggcucaaucauccucccaucucagccuccuguguagcugggacuacaggcacacaccaccacacccagcuaauuuuguauuuuuuugugcaguuagaguuucgccauguuguccaggcuggucuuugaacuucugggcuuaggugaucagccugccucagucucccaaagugcugggauuacaagcacgagccauugugcucagcccuaauucugucauuuuuaauaugacauguaucuauaggaauauuagaaaccaaugaguauaugccuugguguacgucugaugguaaauagacaagggaacauagacaucaaggaacaucuaaauuccauguuuguucuuaucaccaucuuaugcuaaagagcagcuggauugauuccuggggccaaauauuaaccaccuuguucacagcugucacuuacagauggguggggaagcauuucuauccagagcauuaucacuagguuccagccuuuuuucauucucuuuucauccuuucacacuucucuggguauaccuguuuuuccuuuuucugugaccuauagugaaacauacauagaauagaauggaauuuggagggaauaaacuacauacagcugagauaucuucuuggucuguuucacaugauuuaguagcuuagaacaugguucaaguacugagcaguuuauauuggucaagauaguguaaugauuaagacccaggaaacagacugcuuggguucagaucccaaaucugucacauucuuguguaaucuuuggcaaauuacaaguuuaaccucugugcuucaauuacccucaucuauaaaguagggagaauuauaguauuguaaggauuaaaugaauuuauaccagcaaagugcuuggagcacugccuggcaggguuaccacucaauaaauuagccuuuugacuacaaaugaagaaaucaacucauacugguuuaagcuaaaaugggaauuuuuuuuuuuuuuuggcuaauguaaagaaacgucuagggaaggaagagcuucaaacaugguuggccucagguacucaaaugaugucaccaagaaaucgcuuucuaucuugguuccacuugacuguguaggcuucauucucagacagguuccuuuauaagguucaggauggccaccagcaauacagggcuugcuuagacccuucacuggguuuagcaagcccagugaaaugaaaguaccuuuccuaauaguuccugucaaaggcccaggauuguguaucucauguugggacuuggaucgcauagcauugcugacgcugucaacacagcuguccacauuuggguuuuaugccuaacccugacaguggggucagcucuauuugaaccaccugggcuaagaguaagggaagagucgcccaaaggaaaguugaguugucauuuccaggugaagaggcauugaauucuggacaagaaaaaagucacaguucuuucuaucuggagaaaugagguuuuucugagaguuuguugguauuuuuucuuauguuuaggucuuacccuccuucuuucuugguagaagcuaugcucauuucaugacuaucuuuuuucccaguucagauggcaucaccuugacuuguauuguccuaaauauuuuuuuccuuccugcacucugaccugugacauagaaagagcuucauagauauucugaccucaguuuguuuuucuguuuuaaucuauucugacaagcuuuguucucuggucuuagauuuuaguucuccuagcucgauacuucuuuuuucuauauuuagucauccauauaucuucuagacuuucuauguguccuccuuguuauagcuuuuaacagcccaccugauagcaaacuagccaucuuacccucuuaaaacaucucuguuugggggauaaagcauuuauauuuugcauauuaaauuacauuuaaugcuguaacucagacuuccuguuuuggagauuacuacuaaaaacgcaaucaccuuuuaggaaagaaauuauuuugugauaaauuuauuauuuaaaaaauauugaauauuguuguuuuuguaaaaguuguguuucauuuauccuaauuuaugauuuuuuuuucuuguuaaaagucagagcaaccucuguccuucccagauaugguccaccgugccuauuuaaaggacacuugagcaccaaaaguaaugguaagugaggugcuuaaaacggcagcuuuguuagaagauugucugaguguuuccuuuacuggcaaauuauaugacaugauggaaaaauuguuucauuugacgaauauuugaacuucauauuauuaauuuuaaugaaauauaggcguucuugagauuagagaauuuuggagucuaugauuucaaacuauuauugugcccuggauguggacuuggcugucuccugcucccagcugcuacagcagcccagcucuacuuuugccaggaaacuacccugauuuaaggcauaccugccuuguuaaaauggugaguagcagguauuaaagacgcaagcacugaaaaggaaaagcugugcagagaaaaagagcacuugaauaauacauuuccuauuaggagcaaaggccuaugggccucuuuauccaacuggauuucuaggugcugugauauuuuuauauuuuaaagcuuucaagguacauuuuuaagguagguuuuaaaauaaauuuuuguaauuauaccuuagaaguauaagucuauguccuuaggcaaaauaauuaaagccuuauuuuccuuauuuacaggaaaaaucuuugauacuguuaccuccaaaugugguggaaggaucucauuuucaguugccucacuuauuucuuuguauuacaguguauuuuuuaaaguuuaugauuguggcuauguauguauguaacauauauauguauguaacauagccauaaugauaaacuuuaaaaacuaaauuuuaaauaaaaaguuaaaacuagauuuaaaauauacauacauagaaaucaggauaaagaacaauauguaaaguuugcuaacuuucuuuuaaagaauauauauauagagcugguauagguauggugguuuuaaguaugaggcugccuuggaucacauggaagcugcauccuuuaucagcaguguaaccuugaagauguaacucauaucucugugccucaguuuucacuucgauuaaaugauaauaauaaugacuagauaaguuuauacauauaaagaguuuagaacaaugcaugguaaauggcauuuauucaguaaauauuuuuaguaguggcaucaagcucguaauuauugcauaggcuuguauuaugcacagagucucuggaaggaugcauuuaaacaguaacauaguauauuucugggaagggagacuaaaggucaggguagagaaaucacuucuuuuucaaacuccauaugccauuuuagcuguugaauuuuuuuaaccacauugcguguauuacuucucaaaaacuguuuuuaauguuuaaaaaagcuuugccuauauuuauauuuuauacuuguguguaagugcuuaacuauuucuaagauuucuuuuaaacaguuugaaugaggaccaaggaguuuaaugucauggaauuucuuugcgauuacacuuguuauaagauaguuuuaguacuucaaaaagaauguaguaaacugguauguagaucuuguuuucagguuuaaguuagaaauuugcuucuuggaauauaauuuuuguauguaggguuuugggauuugguagucauugaauuucugaaauuccguugauuaaguauuaacaaugguaacuaauuaagcaagcagcuaaacauccuuaguuagaagauugagagcugucaaaaaaaaaauaguucuguaaauguaaugacagaucauauccuagaaucucuuccccagagucucaggcuuguaaaauuuuauucucaggaagguuugaacccaaauggucaauagcucauuggcauuaucagugcaagauuaaagcuucacaucacaaugucauauaucaauaucucugguugaauuucagaacauuuuauaagaaugaguuaaauaaucagugccuuguuuaucucaugauuuuuauauuaguuuuaaauauauaaugauuauguuuuaauuuuuagcuuuuugcacugacuccucuucucucagacuaagcacucuccagcuggucaagaaucacauggcuguucacuauaauaaaauccuuucagccaaagguaaaaaugugcaaaugugaacucucuguacucaauuuaaaccuccagcuucacuucucauuaaaauauaucuauagcaaaaaugaauaccuuauauauaugagaggauuuguauuuguuugguuuagugugauacaaacuauugacucuagguacuuagcaaauucauacccauuuuuguuaacuauauuugaaaucuauauauugccuauuuuauuucguuuuuuaucucuauugcuaauaauauuuuguuagauauugcuuuuaauaugaaaauauauaaucugcuuuuuuguuuacacaucuauggaaguugcacaaagaagaugcuauuuuucuguuuaauuuuuuucuuuugucagcuuuauugagauaaaacuuacauuauaaaaugcauugauuauaauguguacagauaaauauuuugaaaaaugaacacauuuguauaaauacuacuacaaccaugcuguaaaacaggaaucagcuaacuacaccguucaggccaaacccuccuaccaccuguuucuguacagcccaugaacuaagaaugguguucauauuuuuaaaugguagcaaaaaauuuaaaaaaaaguauuuugugaccugaaauucaaauguaguuauccauagacaaacaaucauuuucaaucuuuuacauauugucuguggcagcuuuuacacuaaaaagcagaguugaccaguuguaacagacuguaucacccugcaaauccugaagcauuugcuaccuggcccuuuguagaaaaaauuugccaacccuugauauagaaaaaguccauuaccucaaagaguucccccuaguccuuugccgucaguccccuccugacaaaucccuggcaaccacugaucugcucuuucgccuauaguuuuaccuuuucuauaaguucauagaaauggaaucauguaucguuuugggucuggcuuuuuucaguuaucuuaaugaucuugagacuaauucacacuguucuguguaccaccauuuauucuuuuguauuguuaaggaguauuucauuuaaugaauagaccacaauuuguuuaugauucaccaguuguuaaacauuuggauuguuuugacucacuuuuggccauuaggaauaaagcugcuauaaacauucacauauaauuuuggcgcauguguuuacguuucacucggguaaauuuaugugucaggaguagaacugugagguaauauauuaaguauaaguuuaauuuuauaagaaacuacaguuuuccagagugaauauaccauuuacauuuccauuacuucugcacccuuaccaacccuuggcguugacaguccuuuuuuaaccauucuagugaauaugaaauaguaucacuucauaguuuuaguuugcauuucccugauuucuagugauguugccuuauuacuucccaucuguauaucuucuuuggugaaaugacuguucaaaucuuuuacccauuauuaaaaauggguuguuugucucuuuaguauuaaguugugaguuucuuuauauacagauucuauaucagauauauguuuugcagauauuuuuuucccaaucuguagcugguguuuucauuuucuuguuaaaauucguauucuggagaaauuuuuagacuuacauaaacauuuaaaaauuguauagggaguuaccauauacccuguacucugcucuuccacuaauguuaaaaaucuuaaaaaccgugguauaguuaucaaaaccaggaaaucaauauugaugcaaucccauuaacuacagaccuuauuugaauuucaccaauuuuugacuaaugucuuuuaaauuuuuauuuucucauuuaaauagcuaaaguuuuuaaauuuuaguuuauauuuuaugaugcuuauauuuuuaaaugacuaaaaaaacaaaagaaaaauauuuugugacaugaaaaucgugaagucguuuaguuuuuuaguuuuauaaacuaaacagguuauuucauaaccuguucaagaaauauuugccuaaccuuaggucacucagaauuucuuaauauguuuucuucuagaaguuuuaaaguuuuagcccuuacauuuaaauuugcgauccauuuugaguuaguuuuuguauauggugugauauaaggguuuugagguuuuuuguuuguuuuguuuuuuugccucuucauauccaaauuucccaguaccauuuguugaagagguuaucuuuucucuauuuaauuguccuaguacuuuuugaaagucaguugaccauaugugugggucuguuucuggacuuaacuccuugguucuguugaucuauaugucuaucuuuaagccccaugccacacugccuuaauuauuguagcauuacaguaagucuugaaaucagguaguguaagucuuccauuuugcuuuuuuuuccccaagcuuguuuugggacuacauuauaaguauguuaagucuguuucauuuugaguaguuuauauugcuaugucuucaaguucacuaguauuuucuucugcaguauugaaugaguuauuaaucccaacaguguauuuuuaaucaaggaucuuguguuuuccaucgcuagaaguaugauaaacagcugcaaggucuggaacauuuugugauuuccacauuugguauuugucauuuauaaauacugacaauauuauuaaacuauuaccuuucucuuucagcugcaguagacugcucgguuccaguaagcgugaguaccagcauaaaguguaaguaauuuuuggacauuauuaccuuuuuaaaaaaaaauuaagguaaauauacauaacauaaaauuuacugucuuaaccauuuuuaaguguccaguucaauauuaaguacauuaauauugugguacaaugauaacuacuaccuccagaacucucuuuauacugcaaaacugaaauuccugugccacauaaacaauaauuuccucccauaggcccuggaaaccaacauucuuuucuaucacuaugaauuugacuacugucaccauuguacuuacuaucucuaugaaucuauuuuagguaccuuauauaaguggaaucauaucguguuuguucuguugugacuggcuuauuucaccuagcaugauguucucaagguucacccauauuguaaugagucagaaucuccuuuuuaaaggcugaauaaaauuccauucuguguauauaccacauuuuacuuaugcauucgucaguugauggacacuugaguuacagucaccuuuuggcuguugugaauaaacuauacugcuauggacaugaguauacaaauaccucuucaagacccuccuuuuaaagauuuuggguguauauuuagaaguggaauugcuaaaucauauauucuauuuuuaauuuuuugagaaacuaccauacuauuuucuuuucuuuucuuuuuucuuuuuuuuuuuuugagacagggucucacucuauugcccuggggcuaaagugcaguggaacgaucucaccucacuguaaccuccaccuccugggcucaagcaauccucccaccucagccucccaacagccucccaaguaggugggacuacaggcgcaagccaccacgcacagcuaauuuugccacagccuuuuuacauagagacaggguuuuaccauguugcccaggcuugucucaaacuccugagcucaagugauccaccugacucagucccccaaagugcugggauuauaggcgugagccacugcacccagugaccauauugcuuucuauagcagcugcaccauuuuccauuaugacuaaugaugcucaaguauucagauuuccccauguccuccccaacacuugcuuuuuccuauuuguuuaauaguagccauacuaaaagguguugacacauugccuuuugagaaagcauuucuaacuuaaaaauuauccaaaaauacccaggcacaguggcucacaccuaugggagacagaggcaaguggaucacuugagcccaggcauuuaagaguagccuaggcaacauggugaaacccugucucuucaaaaaauacaaaaauuagcuggaugugguggcaugcaacucuggucccagcuacucaggaggcuaaggugggaagauuacuugagccagggaggucaaggcugcaguaagccaugaucaugccacugcacucuggccuaggugacagggagaugcugucucaagaaaaaaaaaaaaaaaggaaaaagaaaacccauaauguugacacaggauauauagaauccuuauauaucuacccuuugaccagguuaucuucauuuuuaaaucaucagaccaaaaauuugaaaacccuguuuaaaaauuucugaagaauaccauuugaaaccuuuguuuuugauuucaauuaagaaauguauacuuuaugggaggccgaggcaggcggaucacgaggucaggagaucgagaccaaccuggcuaacagggugaaaccccgucucuacuaaaaaacaaaaaauuagcugggugugguggugggcaccuguagucccagcuacucuggaggcugaggcaggagaauggcgugaacccgggagguggagcuugcagugagcagagaucgcaucacugcacuccagccugggcgagagagcaagacaccgucucaaaaaaaaaaaagaaauguauccuuuaaaaauaggcaaaaaacauggcugucacagccuuugauugucguauuaaucauauaaaaaucaguguuauacguauguuuauugcagcacuauucacaauagcaaagacuuggaaccaacccaaauguccaacaaugauagacuggauuaagaaaauguggcacauauacaccauggaauacuaugcagccauaaaaaaugaugaguucauguccuuuguagggacagggaugaaauuggaaaucaucauucucaguaaacuaucacaagaccaaaaaacuaaacaccgcauauucucacucauaggugagaauugaacaaugagaucacauggacacaggaaggggaacaucacacucuggggacuguugugggguggggggaggggggagggauagcauugggagauauaccuaaugcuagaugacgaguuagugggugcagcgcaccagcguggcacauguauacauauguaacuaaccugcacaaugugcacauguacccuaaaacuuaaaguauaauaauaaaauuuuaaaaaaagauaaaaaaaaaucaguguuauaaauuuuaaguuuaguguuuucuaaguuucuaaguuuucuaaguuaauauuugaauuuauguagaguuugagaacauuucuacauuaaaaaaguaaauaucagccaggugcaguggcucaugccuguaaucccagcacuuugggaggcugaggcgggcggaucacgaggucaggagaucgagacuauccuggcuaacacggugaaacccugucucuacuaaaaguacaaaaaauuagcugggcaugguggcaggcgccuguagucccagcugcucgggaggcugaggcaggagaauggcgugaacccaggaggcggagcuugcagugagccgagaugaugccacugcacuccagccugggcaacagugcaagacuccgucucaaaaaaaaaaaaaaagaaaaaaaaguaaauaucaaccuaagguuaauucaugcuaaaugauaaaugaauaaaagcauacauagggaaaugccuuuugggugcaaucuaggaaagaucacaaacaguaggaaugguuaacucaucucugcuuguauaucuuaguugaagagauagaagguaggggagaaaguaacuaccagcuauaggucauagcuacaaacacagugucugucucaggccuugugcuugacacuuuguauucucccuuuucuauucuuuuuauguuugcaacaaaccuucguguaggcugucauauuuuugaaggaaaauuagauucaaauaauuuuaaaggaggaaaaaaggcauguuaggcaagaguagagacuucuuaguacauauuuuuaaagaccaguuuggucgcuacauacaaguuauaugggcaagucauuuuaccucugaccuuccuuuuuugugaaaugaaagguaauuagaugauuucuaaggacccuuccagauuuuuaauuucugugcuuuacauuuuuuucuucuguaucauauuaguaacuuuuuuguagcacaaaacugguucaguguuuacaugcuuuaaauaucuggaucauuugaauuaaguugguugggauuacaggcgugagccaccgcgccuggccuuaaaaugaucucuagagacaaugacagccauuauauaauuuuuaaagggucaacuuaacaggaagauguaacaauuaucuacauacccaacaucagaacuccuaaauauaucaugcaauuguggacaaaucugagggagaaauugacuuuaauacaauaauagaagacuucaauaauccacuuucaauaguggauacauauuauaagacccagacagaaaucauuuaaaccgcugacuugaacaacauaauagaccaaaggaauuuaacagauauauacagaccuuuauacccuauugaagaauacgcacuccucaagugcacaugaaaccuucuucagaauagaucucauauuaggccauaaaaucagacguaacauauuuaagaagauaaaaaucauuucaaguaucuuuuucaaccagaauggaauaaaacuaauaauuaauagcuguaagaaaaugggaaauucacaaauacauggcaacuaaacaacacauucuugaacaaguauugagucaaagaagaaauaaaaacagaauuuugauaucuugaggcaaaggaaaacaaaaccacaauauaccaaaacuuacagaaugcagcaaaauuaguacuaagagagugguuuauagugaugaauacuuacauuaaaagaggggaucucaaacaacucaacuguauaccucaaggaacuagaaaaagaagaauaaacuaagcccaccucgguaaaucccuagaaacauacaaccuucaaaaacugaaucaagaagaaauauccugaauagacuaauagaaaaaaggagauugaaucaguaaucaaaaacuucccaacagaggccacaugugguggcucaugccuguaaucccagcacuuugggaggccaagacaggcagaucacuugaggucaggaguucaagacccucuggccaacauggugaaaccccgacucuacuaaaaaauacaaaaaauuagccagaugugguguugcacaccuguaaucccagcuacucaggaggcugaggcaggagaaucacuugaauccaggagguggagguugcagugagcugagaucaugccccugcacuccagccugggugacagaaugggauaaaaucucaaaaaaauaaaauuaaaaauuaaaaaaaacuucccaacaaagaauagcccaggaccagauaucuucauagguaaaucuaccaaauauucaaagaaaggauagcaccaguccuucuuaaacuuuuauaaaaauagaagugggaauaccuccaaacucauuuuaugaggcuagcaccacccugaugccaaaaccaaacaaagacaacacaagaaaagaaagcuacaggccaauauaucugauugauauaagugcagaaaucuucaguaaaauaccagcaaacugaauucaauugcauguuaaaagagucaaacaccaugaccaagucagauuuaucccugggauacaaaggugguucaacauaugcaaaucaaccaaugugauauaccacaguaacauagugaaagauuaaaaaccacacaaucaucucaauacaugcagaaaaaccauuugacaaaauucagcauccauucaugauaaacucucucaacaaaauaggaauagaaggaacuuacuucaacagcaugaaagcuauauaugaaaaucucacagguaacaugaugcuuaaugaagaaaaacaaagcuuuuccucuaagaucugguauaaggcaaggauuccucacuuuugccacuucuguuuaacauaguauuggaaguccuagccagagcaauuagacaagaaaaagaaauaaaaggcauacgaauuagaaagaaagcaguagagcuggguguggugguucacuccuguaauugcaauacuuugggggaccaagguggagagaucacuugaggccaggaguggccagccugggcaacauaguaagaccaugccucuacaaaauaaaaaaacuaaaaauuaaccaggcauggugacacauaccuguaguccuagcuacauuggaggcugaggcaguaggaucacuugagcccaggaauucaaggucacagugggcuuugaccgugccacugaauuccagcuugggcagcagagaaagacccugucucaaaaaaaaaaaaaaaaaaaaaaaaaaguaagguuacuucuguuugugaugacaugauauauauguagaauacccuaaugcccaauaaaaaagaacuguugcaauaaauucaauauaguuuuaggauacaaaauuaauguacaaaaaccaguggcauuucuguacacaaacaacugucugaaaaggaaauuaagaaaacaaugccauuugcaacagcaacagaaaggauaaaaugcuuaggaauaaccuuaaacaaaaagguugaaaacuuguacacugaaaacuauaaaacaucaauaaaggaaauuuuagaagacacagauaaauggaagacauccauauuuaugaauuggaauaauuaauauuguuauaauuuuuguacuacccaaaguagucuauaaauucacugcaaucccuauagaaaucccaaagacauucuuuacagaaauagaacaaacaaucguaaaauucaugugggaccacaaaagaccacaaauaaaacaaucuugagcaagaaaaacaaggcuggagaaaucacacuuucuaaauuucaaaauauauuucaaagcuacaauaaucaaaacaguauggaacuggcaaaaaaaaacacauaccagaccaauggaaaagaauggagaacccagaaauaaauccauguguuuauagucaacuuaucuucaaaaggguaccaaacacacacaguggggaaaggauagugucaucaaugaaugacucugggaaaccuggauagucccaugcagaaggaugaaaauggacucuuaaaccauagacaaaaaucaacucauacaaaaaucagcucaaaauggauuuaaaaacuuaaauauaagguccuaauccauaaaacuacuagaagagaacauagaaaaaaagcuucuuggcuuuagucugggcaauaauauuuuuggauaugacucugaaagccaggcaacaaaagcaaaaauagacaaguggaauucaccaaacucaaaagcuuuuguacagcaaaggaaacaaucgacagagugcauaggcaacuuacagaaugggaggaaauauuugcaaaccauguaucugauaagagguuaauaucccaacuguguaaguaauaaguacaacucaauagcaaaaaaaaaaaaaaaaaaaaaaaacccaaaaccuugcuauaaaaaugcaugaaggaccugaguagacauucucaaaggaagacauacaaguggccaauaaguguaugaaaaggugcuuaacauuacuaauuaucagggaaaugcaaaucaaaaccuuaaugagauaucacucacaccugugagaauggcuaucaaaaagacaacauguaacaaguguuggcaaggauguggaggaaagggaacacuugugcacuguugcuaggaauguaaguugguacagccauuaggcaaaucaauauagaggcuccucgagaaauugaaaauagaacuaccauacgauuaagcaaucccacuucugaauauauauccaaaggaaaugaaaucaguaugucaaggagauaucuguucucccauguuuguuacagcauuauagcaaauagucaagauauagaaacaaccuaaauguugacagaugaauggauaaagaaaaugugguauguguauaaagaaauacuacacacacauacacacaacccacaccacauuuauaacauacacagacacaugcaaaacccacaccacauagccuuuaaaaagaaggaaauccugucauuucugucauuugugacaacacagaugaaccugaggguucauuuuagcuuccacauauaagugagaucacgugguacuugccugugucuggauuauuaaacauguguaugugcaaucuaaagugggcaaccucagagaggcagagaguagaauggaaguugccaggggcuacaggaaggaggaaauggggagauguuggucaaagaguacaaaguuuuaguuaaugcaaguugaguaaguucuggagaucuaauguacagcauuaauuagaguuaacaguacuguauaauauacuugaaauuugcuaagacaguacaucuguguucucaccacaaaaaaaagaaaaaguagcaacuauguuaggugauagauguauuaauuaucuugauuaugaucauucacaauguauaucagaauaucaaauuaaaugccugaaacauauacaguuugucugcuauaccuuaacaaagcugaaaaaauuauuaccuaagcaaccugauauauauauaaacuuaaauagaauggccaucuggucaugacuggaaagaauauauuaaccagauauauuugguuaauguauugacuggaccaaaagaaaaggcauaucuuguuauaagauagaaagacucuauauaaugcaaauauauugauacauacuuuuuaaaguauugauacuuuuuaaaguaauuucuaaauucaaugugagcucaauuaagaugccaaaaaucaguauuguucauacacuacuugacaaaauguuccaaaauuaaccuacauauauaugagaaaauagccagaaauaaucugaacaugaauagaaaagaguaguagaguagcccuacuaaguauuuaaaaguauuuuaggucaggcguuguggcucacgccuguaaucccagcacuuugggaggccaagacgggaggaucacuugaggucaugaguucgagaccagccuggccaacauaaugaaacccguucucuacuaaaaauacagaaauuagccaggugugguggcaugcaccuguaguuccagcuacucgggaggcugagacaugagaaucacuugaacccgggagggggagguugcagugagccaagaucaugccauugcacuccagccugggcaacaagagugaaacucugucucaaaaaaaauaaagucaaaaucacaaauuuaaaauggucauuuaauuuauuuugcuagaguaacaaaauaacauuuaauuuaguuugcuagaguuuauucauugauuuauucagcauauauuuauugggccccugcuaugugcuagacauuguucuaagggcugggacuaaagaggugaacaggacaaauuuccugcuuuuguagaguuuacauuguaguuggagaagacaaacaauaagcaaauacaaauaaauaaagaauaugucauaugguaauaaaugcaauggaaaaaaaaugacugagagucccuuggaggagaagcccuugcugauaaggugacaauugagcagagaccugaaagaauuaaggaagaggcauguggcuaucuggggaaaaagcaauccagacagaggaaacagcaaguuuaaaagccuugaaauggugucaugauugguguuuucaaaaaacagcaaggagggcuguguagcuaguauggaauaagccaacugaagaguaauagaugaagucacugagaugggacagagggaugcagagaauaaaaggcaguggccauugcaaagacuuuggccuucacucugaaugaaauugcaagccauuggagggucuugaagagaggaguagcagggcuacuuuuacuuuuaaaagcaucccuuuggcuucauaguugggaauagucugaagcagaaugacuaguuagaagacaguaaauaauccagaugagaaauaauggugacugggaccagagugguugcaguggagagagauugaaauaaucagauucuggaaacauuucaaauguguguccauaguauuuacugauggguuggauguagauguagugugagagagaaaagaggauugggucaaaaaugacuuccaagacuuagaaccucucagccaaaaggauggaguuaugauuuacugaagugagcaauaccauaggaaaagauugagaggagaaagcaaagcaguaguucaguguuggucauuacauuugaaauaaaugccuauuacauagccaguuggcaacccuuaggaggcaguuggagugcaagucuggaauucaagagacaauuucaggauagagcuaaaaaugugggauuugacagcauauaggggguauuuaaagaauugcuugcacuuuuuguuuuuaaaauguagauuuagcuagugcuuauuuauccaugguauuuucugcuuuuagucaauuaaggcaggaauuuuuccuuuuugcuacauaaaccaaauugugauggcuuagaguaauugcaaauauuauaaucaccaaguuaaguguaauuaauaaucauucuucauuauauaugauuuuucauuauaaugaauuuggcuuagaaacaggcuuucuagacacauaaaaagagaagucucuggauuugagccaucucuguuuuuauaagcuacucuguacuuuucugucauagcagacuacugacuugaucaguuccuaaccuggaauauaguuuauugaauuauuuaaauaauuuaauuuuuauagaaguuuuauugaaaaauaauuuacauacuauaagauucacugauuuuuuacuaaauuuacagaauugugcaaccacaaaccaauuuuagaacauuuucaucauuuuaugaagaucccuuguacccauuugcagccacgcugcaaauuccuaccccuagccccaggcaaccacuaaucuacuuuuuuuuuuuuuuuagcauucuauuuuuuguuauugggaaaagaagaaauucuauuaaauaaauauauuuacaaaucaaaaugaucuuuaaucaauuuguaacuaguuuccacaauugcauuuguauacaguuucuuuagagaagaaaaauauugacuaaaaaauguccagguguucuuuuuuuauuauuauuauuauacguuaaguucugggauacaugugcagaacaugcagguuuguuacauagguauacaugugccauggugguuugcugcacccaucaaccugucaucuacauuagguauuucuccuaauacuaucccuuccccagucccccaacaggccccagugugugauguuccccuccugguguccauguguucuuauuguucagcucccacuuaugagugagaacaugcaguguuugguuuucuguuccuguguuaguuugcugagaaugauaguuuccagcuucauccauguuccugcaaaggacaugaacucauucuuuuuuauggcugcauaguauucuaugguguauaugugccacauuuucuuuauccagaaagaaauauacccauugaugggcauuuguguugguuccaagucuuugguauugugaacagugcugcaauaaacauaugugugcaugugucuuuauaguagaaugaguuauaauccuuuggguauauacccaguaaugggauuccugggucaaaugguaucucugguccuagauccuugaggaauugccacacggucuuccacaaugguugaacuaauuuacagucccacuaacaguguaaaagcguucauauuucuccacaucaugucuagcaucuguuguuuccugacuuuuuaaugaucgcuauucuaacuggcaugagaugguaucucauugugguuuugauuugcauuucucuaaugaccagugaugauuagcuuuuuuucauguuuguuggccacaucagugucuucuuuugaaaagugucuguucauauccuucgcccacuuuuugauaggguugguuuuuucuuguaaauuuaaguuccuuguggauucuggauauuagcccuuugucagauggauagauugcaaaauuuuucucccauuuuguggguuguuuguccacucugaugacgguuucuuuugcugugcagaagcucuuuaguuuaauuagaucccauuugucaauuuuggcuuuuguugccauugcuuuugguguuuuagucaugaagucugugcacaugccuauguccugaaugguauugccuagguuuucuucuaggguuuuuaugguuuuaggucuuacauuuaagucuuuaauccaucuugaguuaauuuuuguauaagguguaaggaagggguccaguuucaguuuucugcauauggcuagccaguuuucccaacacuguuuguuaaauagggacuccuuuccccauugcuuauuuuucucagauuugucaaagaucagaugguuguagauguguggcguuacuucugagaccucuguucuauuccauuggucuauauauguguuuugguaccaguaucaugcuguuuugguuacuguagccuugcaguauaguuugaagucagguagugugaugccuccagcuuuguucuuuuggcuuaggauugucuuggauauacgggcccuuuuuuugguuccauaugaaauuuaaaauaguuuuuuucuaauucugugaagaaagucaaugguaguuugauggggauagcacugagucuauaaauuacuuuggacaguguggccauuuucacaauauugauucuuccuauccaugagcauguaaugguuuuccauuuguuuguguccucucuuauuuccuugagcagugguuuguaguucucuuugaagagguccuucacaucccuuuuaaguucuauucuuagguauuuuauucucuuuguagcaauugugaaugggaguucacucaugauuuggcugucugucuguuguugguguauagaaaugcuugugauuuuuugcacauugauuuuguauccugagacuuugcugaaguuacuuaucagcuuaaggagauuuugggcugagaugauggggguuucugaauauacaaucaugucaucugcaaacagagacaauuugacuuucucucuuccuaugugaauacccugcauuucuuucucuugccugauugcccuggccuaaacuuccguuacuguguugaauaggagugaugagagagggcauccuugucuugggccgguuuucaaagggaaugcuuccagcuuuuguccauucaguaugauauuggcuguggguuugucauaaauagcucuuauuauuuugagauacauucuaucaacaccuaguuuauugaggguuuuuagcaugaagcgcuguugaauuuugucaaaggccuuuucugcaucuguugagguaauccugugguuuuugucauugguucuguuuaugugaugaauuauguuuauugauuugcauauguugaagcagccuugcaucccagggaugaagccaacuugaucgugguggauaagcuuuuugaugugcugcuggauucgauuugcugguauuuuauugaggauuuucacaucaauguuagucaggaauauuggccugaaauuuuuuuuucuugugucucugccaggguuugguaucaggaugaugcaaaaugaguuagagaggagucccucuuugucuguuguuuggaauagcuucaaaaggaaugguaccagcuccucuuuguaccuauagaggaauuagacugugaauccaucugguuuugggcuuuuuuggguugguaggcuauuaauuacugccucaauuucagaacuuguuaugggucuauucagggauucgacuucuuguuuagucucaggaggauguauguguccaggaauuuauccauuucuucuagauuuucuaauuuauuugcauagagguguuuauaguauucucuggugguaguuuguauuucugugggaucaguggugauauccccuuugucguuuuuuauugugccuuuuugauucucuauuuucuucuuuauuagucuggcuaguggucuaucuauuuuguucaucuuuucaaaaaaacagcuccuggauuuauugauuuuuugaaggguuuuucacaucuguaucuccuucauuucugcucugaucuuaguuauuucuugucuucugcuagcuuuugaguuaguuugcucucgcuccucuaguucuuuaaauugugauguuagggugucgauuuuagaucuuucccacuuucuccugugggcauuuagugcuguaaauaucccucuaaacacugcuuuagcugugucccagagauucugguacauugugucuuuguucucauugguuucaaagaacuuauuuauuucuaccuuaauuuuguuauuuacccaguaguuauucaggagcagguuguucaguuuccauguaguuguguggcuuugagugaguuucuuaauccugaguucuaauuugauugcacuguggucugagagacuguuuguuaugauuuccguucuuuugcaauugcugaggaguguuuuacuuccaauuauguggucaauuuuggaauaaaugugauaugcugcugagaagaauguauauucuguugauuugggauggagaguucuguagaugucuaguaggucugcuugguccagaacugaguucaaguccugaauauccuuguuaauuuucugucuuguugaucucuuuaauauugacaguggggugauaaagucucccacuguuauuguguggcagucuaagucucuuuguaggucucaagaacuugguuuaugaaccugggugcuccuguauugggugcauauguauuuaggauaguuagcucuucuuguugcauugaucccuuuaccauuauguaaugcccuucuuugucuuuuuuuuaucuuuguugguuuaaagucuguuuuuuucagagacuaggauugcaaccccugcguuuuuuguucccuugcuggugaggaguugugauccuuuggaggagaagaggcguucugguuuuuggaauuuucaaccuuuuugcacuguuuuuuccucaucuucguggauuuaucuacuuuuggucuuugcuguuggugaucuuuggauggggucucuguguggauguccuuuuuguugauguugaugcuauuccuuucuguuuguuaguuuuccuucuaacagucaggcuucucugcugcaggucugccguaguuugcuggagguccacuccagacccuguuugccuagguaucaccagcggaggcugcagaacagcaaagauugcugccuguuuuuccuucaggaagcuucgucccagaggggcacccgccauaugccagccggagcucuccuguaugaggugucugucaaccccugcugggaggcaugggggucagggacccaccugaggaggcagucugucccuuagcagagcucaagcacuggcugggagauccgcugcucucuucagagcuggcaggcaggaacauuuaagucugcugaagcugugcccacagccaccccuucucccaggugcucugucccagggaguuuuaucuauaagccccugagggaggcugcugccuuucuuucagagaugcccugcccagagaggaggaaucuagagaggcagucuggcuacaguggccuuguggcgcuguggugggcuccgcccagucugaacuuccuggcggcuuuguuuacacugugagggaaaaaccaccuacucaagccucaauaagguggaugccccuccccccaccaagcucuagagucccaggucaacuucagacugcugugcuggcagggagaauuucacgccaguggaucuuagcuagcuggguucuaugggguggaauaugcugagcuagaccauucgccucccuggcuucagaccccuuuccaggggagugaaugguucugccucacuggcauuccaguugccacugggguauggaaaaaaacuccuauagcuagcucagugucugcccaaacagccacccaguuuugugcuugaaacccagggccuuggugguguaggcaccugagggaaucuccugguccguggguugcaaagaccauggguaaagcauaguaucugggccagagugcacaccguuccucacaggauagucccucauggcuucccuuggcuaggggaaggaguuccccuaccccuugcgcuuccugggugaggcaacaccacacccugcuucagcucacccuccgugggcugcacauauacaguauuucauccuguauauguaccacauuuucuuuauccaauucaccauuaauggacacccagguugguuccauaucuuugcuauuguggauagugcuguguuggauaugagggcaugugucuuuuugguagaaugauuuuuugggggggguuuauacaugguaaugggauugcuggguugaaugguaggucuauuuuuaguuauuugagaagucuucaaacuuuccucaguggcucagucuucagcuuuccucaguggcugaacucacauucccaagaacaguguguaauuccuuuuuccccgcaaccuugccacaucuacuauuuuuugacuucuuaguaauagccauucuggcugguaugaaauaguaucucauugugauuuuauuugcauuucucugaugauuagugauguugaguacuuuuuuauuuguuggcugcuuuuaugucuucuuuugauaagugucuauguccuuuucucacuuuuuaaugggguuauuuguuuuucuucuugcuuuuuuuuuuuuuuuuaaguuccucauagauucuuguauuaggguucucuagagggacagaacuaaugaaauauauauauaaaggggaguuuauuaaguauuaacucacaugaucacaaggucccacaauaggccgucugcaggcugaggagcaaggagagccagucugaguuccacaacugaagaauuuggaguccgauguuugagggcaggaagcauccagcacaggaggaagauguaggcugugagaguaggccagccucaacccuucacguuuuucugccugcuuuauguucgcucgcagcugauuagauggugcccacccagauuaagggugggucugccuuccccaacccacugacucaaauguuaaucuucuuugucagcacccucacagauauacccaguaccaauacuuugcauccuucaauccaaucaaguugacauucaguauuagccaucacaauucuugauauuaguuuuuugucagaugcauaguuuacaaauauauucucccauucuguugguugucuguuuacucuguugauaguuucuuuugcauugcacaagcuuuuuaauuuaauuaggucucacuugucaauuuuuguuuuuguugcaauugcuuuugaggacuuggucacaaauucuuugccaaggccaauguccagcagaguauauccuagguuuucuuauagaauuuuuauaguuuuaggucuuacauuuaaaucuuuaauccaucuuguagccuuguaguguaguuugaagucggguaaugugaugccuccaguuuuguucuuuuugcuuaggacugcucuuuuuugguuccauauaaauuuuagaauaguauuuucaauuucugugaaaaaugaugugaguaguuugauaggaauagugcuaaaucucuagauugcuuugggcaguauggacauuuuaaugauauugacucuuccaauccacgaacauggaauguuuuuccguuugugugugucagcucugauuucuuucagcaguauuuuguaauucuuuuagauauccuucaccuccuuagauauuuuccuagguauuuuauuuuguguguguguaacuauuguaaaugagauuguguucuugauuuggcucucagcuugaauaucauugguguauagaaaugcuacugauuuuugcacauugauuuuguguccuaaaacuuuacuggaaucguuuauuaguucaagaagccuuuuggcagcaucuuuaggguuuucuaauuauagaaucauaucaucaggaaagagauaauuugacuacuacuuuuccaauuuggauguguuuuauuucuuucucuuaccuaauuacucuggcuaggacuccaguaguauguugaauaagaguggugauagugggcauccuuaugcuguuccaguucaaaagaggaaugcuuccagcuuuugcucauucaguaugauguuggcuguggacuuguaauagauggcucuuauuauuuugagguauguucuuuugaugccuaauuuguugaggguuuuuuuuuuuaaucaugaaggauugcuagauuuuauugaagguuuuugcuacaucuguugagaugaucauaagguuuuuguuuuuaauucuguuuauauggugaaucgcauuuauugauuugcauauguugaaccagccuuucauuccaggaaugaagccuacuugacugugguuuauuaacuuuuugaugugcuguuggauucaguuugcuacuauuuguugagcauuuuugugucuauguuaaucagggauauuggccuauagcuuucguuuuuggugugucuuuaccagauuuugguguuagaauuaugcugguuucauagauuggguuucauagaaugaguuagggaagaguccuuccucaaguuuuuggaauaguuucaguaggauuaauaccaacuauugguaugucugguagaauuuggcugugaaucucucugguccagggcuuuuuaugguugguagguuuuuuuuauuacugguucgauuuuggaacucaguauuucucuucaggguuucaauuucuucugaauucaauauugggaaauuguauguuuccagaaauuuaucuauuuccucuagauuuccuaguuucuaugcauaaaagucuucuuaauagucucuaaggaucuuuucuauuucuguggggucuguuguaauguugccuuugucauaucugguuguacuuauuuggaucuucucuuuuaucuuuguuaaucuugcuaacagucuguugaucuguuuauccuuucaaaaaaccaacuuuuuguuucauugaacauuuauauggauuuuggaaucucaauuucaauuauuucugcuuuuagauaauuauuuucuacuacuagcuuugggauuaguucuuguuauucuacuuccucuaguugcaauguuagauuaauuugagaucuuucugucuucuugauguagguauuuagcacuguaaacuugccucuuaacacugcuuuugcugcaucccagaaauuuugguauguuguguuucuguuuuuauuuauuucaaagaguuuuuuuguuuuuuuuuaauuucaccuucuguuguuuacccaaaagucauucaggagcaaguugguuuaauuuccauguaaaauuaugugguuuugaggaguacucuugguauugauuucuaccuuuuuuuccaccgugguccaaaaauauguuuggcgugguuucaauuuuuuuacauuuauugaaacuugcuuugucuucgagcaugugguugaucuuagaguauguuccacaugcagaugagaagaauguuuauucugugguuguuggguggaguauucuucuguagaugucuauuagguccaguuggucaggugucaaauuuaaauccagaauuucuuuguuaguuuucugcuuugagggucuaucuaacacugccagugggauguugaagucccccauuauuaauguguggcugucuaaaucuuuucauaggucuagaaguacuuguaugaaucugggugcuccaguguugggugcaaauauaccuaggauagguaagucuuguggaauugaauccuucgucauuauguaaugcccaucuuuguccuuauugcuguugguuuaaagucuguuuuaucugauacaagaauagcaaccccugcucuucuauuuacuguuugcaugauaggucuuucuucaucacuuuacuucaggccuauaggugucauuacaugugugaugggccucuugaagauaguagaagguugggucuuguuuuuuguuuuuuuuuaaauaaaauauuauuuuauuuuuuaaauaaaaaaauuaaaaagugguucuugccacucugugccuuuuaacuggguacauuuagaccacuuacauucaagguuaauauugauaugugagguuugauccugucauggugguguuugcuguuugcuuuguagucuugauugcguauuugcuuuauaggaucugugaaccucuguauuuauguguucuuuuaugguagugaguaucauucuuauguaugcauguuuagaacuuccuugagcauuuccuauaggcuaggugauguaguuuggguauuuguccccacccaaaugucacauugaaauguaaccccuaguguuggaguuggcgccugaugggaggugauuggaucaugucugugaauuucucaugaauggcuuagcgccacccccuugaugcuguccuugugauagugaguggguucuugcaagaucugguuguuuaaaaguguaugcccccacagccuuccccucucguucuugccauaugaaaugcacauucccucuucgccuuccaccacgagcaaaagcuuccuguggucuccccugaagcagaugcuggcauugugcuuccuguacagccugcagaaucaugagccaauuaaacuucuuaccuuauaaauuacccagucuuggguauuucuaauagcaaugcaagaacagucuaacacacuaggucuagauauaacaaauuccuuuagcguuugcuugucaggaaagacuuuauuucuucuuuguuugugaagcuuaguauuuggugauuacauagucauaaauaacaugguuaagcauuuguaaccuucauaucucugugaauaacugcuaagaguugcuuucuuaugcccuuaggcuuggccaguuugucauaucuuguuggcauucuuuuuuuuuuuuuuuuuuuuugguaacuacacaaaucucacuauauuguuuguauuauuuaaauaguuaauccauuuagaauuucuauaaauuaaauguguuaguuaauaucuagaggcacaugugaaauaaauaauuuuuaaaauguguuaguaacucuuuauauaggaaaauaaauggauuuuuauuuacauaucauaacauuuuaacaagaaaaauguuccauuuauuacucuaacaagaccaaaaaaccaauuuucuauuuuguuccauauuuugaaagauuuguuuucccuuuuagaugcagaccaacaacgaagagagaaacucaaaaaggaauuagcacaaugugaaaaagaguucaaauuaacuaaaacugcaaugcgagccaauuauaaaaauaauuccaagucacuuuuuaauaccuuacaaaagguaagauaguauuuuuauuuuuuaaaagcaaauguuucuaagguacuucuuuagugguacaaucugacuuuguuuacuauaguuuagggucagcaaauuuuuccuguaaagauccagauaguuaauauuuuaaaaggcuguucaggccucugucacaacuacucugccauuggaaggcagacauagacaguacauaaauaaaugaguauagccguguucugcugaaacuuuauuaacugaagacauugggucagauuuggccugaagguuauaguuugcagaccccaguuauagguuuuuugugauaccuucgaacaucugguuaaauaaguucuauuccuaguuugugaaguuuuuuuuuucccuuucuccugaauggauauuaauuuuaugaaaugcuuuuuugcaucucuuggaaugaugauauuaugauauaauuuuucucuuuuaaucugugggguuuuuuuuuuuuuauauauauauauauagucucacucuguugcccaggcuggagugcaguggcaugaucuuggcucacuacaaccuccacuuccuggguugaaacaauucuccucccucagccuccccaguagcuaggaucacaggcacccaccacgacuccagcuaauuuuuguguuuucaguagagauggggucucgccauguuggccagguuggucucaaacuccugaccucaagugaucugcccaccucggccucccaaaaagugcuaggauuacaagcaugagccacuaugcugagccucuuuuaaucuguuaauguaaugaauuacaaacaauugacuuuaauguuaaaccaacuuugcauuccuguuguaaacagaacuuagucaugguacauuaccuuuuuuauucauugcuagauuuacuuacuaauauuuguuuagaauuuuggcaucuguccauuauugauacuggccugucauuuucuuuuuuuguacuccuugugucugguuaugcuauccucauaaaauaaacugggcacuauuucuucuuucuguacucuagcuuguguacauuugguuuauuuguuccuuaaauuugguggaacucaacauuaaaauugucuaggccuaaaguauuuuuuaugagaagauuuugacuacugauucaauuuuuuaagucauuauagaaugauuucaauguuagauuuauguaggaaguuguucauuuuauguaaauuuuuggcagagaauuguucauacuauucucuuaaucucuucugaauauguauuauuuccccuuguuauuccuaagguaguuuauuugugccuucauucuucuucuucaucauucucaucagagauugagucaguuuuuuuaaaggacacacuuuuuauuguguuagucuucucuauuguauuuuguuuucuguuuuguuaauaucuguguuuaucuuuauuucccucucucuggguuuauuuugcuguacuaucucuaauuuuauuuaauuuauuaauucucugccuuacuucuuugcuaguguaagcauuuuuaaugcuauaaauuuuccaccaaguacagcuuuagcugcaucccacaaguuuugauaggugguauuuuuauuauguuucaauucgaaguauuuuacaauuuucuuuuuguuuguuuguuuuuguuuuguuuuuugagauaaugucuugcucuguugcccaggcuggcaugcaguagugugaucucggcucacugcaaccuccgccuccuggguugaagcaauucucgugccucagccucccaaguagcugggacuacaggugccugccaccaugcccagcuaauuuuuguguuuuuaguagagucuaguuucaccauguuggccagguuggucucuaacuccugaccucaagugaucugcuugccucagccucccaaagugcugggauuacaggcgugagccaccaugcccggccuacaauuuucauuaugauuuuuuuauuuaacccagaaaucauuuagaacuauuucuuaaucucuguaucugcuuuuuccuuaguaucuguuuguuacagauuucuagccuaauuguacugugauuaggaaacaucuauauuauauccauuucuugaaauuuauugagcacuuguuuuaugucccaguagguggacaauuuuuuaaaaauguccugucauuauauguuugaaaauaaaauauauucuauaguuuuugcauguaguauuugauauauaguauauucauuaaacuuuguauuuuccagauauucaaaucuuuuauaucauauugauuauuuuugucugguuaaucuaucaguuauugagagaaaucuuccacauacuuacauauuuagcuauuucuccuugugguacuauuaauuuuugauuuacauauuuugaaugcauguuauuacauuagagauauuagagauacagaauacagauuuagaaaauccugaaggagguaguuucuuggugaacugaaccuguuaucacugugcuuugaauuucuuuaccuuaaugcuuuuucuauuaauauuuucugauagugauauaauuaaauuagcuuuauuuugacuaguauuuacuugguauaucauuuuccauuuuuugaucuuaauguuuucuucuuuuuuuuuuuuuaaugucacuugccaaucucaauguuuuagguuaguauuuggugggucagauuauucaaucugauaaucauugucuuuuuuuuuuuuugagacagagucucgcuuuuuuacccaggccagacugcaguggcgcuaucuuggcucacugcaagcucugccucccggguucacgccauucuccugccucagccuccgaguagcugggacuacaggcacccgccaccacgccuggcuaauuuuuuguauuuuuaguagagacgggguuccaccauguuagccaggauggucucgaucuccugaccucgugaucugccugccucggccucccaaagugcugugauaaucauugucuuuuuaauggggcauuuaauauguuuuuauuucuggcuucuuauuucauaccuucuauuugacucaaugugguagacaaaauuugaagacaacacccccacagugacccacacccuuaagcaauccccuccucuucagugcagguaggaccuguaacuugcuucuacccaguagaauaugggaaagaugauaggaugucacuucugugauucuguuauguggcaaaagugaagggauauuuuccccugcagauuaagguuuuuguuccuuaaaagagaauggaaaaauaagucugggaagauuuuccacagugacugcuguuucucuccccaagccacaccaagagaaggugggaaagggauucucucuacucuucccuauaagcuucgaguagguuuccuggaggaaaagccugcaagagguacaaacuccccaaguccucagguccgguacagaccugagcacaucacuaguccacacucagucuuuaggaaauuaacaaauauuuauaacauaaucuuaucaauuuauguggcauuccauggcaucuuucccaaguaagcaagugcugggauacuuaucucucuccauauuucagguuaguuguuugcucugugaccucaguucucucauuaguucaagaaaaaucauuaaugugcagaucguucagcuuuuuucuucuuguaauggugagagcuguguucuuuccaucucuaucucucagcugaaacaguaaguuuguuuuauuuuuaugugugguuucauuuuuugaacuuuuaaauuuugaaaaccuuagcauuuacaaaaauauaguauaauaagcccacauguuccuaucaccuagguuguagcaaugaucagcucagagccaguguuauuucaccuauaugcccacucacucuccuagguuguuuugaugcaaaccccagacaccauauaauuuuauccauaaauauuugaguauauaucuaaaagauagacuuuuaaaaccacaacaauacuauuaugccuuaaaaauuaauaacaggcugggugugguggcccacaccuguaaucccagcacuuugggaggccaagguggguggaucaccaggucaggagaucaagaccauccuggccaacauggugaaaccucgucucuacuaaaauacaaaaaaaaauuagccaggagugguggugcgcacuuguagucccagcuacucgggaggcugaggcaggggaaucgaacccaggaggugggaggucucaaugagcugaguuaacgccacugcacuccagccuggugacagagcgaaacuccgucucaaaaaaaaaaauaauuaauuaauaacaguucuuuaauaauaaauaucugauguuuagauuuccccacugucuccuuuuugaguuuguuagaguugguauuagaaggccagcagucuccuucaacucagugccaggguucaggauggggaaguuuccuugcaagucaucuaguugaggaguagccauugagagaaucccagauucucaagcaugaucucuuaagagcuuuguuuucugccccuagcacccaugaugugguuuaaaaaaaacuauggacugcugggcaaaagccagauugacugcucugcuuaccaaauaccaaggcuguaauaaugagucuggauuuuuuuccuugagaaaugcugggagccauagaccaguuuuuaguugggaaguuaugucaucauacugacacuacacagacuacacugacaacaguggaggacaguuacgagacaguugcaguaaucugggaagcaguaauuaagacaugauucuaugacagcagagagagcauaaggaauacauuuaagaaauaauuagaaaguagaaucucggccgggcgugguggcucauggcuguaaucccagcacuuugggaggcugaggcgggcggaucacaaggucaggaguucgagaccagccuggccaauauggugaaacccugucucugcuaaaaauacaaaaauuagcugggcaugguggcaugcaccuguacuccuagcuacucaggaggcugaggcagaagaaucgcuugaguccaggaggcgggguugcagugagccaagauugugccacugcacuccagccugggcgacagagcgagacuccaucucaaaaaaaaaaaaaaaaaguagaaucugcaggacuuggugacugaguggaugaugugaagaguaagaagcaggaguuaaaauccuaaguuucugccuugggcaacugggagaauaguaauauaucauucacagaaauauaauaggaugaggugcagguuuucuuuggggcuggagguaauaagagauaggaguuuauuguuuggcuguguuugauuugagaugcuuuuggaacaucuaguauauuuaguagacacuuggauauaagcaucugugucagcaaagaggucugggcugaaaauagacuugggagucaucaggggaagcagugaauaugauugagagccccagggcuauuauguagauaaaaagaccagcaauagagcugcuuccuuuagaauaaaucuguuaucugcucuguauuauacuuugcuaucugggauucuguuccucaauauuugaaucacagguguauuuucauuuuuagugauuguacuuuuuaacagaaaauuuaaaauuuguuucuauuauucagcaugaguauaaauuacuaauuaaauuuugagauaagaaugggguuucuugaaaauacaaaucauauauuuuaauauaucuuuuuaauguauuuuauauaucuauuuauauauaauaaaguaaaaauauauauuauuuacauauuauauauuuuuaauauauuucuguaaauguuagauguuuucauuuuuccaauagcaacuauaacccuauauaacuuuuugccuccauaaaguuguuaauuuauuauuuuaucuguauuuuuauugacuccauuuaggauucauaguaacuugcacuuugccuacauuuuugauaagcccugauaauaaauauuuuagauacacucagauugucuuaagagccuuauuuuggguaguauauuuugauaauugaauggguguuaugguuaacagacaccuguuaugguuauaauuuguauucacuguaaaggcugcuauaguuaaaaugcuggcuuuaaccucugaauguauuagcccuuuauauacauuauaaaggucauauaucaaaaaccuuuuaugauaauugcccaauucucuugccacuuuucuucucccauacucugacucacaugcugucacccucagaacccuccuaagcccuuccagucuucacccuguaacucuugagucauucacuacuuagucaaugcucccauacuacucguuugcuucacugguguagcacuuacugugugcuuuuaagauuaagugaauaugugggugugagcuuuauuucugaauaaaucuagaaaagaggcgggagcaguggcucacaccugugaucccaacacuuugagagacugaggcagacagaucacuugagcccaggaguuugagaccagccuggacaacauggcaaaaccccaucucuacaaaaaaaaaaaaaaaaauacaagaaaaaaaaaaaagccaggcaugaugguguguaucuguugucccagcuacucaggaggcugaggcaggcagauuaauugagcccaggaggucguggcugcagugagccaugaucaggccacugcacuccagccuggguaacaaaguaagauuaaaaaaaaaaaaucugggaaacuuuuuaaaaacaguacaaaauagugaaaaucaagagcuauauuuguuuuauaaaauauaauuugaaacuuuuuugcaaacagauguuagauuuuaaaauaauuuuuuuuuuuuuuuuuuuuuuuuuuuugagacggagucucgcucugucgcccaggcuggagugcaguggcgcgaucucggcucacugcaagcuccgccucccggguucacgccauuccccugccucagccucccgaguagcugggacuacaggcgcccgcuacccauccaauucuacaauugaauugacucuucaaguguuuaaaaauccgacaauuggaaaauuauuguagguuaugucuucugacauccuuaaaaaagauugauuuaguacugaguucuguauuguaaaauucuugacaugaaaguaugaugaguauauaaacuauguuaugguuauuacuuuacauaaaucuugaaaucacagaaacagugcacaacaaaccucguaaacuaagaauaaccuaagaaagugaguguucaggguaccaccagacucuuugcuccauuggcacauaauugaugaacccuuuucugauuucagaacuuuacagugaucugcuguucauguuuugggauucuaccaguguguuacauauauucugcacaaauaucuuuauccaaguuucaugauauucauagcuaaaggaaacaagaugcagauugguacaguggauuuuauacuguagucuacugguuuccaaggaaagaaaaaauaggauacaagguagaaauuauaagauacaaaaaugggaaaaguuucaugcuuucuauaaguucagaagcaauuuuuccaucccauuucagagagauagcuuaacauauacuucuaccuuuuaaaaagacuuucuucaguguuucauuuuguuuauuaaauaaccauuaccgauaacauuucuuuacaggcaaucauaauggcuuaugcauuucuuucuccuuccucugaucucaguuugugcuguucuucuaaguguaaauaauuccugugcuuauuaauuaauugcccuauaggauauuuuuagacuguacuuagaaauuucuucuuugagagcuaaacucuucugguacauaagcuguagugugaguaucauuuaggacuacuuauaaaaacuaacaucuugaagucauuuaccaaauaguacccuagugacucaaaauuuaaugccagcauacuuacuugcuuugaguaauguugucuuguauuuggaauaagguuauaaaacaguuggaaaggaaaggugauuugacauauuuuagauaguagucacaauguccaguuaucugcaauuuuuuugcuuugauaaaucagcacuuuagguuagcugacuuauuuguucccagaaaaagaguuaaaaucaguuuaaaauuuuuuaugcuguaaaaaaaaucuaaaaucauauaauuuucaaauaaguuuuuaaguagacaauaugauaaaguggcaaagaacaugggcucugccucuguucaaaucugugagacacugcaccucagagcaguguuuuuaucuacaaaauaggguaauaauuguacuaccucucagaaguugauguuaggauuaaaugagcuauacaugaaaaugaguacaguaccuugcacauaguaagcacaccauacauauuaguagcagugauagaaguucuuauuauuccucuucuauucaaugucaagagcaguaccuuucauacaggaagccuuuuuccuuacucaacuuguccaucuuccccuuguuauuccucccaaugagguaauaagacagauauaauuggcuaaauccuagcgauuuuuaaccucaauuucuguaaccuccauguaauuuccccucuaccuaaugaaagugccucagaguuuugcaaaggauauacagauguguccguaagggcugaagucauaggcaaagcuucuuagacauuuucaguuuauaaaacaauaaaauacuaucuguguuuuuagacuuuacaaauaaccuguagaaaugguuuuccuaaaguaaagccaaaaagaaauggagcaagucaaaaugccucccuuuucauaguauuacccccaccccaaugaaaagaaguugagaaauauauaugaaauuauuauggaauaaauauuuauuaauuauauuuaaauuaucaauuaccuaaaucagggcuccauacauuaugaggagaaguuccuuuucguuucuuuaaaggcuuaacaucacaaagggauggcuuacacugcacucuccaauaaugacaagacaggacagugaggaugaugucacuaauagugguugagaagggcauuggugcucacaauuuguguggaagcuuucagauaaaacugacaucucccaauaaaucuuaauaugcaaguugaagaucccaaauauagauauguuauucaucuuuuuuucguuucagaaaggaaauugauugcucuauuacuuauauuuggaauuaaauguuaauaucuuaguuuaaauacuugacuagaacuucagauaaaauauuaacaucuucaggaacauaucaguuaauuuuguaaacccuugaggcuaucauuuuuuuaauguauaaucucaaaauccccaauuacaugaauucguaaugcaguugaugacugucauaucgaauguucuuagcccucaggcgaaccgcaaauugaggaugacauguuaaaagaagaaaugaauggauuuucauccuuugcaaggucacuaguacccucuucagagagacuacaccuaagucuacauaaauccaguaaagucaucacaaaugguccugagaagaacuccaguuccuccccguccaguguggauuaugcagccuccgggccccggaaacugagcucuggagcccuguauggcagaaggcccagaagcacauucccaaauucccaccgguuucaguuagucauuucgaaagcacccaguggggaucuuuuggauaaacauucugaacucuuuucuaacaaacaauugccauucacuccucgcacuuuaaaaacagaagcaaaaucuuuccugucacaguaucgcuauuauacaccugccaaaagaaaaaaggauuuuacagaucaacggauagaagcugaaacccagacugaauuaagguaugacacaucagcaaccaacaguaaauccuucaggaaauuaaaugaaaauuaaugaauuaauauuccuuguuuucugcugccagccuuaagaucugauagugcccuuuugauuggaaugagaugaaugugacuuuuccuuuuccauguaucacuagaacuaucagaguaauugcugaaaaauagcuauuaaacuggucaagcaccuuaugcguaugaauuacauauuuuauuauuucaagcgugguucaagaauuguguauguuuuuaaauauuauacuuucagagaauucuuaaaauaggucaucagacagcauuuguggaaauaugcauauugauucauguuaaaaguggcgaaacaaugggcuauagaggggaagaaacuaacccuuuauccaucuaacccucugcuccauuuccugcagauauuccggccagucuucauagcaacaacugccaagaauaauuuuaaauugggauaauuucuagaaauuaaguauaauuugccucaauaauguuuucaaauacaguagugccuggcacaagaugaauguucaauaaaaguuugccagaugacuaaagaaaaaaacaaaucuugucaaguuuugagauuuagcagauuugugauugugauuguuuuucuaguauuacauaaacaauuuaucuggcaguagguuuuaguuguuuuagaaaguaaaaacaauuuaagauuaguauuuuuuucuuugaauauagauaaguacagugauaucagaugagucugcagauauuuaaucaaauaaaaucaaauaauucaaaauuauguauuuuauaagaauagaugggucucauucuuuuugaguuuauuuuuucuagccaguaaaccuuguuaccacagugcuuauauuuugaaggauuaacaauuauuuauuuuaaauuauuacagcuuuaaaucugaguuggggacagcugagacuaaaaacaugacagauucagaaaugaacauaaagcagguaauaaguaugaaaucuuuugguauugcuacauuugaauuacagauguuuuucaguaaauagaauauguacagcuauuuagacugugaagaauaaucuguugguggcacuuaucauacaugauauagccaguauacagaaggucugccuauuuacaaaugguuauagcucucucugaauggccagguggauccugccaaaucugggaagucauuuguuacuaacaucuuuccuagaugauugguuggcuggcuggacaaauggaaggaucaguaaaauaccuuaaguauuguuuucaaagaugcagaccuggauuacuagaggagccagcagaguagugcagaaguugaguuuuuauaccuuuuuuuuuuuuguaaagaauugccacauauuauauaauuggaaauuauacauuuuauaagaauaaguagcuguuauucucuuauguuugccucugcuuuuucuagaccaugaagcuguuuauuacaggguuuauauuuugaauucuuagcaucauuucuuuuaaaauauugcaacuuugagucugauuuugagauaaauuguuuuauuuuuggaguuucagucuugcacuuguguccugacuuaaauuuguugcuuauaaaaaugguuugucuauuaaaaugucaaacacagauccagagauagaagaauaaaauauaaucauacucaacuucccccuucccuucugaaaauggguagaaggugguaguuuuccaucucagcuauuaaucgcuguuugacauagggcccugccacuuaaggcccaaggacaaaucacuuauccucugagagcugaauuuccucaucuagaaaaacuguacuuaacuugcaggauuauuaggaggaguaaaugauguaggcaaagugccuagccugguaagggcuuaauaaaugauagcuauuacuagcuugaaauuuuuggaaagaguuagcuuugcagauaacuacguaaacaugaaaaaauauuuauuuacaauccugcaagaaaauguguguccccauauuccauagauagugccaucaguacuugacuugaagaagccaguagaguauuaacugcaguagauccauauuuuaacagcaccuuuaaaacuguaaagcacuauacauaaauugucauuguaaagauugaaucuaaugaugugaguaaaugcuuggcacaguuugugguguguaguaaggagucuauaaaaguaagcugccauuauuuuuguuuguuaauauuauuguucaugcugccagcgcuaccacugcuucuacauauuugacauguuggcauuuaaaacagaugagcuauuugaauuucugaauaaugagauuuuguucccucaaacuuacuuaaaaguugaaaauuugcuucauuuuucccuuuauauguuuauuuguggcaauuucuuaaugucauuuaaaugccacucauuaaaauacaagaaauaagucauuuuaucuuuaaguuuaagaaaaaagugcuggauggauagaaaaauuauucuaaaauauucuuugucguacuguauaauuuuuaucuacuggauaucucuguucaaucacuuaaaauuugcuguguuauauucugcuuucguaauguauuuuuaagcaaaaauaaauauuuuuuuuauugcauccccaggcaucuaauugugugacauaugaugccaaagaaaaaauagcuccuuuaccuuuagaagggcaugacucaacaugggaugagauuaaggaugaugcucuucagcauuccucaccaagguaaacaguucacaggagaaauaauuucaacugucuuuaauugccuucuuguauaacagacauauaguauuugccgcauaaguacuauuuaauugcaugcuccaaucuauuuugguguuauguaauucaauaacaguuuuaguuuuaccaaggaaauuuuacaaauugaagugcuuaguaaaaguugaaaugaauuaauuuugcuaauucauuaguaaaggaaaaaaccacaccaacuuguauuauuuauuaucacuguucauuaaaaaaaugauuuuccccaagacaaguccucuggcagugaugcuaaccaguuuacaugccacaaauaguacugaagagcuuuaccauuugaggagucauaauuugugauuuugaauauucaucauauccuagugcuugaccaaucugugcuauaugaagacacuauuuauuuauuuauuuauuuauuuauuuauuuaugagacagucucucucuguuguccaggcuggagugcaguggugcggucucagcucacugcaauggaggcacucuuuaaaaacuacucaucauguugaguaauuaaggaauauuauacauuaauuagcagguaguagaaaaccuaaaagaugccucgauaguuucaguugucaaauguauuuccagugucagagaguggauaugaaaugccgguggaagggguagaagaaaggaaggaguagagauuaaaaagagggcaagaauaagguguuaguagcagaccacuagggaaguacacacaauccccucaggcucuggcuucucccucaggccuuugcuagggagaucucaccugcuaaggccauggagaguucauuguuaacuacccugucuuugaaauuucugauguuucaacacauauaacuuauuauuuauuaauauaacugcucuugagccagucuucauugaauauuaagaaugacuuaaggaaaggaauauuuaucuuuucuaauacuuucuaaaagaaguaaaguagaauaguauaguugaguauaccugaauaaaauuuagcuucaaauuaauuauugguaacauaacugaauaauaacaaaauuuaucaugaugaccaccuuuaaaaauauuuucauaauaauguaucuauauccagcauuaucuauacauuaaccuuagucaaauugucauuguuuauacuagagaagugccguaguguaguuuuaaaaagaauugugaauuuauaccuagaaaaguaguuuaaaaaccugucuuugcugcuuacuaacauuaaccuuggaaaguuacuuagccuuucugacccuuggugaacuaaucaguaaaugggaaaaauaauacacagcccacaugccugacuggguuguuuagaagauuaaauuagauauggguaugagagugcuuuaaaaauugcugaaacauguaauuacagguugagcaucccaaauuugaaaaucuguaauucaccauacuccaaaauccgacaugaugcccaaaggaaaugcucauuggaacauuuuuggauuucagauuuuuggauugagaugcucaacuacuaaguauauaauggaaauauuccaaaauccaaauucugaaacacuucugguuccaaacaucuaagauaagggcuauucaguguguacuaauauacaauguuauugaguacuuauuguaugccaaccacuguuuugcucaacuacuuuaacuuccucuuucuagggcaaugugucaguauucccugaagcccccuucaacucguaaaaucuacucugaguaagaucuuuuuuaagucuucguuuugcauaguggaaucaaggauuaagaaucaaagaaaccauauuaaauaagucaggauugaacaauaaucucuuuuuuuaaaacuggcaaguaauaaauguacauauucauggaguaccuagugauauuuugauacauauacuguacagugauuagaacaguuuaauuagcauauccaucaucucgaacauuuuaucauuucuuuguguuggaaacauugaguauccuucuucuagcuauuugaaacuauguauuauuguuaaccaugguagucauccuauagugguauagaacacuagaacuuacuccuccuaucuagcuauaauuuuguaucuuguaacaaaucucagcuugucccucauucccgucuacccuucccagccuccaguaccuucuguucuacuuucuacuucuaugaaaucaacuguuuuuagcuuccacauaugagugagaacaugcgauguuuaacuuucuguugcuggcuuauuucaccagcauccauccauguuccauccauguugccacaaaugacaugauuuuauuuguuuuuauggcugaauaguauuucaugguguauauauacauuuucuuuauccauucaucugugaacacuaaucucucuuacaaccagcuuugggauaucaaucguauaauacauacuaaauuugagaaacugaccugaauaauuuucucgaauuuuuuugagaaauaauaacaacuuucuggaauaauuaucaaucacgucauuuuuaucuccaguagaaauuuguccccagguauuaccugauacuuuuuaauaaucaguauccaugauucuuacuuauuuuuuaaguaaaaauaauaaaauaauaaagaagaguuuuagagaaaugcagacuuuuaauaguucaggauacucuuuccagagguuucuaaccucagcaguucuuugcagauauuuuauuuguagauuuuaauguuguuuuaauuaaguuacucuuuuuagggaaaauaauuuauaaaauuuuauuuauuuucaaauaugcuguuuuuaaauaagcaagacccugugaaucaguuugaaaguguaacuuuuuauuaaacauuuaaaucuauuauuugauuugcuuauuaacucuucccuuauauuugcuuauucaguaauuuaguuacuugcuacuuacauuugguauuaauucacuaauuucagcuaauuaaaaucaaacguacaauaauauccuaauuuucuuguaauagcuacuaaaauauaguuauaauagagaaguguguucaaguaguuaaaaauuaccacaagauuuauguucacaaauuuuccuaugagaauuuuucgucuccaaacguuuugagagaaaaaauaaauuuuucugcuuaguaaauuucucaaccuuaaaacaagaugcuggccuagggcuaggagaggacuucuuaguugaagcuccugcuucucuggacaacuuuccucuuccuucuugcaaaugcuuugcagagggacuugcaccucugcugcuggaccuggucaggagcaagaggaaauuuaaaacauuccucgggagugcuugcucccaguggauugcauuugauugcgccuuguccuucguugcuuucuuuuuguguuguuuaauucugcuuguuuuuuacugcuauggauguugcagauaucugugaaauuuuacucuauuaggucaucaccuuuaguaaauauuuauccuugcauaauuugagaagguagacauguuuguuuuguaauauuccccuuaguaauaugagauagaaguacauugguaaugguagagauagauauuucuaauuagguacuaauguuucuuacaguuuucagaauaaguaaggaauaauuuuuaugcuauauauugccuuccuuuuacagugaagaagaacuguuguaucugaguuucauugaagauguaacagaugaaauuuugaaacuugguuuauuuucaaacagguuaguuuuuuuaaugguguuauguuaauucaggaguacauuaaauauucuucauauuucuucauaugauguuaaaauuuuaaaguuauuuucccauauuaggaaaugaaaaaauauauugcuuucuuggaaacuuauuauuauaauugauagcaaguuguaaagaauguuuaauucauacucuaggggaaguucaccacuugggagaauuaaagaauagagcuuuuauucauuuuaauauuauaucccuugaguuauaagugacuagugaaggaagaucuuuaucacuuauuugcaaagcuccauaaucccauuuuacuaccuaaaauugucaugagaaucaaaagcaagcauuuuuggugcaaccauuauuaguauuagaucuaguaaaaugagaacaaauuaagagcuagguuugcacgcuguaaguuaaauggaaaguuugcaaaaccagauuagcuauugcauagcuuaaggaaacuguguguccugaauuuugcuugaacauuuauguaucuaagauucauugagcacugagcucuacuuuguguuauguaaccuaggacccuauuauguauacuacuugcuuucucugucauaauaauaugccaagcauagacauuuuuaauaaauuauuucuauccucuacaucaaguuuuuuaaaaaauuaaagcaaacauuuucauuauugguauaaaaaggcauaucaaaaagaccuaagauuuuuggcauuaauucuguugaccccuuucauuuuaaaaaguugguuaauaauauuugcauaauauggguaaagaguuucaggauacauaaugaaaaguuuuggcaaucuguaucacaauaugaauauaccuaacacugcugaaucgugcacuuaaaaaugguuaagaugauaaguuugguuaguuuuugccaccacaagaaaaaaaguacacauacaaaaucauauguauuuaugcuuaaaauuuuauguuuuucucaagauuauaagacuguuuauuacagcauuuuuauaauuguaccaaaaaccagaaucaaccuaaauguuuaaugguaaauguuugguugaauaaacuguggaauauauaugaaaugugaggucuguuuagggauuaaaaaugauguugaagugaauuuacagauauagaaagauguuaaagauauaugucauugauuagaaaaaacaaaauagggcugggcgcaguggcucacaccaguaaucccagcacuuugggaggcuaaggugggcggaucacaaggucaggaguucaacaccagccuggccaauauggugaaaccucaucucuacuaaaaauacaaaaauuagcugggcgugguggugcgcgccuguagucccagcuacucaggagggugaggcaggagaaucgcuugaaccccgcaaggcggagguugcagugagcugagaucgcgccaccgcacuccaucuugggcgacagagugagacucugucucagaaaaaaaaaaaaaaagaaaaagaaaaaagaaaaaacaagauagauacccaaauaguauguauuguuuaauuacaaguugguaaagaaauacaaaugaauagaaaaaaugccuaguagugaauauucuaaaauguuaacaauaguuguaaaaaguagaauacagauuucuuggguuuuaauaaaaaauugugaaauaauucagaacuacuaacucugagguugguucauaacuucacugaugcuagcaaaugauaacaaaggaaauuaguuguuuuuuaagaaacuguugauacauuccugugauagagaggugagcaugguguucuagaaugaagaaauucuguggagccagacacaucuggguuaaauucuccuaaaggcuuuugaccucaggggagaggaaauuaucaucuuagagauguggcuuucucgucuuuaaaaugguuuuuacacuaucuuucccucccuacauuggucagaacuagagguaaaaugauuauuaugacuagcacaguagcacuuaauggaaauuaauaggugauaacuuuuaaauuauuauguggauuuaccaucagugggaguuuuuaaauuuuuuaauuauuuuuuaaaauuuugugagguacacaguagguauguauauuuaagggguacaugagauguuuugauacaggcaagcauugugaaauaagaacgucacggagagugggguauccauccucucaagcauuuauccuuugaguuacaaacgaucagauuacauucucuaaguuauuuuaaauguacaauuaaguuacuauugacuguagucacccuguugugcugucaaauggucuuauucauucuuucuauguuuuuguacccauuaacuaccccacuuaaccugcagcccucuacuacccuucccagccucuguuaaccauccuucuacucucuaugcccaugaguucaauuguuuugauuuuuagaucccacaaauacgugggagaaugcaauguuugucuuucugugccaggcucauuucacuuaauauaaugaucuccaguuccguccauauuguugcagaugacaggaucucacuuuuuuaauggcugaauaguacuccaugguguauauguacuacguuuuuuuauccauucauuuguuaauggacacuuaguugcuuccaaaucuuagcugucauaaacagugcuacgacaaacauaagagugcagguaucucuucgauauccugacuuacuuccuuuugggauugcuggaacauaugguagcucaauuucuaguuuuuugagggaccuccaaacuguucuccauagugguugaacuaauaguuuacauucuuaccaacagugugcaaggauucccuuuucuccacauccucaccagcauuuauuauugcuuguuuuugcauauaagccauuuuaacuggagugagaugauaccucauuguaguuuugauuugcauuccucugaugaucagugauguguggaauaccuuuucauauuccugucuacaauucguaugucuuuugagaauugucuauucaaaucuuuugcccauuuuuugauuggguuauuagauuuuucccuauaaaucuaauaguaaauaguuguuugagcuccuuauauauucugguuauuaauuccuugucagagggguaguuugcaaauauuuucucccauucuguggauugucucuucacuuuguugguuauauccuuugcuguguggaagcuuuuuaauuugugaucccauuuguccauguuugcuuugguugccugugcuugugggauauuacucaagaagucuuugccagaccaguguccuagagauuuucccucaauguuuucauuuaguaguuccauaguuucagaacuuauauuuaagccuuucaucuauuuugauuugauuuuuguauguggugagagauaggggucuaguuucauucuuuugcauauggguauccaguuuucccauuaccauuuauugaagagacugccuuuuccccaguguauguauguucuuggcaacuuugucaaaaaugaguucacuauagguguguggauuuguuucugaguucucuauucuguuccauuggucugugucuguuuuuaugccugaccaugcuguuuugguuacuguagcucuguacuguaauuugaagucagguaacaugauuccaccaguuuuguucuuuuuacuuaggauagcuuuggcuauucugggucuuuuguaguuucauguacauuuuaggauuuuuuuuucuauuucugugaauaaugucacugguauuuugauagggauugcauugacucuguagauugcuuugggugguguggacauuuuaacaauauugauucuuccaauccaugaauuuggaauauuuuuccuuuuuuuuuuuugguguccuuuuccauuuuguucauugguguuuuauacuuuaauauaggaauuuuuaaaaguauaauuuaggaaggauuauaaaauaucucuguaagagguuuuucuuuaggguuugguuguguguguguguguguguguaaauaucgggguagagaggcuuuggguguuugcauaugucugugagagaaaaacagcuuuuuggugguggggugagaaaaaggagaauuuuauucaaagaaauaaaaguagcauacagucuuucagaaauauguaaugugaagcaaaugcauaauggaagaacuuagaacaggaaaggauuagucuucagcuuuacagagaaaaagaaaaaucugaaaaacauuuuucaaccuuuguaguuucaguguuacguagcuaguuuauauuuagaugauuuucugauuuugagacauuaacauuuuuguuuaucauuuguagguuuuuagaacgacuguucgagcgacauauaaaacaaaauaaacauuuggaggagguuugucuuuccuuauaacuucauuagaaaaauuauaauguaaaaauaauuguaugguuuuuuucauaccuucaaacaauacauuaaaagcaagugcuuuuuuuuucccuugaacuuuuuugagggugguggugggagaagugaaaggaaaaguauuaauccugugagauuuucagcacugcagucaaaauuuaauuugacucaauuaauguaauuagucucaucuuuucuuaauccuaggaaaaaaugcgccaccugcugcauguccugaaaguagacuuaggcugcacaucggaggaaaacucgguaaagcaaaaugauguugauauguugaauguauuugauuuugaaaaggcugggaauucagaaccaaaugaauuaaaaaaugaaagugaaguaacaauucagcaggaacgucaacaauaccaaaaggcuuuggauauguuauugucggcaccaaaggaugagaacgagauauucccuucaccaacugaauuuuucaugccuauuuauaaaucaaagcauucagaagggguuauaauucaacaggugaaugaugaaacaaaucuugaaacuucaacuuuggaugaaaaucauccaaguauuucagacaguuuaacagaucgggaaacuucugugaaugucauugaaggugauagugacccugaaaagguugagauuucaaauggauuauguggucuuaacacaucacccucccaaucuguucaguucuccagugucaaaggcgacaauaaucaugacauggaguuaucaacucuuaaaaucauggaaaugagcauugaggacugcccuuuggauguuuaaucuucauuaauaaauaccucaaauggccaguaacucaa

SEQ ID NO: 192379 - RNA, 52817 nt, Homo sapiens
uugaguuacuggccauuugagguauuuauuaaugaagauuaaacauccaaagggcaguccucaaugcucauuuccaugauuuuaagaguugauaacuccaugucaugauuauugucgccuuugacacuggagaacugaacagauugggagggugauguguuaagaccacauaauccauuugaaaucucaaccuuuucagggucacuaucaccuucaaugacauucacagaaguuucccgaucuguuaaacugucugaaauacuuggaugauuuucauccaaaguugaaguuucaagauuuguuucaucauucaccuguugaauuauaaccccuucugaaugcuuugauuuauaaauaggcaugaaaaauucaguuggugaagggaauaucucguucucauccuuuggugccgacaauaacauauccaaagccuuuugguauuguugacguuccugcugaauuguuacuucacuuucauuuuuuaauucauuugguucugaauucccagccuuuucaaaaucaaauacauucaacauaucaacaucauuuugcuuuaccgaguuuuccuccgaugugcagccuaagucuacuuucaggacaugcagcagguggcgcauuuuuuccuaggauuaagaaaagaugagacuaauuacauuaauugagucaaauuaaauuuugacugcagugcugaaaaucucacaggauuaauacuuuuccuuucacuucucccaccaccacccucaaaaaaguucaagggaaaaaaaaagcacuugcuuuuaauguauuguuugaagguaugaaaaaaaccauacaauuauuuuuacauuauaauuuuucuaaugaaguuauaaggaaagacaaaccuccuccaaauguuuauuuuguuuuauaugucgcucgaacagucguucuaaaaaccuacaaaugauaaacaaaaauguuaaugucucaaaaucagaaaaucaucuaaauauaaacuagcuacguaacacugaaacuacaaagguugaaaaauguuuuucagauuuuucuuuuucucuguaaagcugaagacuaauccuuuccuguucuaaguucuuccauuaugcauuugcuucacauuacauauuucugaaagacuguaugcuacuuuuauuucuuugaauaaaauucuccuuuuucucaccccaccaccaaaaagcuguuuuucucucacagacauaugcaaacacccaaagccucucuaccccgauauuuacacacacacacacacacacaaccaaacccuaaagaaaaaccucuuacagagauauuuuauaauccuuccuaaauuauacuuuuaaaaauuccuauauuaaaguauaaaacaccaaugaacaaaauggaaaaggacaccaaaaaaaaaaaaggaaaaauauuccaaauucauggauuggaagaaucaauauuguuaaaauguccacaccacccaaagcaaucuacagagucaaugcaaucccuaucaaaauaccagugacauuauucacagaaauagaaaaaaaaauccuaaaauguacaugaaacuacaaaagacccagaauagccaaagcuauccuaaguaaaaagaacaaaacugguggaaucauguuaccugacuucaaauuacaguacagagcuacaguaaccaaaacagcauggucaggcauaaaaacagacacagaccaauggaacagaauagagaacucagaaacaaauccacacaccuauagugaacucauuuuugacaaaguugccaagaacauacauacacuggggaaaaggcagucucuucaauaaaugguaaugggaaaacuggauacccauaugcaaaagaaugaaacuagaccccuaucucucaccacauacaaaaaucaaaucaaaauagaugaaaggcuuaaauauaaguucugaaacuauggaacuacuaaaugaaaacauugagggaaaaucucuaggacacuggucuggcaaagacuucuugaguaauaucccacaagcacaggcaaccaaagcaaacauggacaaaugggaucacaaauuaaaaagcuuccacacagcaaaggauauaaccaacaaagugaagagacaauccacagaaugggagaaaauauuugcaaacuaccccucugacaaggaauuaauaaccagaauauauaaggagcucaaacaacuauuuacuauuagauuuauagggaaaaaucuaauaacccaaucaaaaaaugggcaaaagauuugaauagacaauucucaaaagacauacgaauuguagacaggaauaugaaaagguauuccacacaucacugaucaucagaggaaugcaaaucaaaacuacaaugagguaucaucucacuccaguuaaaauggcuuauaugcaaaaacaagcaauaauaaaugcuggugaggauguggagaaaagggaauccuugcacacuguugguaagaauguaaacuauuaguucaaccacuauggagaacaguuuggaggucccucaaaaaacuagaaauugagcuaccauauguuccagcaaucccaaaaggaaguaagucaggauaucgaagagauaccugcacucuuauguuugucguagcacuguuuaugacagcuaagauuuggaagcaacuaaguguccauuaacaaaugaauggauaaaaaaacguaguacauauacaccauggaguacuauucagccauuaaaaaagugagauccugucaucugcaacaauauggacggaacuggagaucauuauauuaagugaaaugagccuggcacagaaagacaaacauugcauucucccacguauuugugggaucuaaaaaucaaaacaauugaacucaugggcauagagaguagaaggaugguuaacagaggcugggaaggguaguagagggcugcagguuaagugggguaguuaauggguacaaaaacauagaaagaaugaauaagaccauuugacagcacaacagggugacuacagucaauaguaacuuaauuguacauuuaaaauaacuuagagaauguaaucugaucguuuguaacucaaaggauaaaugcuugagaggauggauaccccacucuccgugacguucuuauuucacaaugcuugccuguaucaaaacaucucauguaccccuuaaauauacauaccuacuguguaccucacaaaauuuuaaaaaauaauuaaaaaauuuaaaaacucccacugaugguaaauccacauaauaauuuaaaaguuaucaccuauuaauuuccauuaagugcuacugugcuagucauaauaaucauuuuaccucuaguucugaccaauguagggagggaaagauaguguaaaaaccauuuuaaagacgagaaagccacaucucuaagaugauaauuuccucuccccugaggucaaaagccuuuaggagaauuuaacccagaugugucuggcuccacagaauuucuucauucuagaacaccaugcucaccucucuaucacaggaauguaucaacaguuucuuaaaaaacaacuaauuuccuuuguuaucauuugcuagcaucagugaaguuaugaaccaaccucagaguuaguaguucugaauuauuucacaauuuuuuauuaaaacccaagaaaucuguauucuacuuuuuacaacuauuguuaacauuuuagaauauucacuacuaggcauuuuuucuauucauuuguauuucuuuaccaacuuguaauuaaacaauacauacuauuuggguaucuaucuuguuuuuucuuuuuucuuuuucuuuuuuuuuuuuuuucugagacagagucucacucugucgcccaagauggagugcgguggcgcgaucucagcucacugcaaccuccgccuugcgggguucaagcgauucuccugccucacccuccugaguagcugggacuacaggcgcgcaccaccacgcccagcuaauuuuuguauuuuuaguagagaugagguuucaccauauuggccaggcugguguugaacuccugaccuugugauccgcccaccuuagccucccaaagugcugggauuacuggugugagccacugcgcccagcccuauuuuguuuuuucuaaucaaugacauauaucuuuaacaucuuucuauaucuguaaauucacuucaacaucauuuuuaaucccuaaacagaccucacauuucauauauauuccacaguuuauucaaccaaacauuuaccauuaaacauuuagguugauucugguuuuugguacaauuauaaaaaugcuguaauaaacagucuuauaaucuugagaaaaacauaaaauuuuaagcauaaauacauaugauuuuguauguguacuuuuuuucuugugguggcaaaaacuaaccaaacuuaucaucuuaaccauuuuuaagugcacgauucagcaguguuagguauauucauauugugauacagauugccaaaacuuuucauuauguauccugaaacucuuuacccauauuaugcaaauauuauuaaccaacuuuuuaaaaugaaaggggucaacagaauuaaugccaaaaaucuuaggucuuuuugauaugccuuuuuauaccaauaaugaaaauguuugcuuuaauuuuuuaaaaaacuugauguagaggauagaaauaauuuauuaaaaaugucuaugcuuggcauauuauuaugacagagaaagcaaguaguauacauaauaggguccuagguuacauaacacaaaguagagcucagugcucaaugaaucuuagauacauaaauguucaagcaaaauucaggacacacaguuuccuuaagcuaugcaauagcuaaucugguuuugcaaacuuuccauuuaacuuacagcgugcaaaccuagcucuuaauuuguucucauuuuacuagaucuaauacuaauaaugguugcaccaaaaaugcuugcuuuugauucucaugacaauuuuagguaguaaaaugggauuauggagcuuugcaaauaagugauaaagaucuuccuucacuagucacuuauaacucaagggauauaauauuaaaaugaauaaaagcucuauucuuuaauucucccaaguggugaacuuccccuagaguaugaauuaaacauucuuuacaacuugcuaucaauuauaauaauaaguuuccaagaaagcaauauauuuuuucauuuccuaauaugggaaaauaacuuuaaaauuuuaacaucauaugaagaaauaugaagaauauuuaauguacuccugaauuaacauaacaccauuaaaaaaacuaaccuguuugaaaauaaaccaaguuucaaaauuucaucuguuacaucuucaaugaaacucagauacaacaguucuucuucacuguaaaaggaaggcaauauauagcauaaaaauuauuccuuacuuauucugaaaacuguaagaaacauuaguaccuaauuagaaauaucuaucucuaccauuaccaauguacuucuaucucauauuacuaaggggaauauuacaaaacaaacaugucuaccuucucaaauuaugcaaggauaaauauuuacuaaaggugaugaccuaauagaguaaaauuucacagauaucugcaacauccauagcaguaaaaaacaagcagaauuaaacaacacaaaaagaaagcaacgaaggacaaggcgcaaucaaaugcaauccacugggagcaagcacucccgaggaauguuuuaaauuuccucuugcuccugaccagguccagcagcagaggugcaagucccucugcaaagcauuugcaagaaggaagaggaaaguuguccagagaagcaggagcuucaacuaagaaguccucuccuagcccuaggccagcaucuuguuuuaagguugagaaauuuacuaagcagaaaaauuuauuuuuucucucaaaacguuuggagacgaaaaauucucauaggaaaauuugugaacauaaaucuugugguaauuuuuaacuacuugaacacacuucucuauuauaacuauauuuuaguagcuauuacaagaaaauuaggauauuauuguacguuugauuuuaauuagcugaaauuagugaauuaauaccaaauguaaguagcaaguaacuaaauuacugaauaagcaaauauaagggaagaguuaauaagcaaaucaaauaauagauuuaaauguuuaauaaaaaguuacacuuucaaacugauucacagggucuugcuuauuuaaaaacagcauauuugaaaauaaauaaaauuuuauaaauuauuuucccuaaaaagaguaacuuaauuaaaacaacauuaaaaucuacaaauaaaauaucugcaaagaacugcugagguuagaaaccucuggaaagaguauccugaacuauuaaaagucugcauuucucuaaaacucuucuuuauuauuuuauuauuuuuacuuaaaaaauaaguaagaaucauggauacugauuauuaaaaaguaucagguaauaccuggggacaaauuucuacuggagauaaaaaugacgugauugauaauuauuccagaaaguuguuauuauuucucaaaaaaauucgagaaaauuauucaggucaguuucucaaauuuaguauguauuauacgauugauaucccaaagcugguuguaagagagauuaguguucacagaugaauggauaaagaaaauguauauauacaccaugaaauacuauucagccauaaaaacaaauaaaaucaugucauuuguggcaacauggauggaacauggauggaugcuggugaaauaagccagcaacagaaaguuaaacaucgcauguucucacucauauguggaagcuaaaaacaguugauuucauagaaguagaaaguagaacagaagguacuggaggcugggaaggguagacgggaaugagggacaagcugagauuuguuacaagauacaaaauuauagcuagauaggaggaguaaguucuaguguucuauaccacuauaggaugacuaccaugguuaacaauaauacauaguuucaaauagcuagaagaaggauacucaauguuuccaacacaaagaaaugauaaaauguucgagaugauggauaugcuaauuaaacuguucuaaucacuguacaguauauguaucaaaauaucacuagguacuccaugaauauguacauuuauuacuugccaguuuuaaaaaaagagauuauuguucaauccugacuuauuuaauaugguuucuuugauucuuaauccuugauuccacuaugcaaaacgaagacuuaaaaaagaucuuacucagaguagauuuuacgaguugaagggggcuucagggaauacugacacauugcccuagaaagaggaaguuaaaguaguugagcaaaacagugguuggcauacaauaaguacucaauaacauuguauauuaguacacacugaauagcccuuaucuuagauguuuggaaccagaaguguuucagaauuuggauuuuggaauauuuccauuauauacuuaguaguugagcaucucaauccaaaaaucugaaauccaaaaauguuccaaugagcauuuccuuugggcaucaugucggauuuuggaguauggugaauuacagauuuucaaauuugggaugcucaaccuguaauuacauguuucagcaauuuuuaaagcacucucauacccauaucuaauuuaaucuucuaaacaacccagucaggcaugugggcuguguauuauuuuucccauuuacugauuaguucaccaagggucagaaaggcuaaguaacuuuccaagguuaauguuaguaagcagcaaagacagguuuuuaaacuacuuuucuagguauaaauucacaauucuuuuuaaaacuacacuacggcacuucucuaguauaaacaaugacaauuugacuaagguuaauguauagauaaugcuggauauagauacauuauuaugaaaauauuuuuaaagguggucaucaugauaaauuuuguuauuauucaguuauguuaccaauaauuaauuugaagcuaaauuuuauucagguauacucaacuauacuauucuacuuuacuucuuuuagaaaguauuagaaaagauaaauauuccuuuccuuaagucauucuuaauauucaaugaagacuggcucaagagcaguuauauuaauaaauaauaaguuauauguguugaaacaucagaaauuucaaagacaggguaguuaacaaugaacucuccauggccuuagcaggugagaucucccuagcaaaggccugagggagaagccagagccugaggggauuguguguacuucccuaguggucugcuacuaacaccuuauucuugcccucuuuuuaaucucuacuccuuccuuucuucuaccccuuccaccggcauuucauauccacucucugacacuggaaauacauuugacaacugaaacuaucgaggcaucuuuuagguuuucuacuaccugcuaauuaauguauaauauuccuuaauuacucaacaugaugaguaguuuuuaaagagugccuccauugcagugagcugagaccgcaccacugcacuccagccuggacaacagagagagacugucucauaaauaaauaaauaaauaaauaaauaaauaaauagugucuucauauagcacagauuggucaagcacuaggauaugaugaauauucaaaaucacaaauuaugacuccucaaaugguaaagcucuucaguacuauuuguggcauguaaacugguuagcaucacugccagaggacuugucuuggggaaaaucauuuuuuuaaugaacagugauaauaaauaauacaaguuggugugguuuuuuccuuuacuaaugaauuagcaaaauuaauucauuucaacuuuuacuaagcacuucaauuuguaaaauuuccuugguaaaacuaaaacuguuauugaauuacauaacaccaaaauagauuggagcaugcaauuaaauaguacuuaugcggcaaauacuauaugucuguuauacaagaaggcaauuaaagacaguugaaauuauuucuccugugaacuguuuaccuuggugaggaaugcugaagagcaucauccuuaaucucaucccauguugagucaugcccuucuaaagguaaaggagcuauuuuuucuuuggcaucauaugucacacaauuagaugccuggggaugcaauaaaaaaaauauuuauuuuugcuuaaaaauacauuacgaaagcagaauauaacacagcaaauuuuaagugauugaacagagauauccaguagauaaaaauuauacaguacgacaaagaauauuuuagaauaauuuuucuauccauccagcacuuuuuucuuaaacuuaaagauaaaaugacuuauuucuuguauuuuaaugaguggcauuuaaaugacauuaagaaauugccacaaauaaacauauaaagggaaaaaugaagcaaauuuucaacuuuuaaguaaguuugagggaacaaaaucucauuauucagaaauucaaauagcucaucuguuuuaaaugccaacaugucaaauauguagaagcagugguagcgcuggcagcaugaacaauaauauuaacaaacaaaaauaauggcagcuuacuuuuauagacuccuuacuacacaccacaaacugugccaagcauuuacucacaucauuagauucaaucuuuacaaugacaauuuauguauagugcuuuacaguuuuaaaggugcuguuaaaauauggaucuacugcaguuaauacucuacuggcuucuucaagucaaguacugauggcacuaucuauggaauauggggacacacauuuucuugcaggauuguaaauaaauauuuuuucauguuuacguaguuaucugcaaagcuaacucuuuccaaaaauuucaagcuaguaauagcuaucauuuauuaagcccuuaccaggcuaggcacuuugccuacaucauuuacuccuccuaauaauccugcaaguuaaguacaguuuuucuagaugaggaaauucagcucucagaggauaagugauuuguccuugggccuuaaguggcagggcccuaugucaaacagcgauuaauagcugagauggaaaacuaccaccuucuacccauuuucagaagggaagggggaaguugaguaugauuauauuuuauucuucuaucucuggaucuguguuugacauuuuaauagacaaaccauuuuuauaagcaacaaauuuaagucaggacacaagugcaagacugaaacuccaaaaauaaaacaauuuaucucaaaaucagacucaaaguugcaauauuuuaaaagaaaugaugcuaagaauucaaaauauaaacccuguaauaaacagcuucauggucuagaaaaagcagaggcaaacauaagagaauaacagcuacuuauucuuauaaaauguauaauuuccaauuauauaauauguggcaauucuuuacaaaaaaaaaaaagguauaaaaacucaacuucugcacuacucugcuggcuccucuaguaauccaggucugcaucuuugaaaacaauacuuaagguauuuuacugauccuuccauuuguccagccagccaaccaaucaucuaggaaagauguuaguaacaaaugacuucccagauuuggcaggauccaccuggccauucagagagagcuauaaccauuuguaaauaggcagaccuucuguauacuggcuauaucauguaugauaagugccaccaacagauuauucuucacagucuaaauagcuguacauauucuauuuacugaaaaacaucuguaauucaaauguagcaauaccaaaagauuucauacuuauuaccugcuuuauguucauuucugaaucugucauguuuuuagucucagcuguccccaacucagauuuaaagcuguaauaauuuaaaauaaauaauuguuaauccuucaaaauauaagcacugugguaacaagguuuacuggcuagaaaaaauaaacucaaaaagaaugagacccaucuauucuuauaaaauacauaauuuugaauuauuugauuuuauuugauuaaauaucugcagacucaucugauaucacuguacuuaucuauauucaaagaaaaaaauacuaaucuuaaauuguuuuuacuuucuaaaacaacuaaaaccuacugccagauaaauuguuuauguaauacuagaaaaacaaucacaaucacaaaucugcuaaaucucaaaacuugacaagauuuguuuuuuucuuuagucaucuggcaaacuuuuauugaacauucaucuugugccaggcacuacuguauuugaaaacauuauugaggcaaauuauacuuaauuucuagaaauuaucccaauuuaaaauuauucuuggcaguuguugcuaugaagacuggccggaauaucugcaggaaauggagcagaggguuagauggauaaaggguuaguuucuuccccucuauagcccauuguuucgccacuuuuaacaugaaucaauaugcauauuuccacaaaugcugucugaugaccuauuuuaagaauucucugaaaguauaauauuuaaaaacauacacaauucuugaaccacgcuugaaauaauaaaauauguaauucauacgcauaaggugcuugaccaguuuaauagcuauuuuucagcaauuacucugauaguucuagugauacauggaaaaggaaaagucacauucaucucauuccaaucaaaagggcacuaucagaucuuaaggcuggcagcagaaaacaaggaauauuaauucauuaauuuucauuuaauuuccugaaggauuuacuguugguugcugaugugucauaccuuaauucagucuggguuucagcuucuauccguugaucuguaaaauccuuuuuucuuuuggcagguguauaauagcgauacugugacaggaaagauuuugcuucuguuuuuaaagugcgaggagugaauggcaauuguuuguuagaaaagaguucagaauguuuauccaaaagauccccacugggugcuuucgaaaugacuaacugaaaccggugggaauuugggaaugugcuucugggccuucugccauacagggcuccagagcucaguuuccggggcccggaggcugcauaauccacacuggacggggaggaacuggaguucuucucaggaccauuugugaugacuuuacuggauuuauguagacuuagguguagucucucugaagaggguacuagugaccuugcaaaggaugaaaauccauucauuucuucuuuuaacaugucauccucaauuugcgguucgccugagggcuaagaacauucgauaugacagucaucaacugcauuacgaauucauguaauuggggauuuugagauuauacauuaaaaaaaugauagccucaaggguuuacaaaauuaacugauauguuccugaagauguuaauauuuuaucugaaguucuagucaaguauuuaaacuaagauauuaacauuuaauuccaaauauaaguaauagagcaaucaauuuccuuucugaaacgaaaaaaagaugaauaacauaucuauauuugggaucuucaacuugcauauuaagauuuauugggagaugucaguuuuaucugaaagcuuccacacaaauugugagcaccaaugcccuucucaaccacuauuagugacaucauccucacuguccugucuugucauuauuggagagugcaguguaagccaucccuuugugauguuaagccuuuaaagaaacgaaaaggaacuucuccucauaauguauggagcccugauuuagguaauugauaauuuaaauauaauuaauaaauauuuauuccauaauaauuucauauauauuucucaacuucuuuucauugggguggggguaauacuaugaaaagggaggcauuuugacuugcuccauuucuuuuuggcuuuacuuuaggaaaaccauuucuacagguuauuuguaaagucuaaaaacacagauaguauuuuauuguuuuauaaacugaaaaugucuaagaagcuuugccuaugacuucagcccuuacggacacaucuguauauccuuugcaaaacucugaggcacuuucauuagguagaggggaaauuacauggagguuacagaaauugagguuaaaaaucgcuaggauuuagccaauuauaucugucuuauuaccucauugggaggaauaacaaggggaagauggacaaguugaguaaggaaaaaggcuuccuguaugaaagguacugcucuugacauugaauagaagaggaauaauaagaacuucuaucacugcuacuaauauguauggugugcuuacuaugugcaagguacuguacucauuuucauguauagcucauuuaauccuaacaucaacuucugagagguaguacaauuauuacccuauuuuguagauaaaaacacugcucugaggugcagugucucacagauuugaacagaggcagagcccauguucuuugccacuuuaucauauugucuacuuaaaaacuuauuugaaaauuauaugauuuuagauuuuuuuuacagcauaaaaaauuuuaaacugauuuuaacucuuuuucugggaacaaauaagucagcuaaccuaaagugcugauuuaucaaagcaaaaaaauugcagauaacuggacauugugacuacuaucuaaaauaugucaaaucaccuuuccuuuccaacuguuuuauaaccuuauuccaaauacaagacaacauuacucaaagcaaguaaguaugcuggcauuaaauuuugagucacuaggguacuauuugguaaaugacuucaagauguuaguuuuuauaaguaguccuaaaugauacucacacuacagcuuauguaccagaagaguuuagcucucaaagaagaaauuucuaaguacagucuaaaaauauccuauagggcaauuaauuaauaagcacaggaauuauuuacacuuagaagaacagcacaaacugagaucagaggaaggagaaagaaaugcauaagccauuaugauugccuguaaagaaauguuaucgguaaugguuauuuaauaaacaaaaugaaacacugaagaaagucuuuuuaaaagguagaaguauauguuaagcuaucucucugaaaugggauggaaaaauugcuucugaacuuauagaaagcaugaaacuuuucccauuuuuguaucuuauaauuucuaccuuguauccuauuuuuucuuuccuuggaaaccaguagacuacaguauaaaauccacuguaccaaucugcaucuuguuuccuuuagcuaugaauaucaugaaacuuggauaaagauauuugugcagaauauauguaacacacugguagaaucccaaaacaugaacagcagaucacuguaaaguucugaaaucagaaaaggguucaucaauuaugugccaauggagcaaagagucuggugguacccugaacacucacuuucuuagguuauucuuaguuuacgagguuuguugugcacuguuucugugauuucaagauuuauguaaaguaauaaccauaacauaguuuauauacucaucauacuuucaugucaagaauuuuacaauacagaacucaguacuaaaucaaucuuuuuuaaggaugucagaagacauaaccuacaauaauuuuccaauugucggauuuuuaaacacuugaagagucaauucaauuguagaauuggauggguagcgggcgccuguagucccagcuacucgggaggcugaggcaggggaauggcgugaacccgggaggcggagcuugcagugagccgagaucgcgccacugcacuccagccugggcgacagagcgagacuccgucucaaaaaaaaaaaaaaaaaaaaaaaaaaaauuauuuuaaaaucuaacaucuguuugcaaaaaaguuucaaauuauauuuuauaaaacaaauauagcucuugauuuucacuauuuuguacuguuuuuaaaaaguuucccagauuuuuuuuuuuuaaucuuacuuuguuacccaggcuggagugcaguggccugaucauggcucacugcagccacgaccuccugggcucaauuaaucugccugccucagccuccugaguagcugggacaacagauacacaccaucaugccuggcuuuuuuuuuuuucuuguauuuuuuuuuuuuuuuuuguagagaugggguuuugccauguuguccaggcuggucucaaacuccugggcucaagugaucugucugccucagucucucaaaguguugggaucacaggugugagccacugcucccgccucuuuucuagauuuauucagaaauaaagcucacacccacauauucacuuaaucuuaaaagcacacaguaagugcuacaccagugaagcaaacgaguaguaugggagcauugacuaaguagugaaugacucaagaguuacagggugaagacuggaagggcuuaggaggguucugagggugacagcaugugagucagaguaugggagaagaaaaguggcaagagaauugggcaauuaucauaaaagguuuuugauauaugaccuuuauaauguauauaaagggcuaauacauucagagguuaaagccagcauuuuaacuauagcagccuuuacagugaauacaaauuauaaccauaacaggugucuguuaaccauaacacccauucaauuaucaaaauauacuacccaaaauaaggcucuuaagacaaucugaguguaucuaaaauauuuauuaucagggcuuaucaaaaauguaggcaaagugcaaguuacuaugaauccuaaauggagucaauaaaaauacagauaaaauaauaaauuaacaacuuuauggaggcaaaaaguuauauaggguuauaguugcuauuggaaaaaugaaaacaucuaacauuuacagaaauauauuaaaaauauauaauauguaaauaauauauauuuuuacuuuauuauauauaaauagauauauaaaauacauuaaaaagauauauuaaaauauaugauuuguauuuucaagaaaccccauucuuaucucaaaauuuaauuaguaauuuauacucaugcugaauaauagaaacaaauuuuaaauuuucuguuaaaaaguacaaucacuaaaaaugaaaauacaccugugauucaaauauugaggaacagaaucccagauagcaaaguauaauacagagcagauaacagauuuauucuaaaggaagcagcucuauugcuggucuuuuuaucuacauaauagcccuggggcucucaaucauauucacugcuuccccugaugacucccaagucuauuuucagcccagaccucuuugcugacacagaugcuuauauccaagugucuacuaaauauacuagauguuccaaaagcaucucaaaucaaacacagccaaacaauaaacuccuaucucuuauuaccuccagccccaaagaaaaccugcaccucauccuauuauauuucugugaaugauauauuacuauucucccaguugcccaaggcagaaacuuaggauuuuaacuccugcuucuuacucuucacaucauccacucagucaccaaguccugcagauucuacuuuuuuuuuuuuuuuuugagauggagucucgcucugucgcccaggcuggagugcaguggcacaaucuuggcucacugcaaccccgccuccuggacucaagcgauucuucugccucagccuccugaguagcuaggaguacaggugcaugccaccaugcccagcuaauuuuuguauuuuuagcagagacaggguuucaccauauuggccaggcuggucucgaacuccugaccuugugauccgcccgccucagccucccaaagugcugggauuacagccaugagccaccacgcccggccgagauucuacuuucuaauuauuucuuaaauguauuccuuaugcucucucugcugucauagaaucaugucuuaauuacugcuucccagauuacugcaacugucucguaacuguccuccacuguugucaguguagucuguguagugucaguaugaugacauaacuucccaacuaaaaacuggucuauggcucccagcauuucucaaggaaaaaaauccagacucauuauuacagccuugguauuugguaagcagagcagucaaucuggcuuuugcccagcaguccauaguuuuuuuuaaaccacaucaugggugcuaggggcagaaaacaaagcucuuaagagaucaugcuugagaaucugggauucucucaauggcuacuccucaacuagaugacuugcaaggaaacuuccccauccugaacccuggcacugaguugaaggagacugcuggccuucuaauaccaacucuaacaaacucaaaaaggagacaguggggaaaucuaaacaucagauauuuauuauuaaagaacuguuauuaauuaauuauuuuuuuuuuugagacggaguuucgcucugucaccaggcuggagugcaguggcguuaacucagcucauugagaccucccaccuccuggguucgauuccccugccucagccucccgaguagcugggacuacaagugcgcaccaccacuccuggcuaauuuuuuuuuguauuuuaguagagacgagguuucaccauguuggccaggauggucuugaucuccugaccuggugauccacccaccuuggccucccaaagugcugggauuacaggugugggccaccacacccagccuguuauuaauuuuuaaggcauaauaguauuguugugguuuuaaaagucuaucuuuuagauauauacucaaauauuuauggauaaaauuauauggugucugggguuugcaucaaaacaaccuaggagagugagugggcauauaggugaaauaacacuggcucugagcugaucauugcuacaaccuaggugauaggaacaugugggcuuauuauacuauauuuuuguaaaugcuaagguuuucaaaauuuaaaaguucaaaaaaugaaaccacacauaaaaauaaaacaaacuuacuguuucagcugagagauagagauggaaagaacacagcucucaccauuacaagaagaaaaaagcugaacgaucugcacauuaaugauuuuucuugaacuaaugagagaacugaggucacagagcaaacaacuaaccugaaauauggagagagauaaguaucccagcacuugcuuacuugggaaagaugccauggaaugccacauaaauugauaagauuauguuauaaauauuuguuaauuuccuaaagacugaguguggacuagugaugugcucaggucuguaccggaccugaggacuuggggaguuuguaccucuugcaggcuuuuccuccaggaaaccuacucgaagcuuauagggaagaguagagagaaucccuuucccaccuucucuugguguggcuuggggagagaaacagcagucacuguggaaaaucuucccagacuuauuuuuccauucucuuuuaaggaacaaaaaccuuaaucugcaggggaaaauaucccuucacuuuugccacauaacagaaucacagaagugacauccuaucaucuuucccauauucuacuggguagaagcaaguuacagguccuaccugcacugaagaggaggggauugcuuaagggugugggucacuguggggguguugucuucaaauuuugucuaccacauugagucaaauagaagguaugaaauaagaagccagaaauaaaaacauauuaaaugccccauuaaaaagacaaugauuaucacagcacuuugggaggccgaggcaggcagaucacgaggucaggagaucgagaccauccuggcuaacaugguggaaccccgucucuacuaaaaauacaaaaaauuagccaggcgugguggcgggugccuguagucccagcuacucggaggcugaggcaggagaauggcgugaacccgggaggcagagcuugcagugagccaagauagcgccacugcagucuggccuggguaaaaaagcgagacucugucucaaaaaaaaaaaaagacaaugauuaucagauugaauaaucugacccaccaaauacuaaccuaaaacauugagauuggcaagugacauuaaaaaaaaaaaaagaagaaaacauuaagaucaaaaaauggaaaaugauauaccaaguaaauacuagucaaaauaaagcuaauuuaauuauaucacuaucagaaaauauuaauagaaaaagcauuaagguaaagaaauucaaagcacagugauaacagguucaguucaccaagaaacuaccuccuucaggauuuucuaaaucuguauucuguaucucuaauaucucuaauguaauaacaugcauucaaaauauguaaaucaaaaauuaauaguaccacaaggagaaauagcuaaauauguaaguauguggaagauuucucucaauaacugauagauuaaccagacaaaaauaaucaauaugauauaaaagauuugaauaucuggaaaauacaaaguuuaaugaauauacuauauaucaaauacuacaugcaaaaacuauagaauauauuuuauuuucaaacauauaaugacaggacauuuuuaaaaaauuguccaccuacugggacauaaaacaagugcucaauaaauuucaagaaauggauauaauauagauguuuccuaaucacaguacaauuaggcuagaaaucuguaacaaacagauacuaaggaaaaagcagauacagagauuaagaaauaguucuaaaugauuucuggguuaaauaaaaaaaucauaaugaaaauuguaggccgggcaugguggcucacgccuguaaucccagcacuuugggaggcugaggcaagcagaucacuugaggucaggaguuagagaccaaccuggccaacauggugaaacuagacucuacuaaaaacacaaaaauuagcugggcaugguggcaggcaccuguagucccagcuacuugggaggcugaggcacgagaauugcuucaacccaggaggcggagguugcagugagccgagaucacacuacugcaugccagccugggcaacagagcaagacauuaucucaaaaaacaaaacaaaaacaaacaaacaaaaagaaaauuguaaaauacuucgaauugaaacauaauaaaaauaccaccuaucaaaacuugugggaugcagcuaaagcuguacuugguggaaaauuuauagcauuaaaaaugcuuacacuagcaaagaaguaaggcagagaauuaauaaauuaaauaaaauuagagauaguacagcaaaauaaacccagagagagggaaauaaagauaaacacagauauuaacaaaacagaaaacaaaauacaauagagaagacuaacacaauaaaaaguguguccuuuaaaaaaacugacucaaucucugaugagaaugaugaagaagaagaaugaaggcacaaauaaacuaccuuaggaauaacaaggggaaauaauacauauucagaagagauuaagagaauaguaugaacaauucucugccaaaaauuuacauaaaaugaacaacuuccuacauaaaucuaacauugaaaucauucuauaaugacuuaaaaaauugaaucaguagucaaaaucuucucauaaaaaauacuuuaggccuagacaauuuuaauguugaguuccaccaaauuuaaggaacaaauaaaccaaauguacacaagcuagaguacagaaagaagaaauagugcccaguuuauuuuaugaggauagcauaaccagacacaaggaguacaaaaaaagaaaaugacaggccaguaucaauaauggacagaugccaaaauucuaaacaaauauuaguaaguaaaucuagcaaugaauaaaaaagguaauguaccaugacuaaguucuguuuacaacaggaaugcaaaguugguuuaacauuaaagucaauuguuuguaauucauuacauuaacagauuaaaagaggcucagcauaguggcucaugcuuguaauccuagcacuuuuugggaggccgaggugggcagaucacuugaggucaggaguuugagaccaaccuggccaacauggcgagaccccaucucuacugaaaacacaaaaauuagcuggagucguggugggugccugugauccuagcuacuggggaggcugagggaggagaauuguuucaacccaggaaguggagguuguagugagccaagaucaugccacugcacuccagccugggcaacagagugagacuauauauauauauauaaaaaaaaaaaaaccccacagauuaaaagagaaaaauuauaucauaauaucaucauuccaagagaugcaaaaaagcauuucauaaaauuaauauccauucaggagaaagggaaaaaaaaaacuucacaaacuaggaauagaacuuauuuaaccagauguucgaagguaucacaaaaaaccuauaacuggggucugcaaacuauaaccuucaggccaaaucugacccaaugucuucaguuaauaaaguuucagcagaacacggcuauacucauuuauuuauguacugucuaugucugccuuccaauggcagaguaguugugacagaggccugaacagccuuuuaaaauauuaacuaucuggaucuuuacaggaaaaauuugcugacccuaaacuauaguaaacaaagucagauuguaccacuaaagaaguaccuuagaaacauuugcuuuuaaaaaauaaaaauacuaucuuaccuuuuguaagguauuaaaaagugacuuggaauuauuuuuauaauuggcucgcauugcaguuuuaguuaauuugaacucuuuuucacauugugcuaauuccuuuuugaguuucucucuucguuguuggucugcaucuaaaagggaaaacaaaucuuucaaaauauggaacaaaauagaaaauugguuuuuuggucuuguuagaguaauaaauggaacauuuuucuuguuaaaauguuaugauauguaaauaaaaauccauuuauuuuccuauauaaagaguuacuaacacauuuuaaaaauuauuuauuucacaugugccucuagauauuaacuaacacauuuaauuuauagaaauucuaaauggauuaacuauuuaaauaauacaaacaauauagugagauuuguguaguuaccaaaaaaaaaaaaaaaaaaaaagaaugccaacaagauaugacaaacuggccaagccuaagggcauaagaaagcaacucuuagcaguuauucacagagauaugaagguuacaaaugcuuaaccauguuauuuaugacuauguaaucaccaaauacuaagcuucacaaacaaagaagaaauaaagucuuuccugacaagcaaacgcuaaaggaauuuguuauaucuagaccuaguguguuagacuguucuugcauugcuauuagaaauacccaagacuggguaauuuauaagguaagaaguuuaauuggcucaugauucugcaggcuguacaggaagcacaaugccagcaucugcuucaggggagaccacaggaagcuuuugcucgugguggaaggcgaagagggaaugugcauuucauauggcaagaacgagaggggaaggcugugggggcauacacuuuuaaacaaccagaucuugcaagaacccacucacuaucacaaggacagcaucaaggggguggcgcuaagccauucaugagaaauucacagacaugauccaaucaccucccaucaggcgccaacuccaacacuagggguuacauuucaaugugacauuuggguggggacaaauacccaaacuacaucaccuagccuauaggaaaugcucaaggaaguucuaaacaugcauacauaagaaugauacucacuaccauaaaagaacacauaaauacagagguucacagauccuauaaagcaaauacgcaaucaagacuacaaagcaaacagcaaacaccaccaugacaggaucaaaccucacauaucaauauuaaccuugaauguaaguggucuaaauguacccaguuaaaaggcacagaguggcaagaaccacuuuuuaauuuuuuuauuuaaaaaauaaaauaauauuuuauuuaaaaaaaaacaaaaaacaagacccaaccuucuacuaucuucaagaggcccaucacacauguaaugacaccuauaggccugaaguaaagugaugaagaaagaccuaucaugcaaacaguaaauagaagagcagggguugcuauucuuguaucagauaaaacagacuuuaaaccaacagcaauaaggacaaagaugggcauuacauaaugacgaaggauucaauuccacaagacuuaccuauccuagguauauuugcacccaacacuggagcacccagauucauacaaguacuucuagaccuaugaaaagauuuagacagccacacauuaauaaugggggacuucaacaucccacuggcaguguuagauagacccucaaagcagaaaacuaacaaagaaauucuggauuuaaauuugacaccugaccaacuggaccuaauagacaucuacagaagaauacuccacccaacaaccacagaauaaacauucuucucaucugcauguggaacauacucuaagaucaaccacaugcucgaagacaaagcaaguuucaauaaauguaaaaaaauugaaaccacgccaaacauauuuuuggaccacgguggaaaaaaagguagaaaucaauaccaagaguacuccucaaaaccacauaauuuuacauggaaauuaaaccaacuugcuccugaaugacuuuuggguaaacaacagaaggugaaauuaaaaaaaaacaaaaaaacucuuugaaauaaauaaaaacagaaacacaacauaccaaaauuucugggaugcagcaaaagcaguguuaagaggcaaguuuacagugcuaaauaccuacaucaagaagacagaaagaucucaaauuaaucuaacauugcaacuagaggaaguagaauaacaagaacuaaucccaaagcuaguaguagaaaauaauuaucuaaaagcagaaauaauugaaauugagauuccaaaauccauauaaauguucaaugaaacaaaaaguugguuuuuugaaaggauaaacagaucaacagacuguuagcaagauuaacaaagauaaaagagaagauccaaauaaguacaaccagauaugacaaaggcaacauuacaacagaccccacagaaauagaaaagauccuuagagacuauuaagaagacuuuuaugcauagaaacuaggaaaucuagaggaaauagauaaauuucuggaaacauacaauuucccaauauugaauucagaagaaauugaaacccugaagagaaauacugaguuccaaaaucgaaccaguaauaaaaaaaaccuaccaaccauaaaaagcccuggaccagagagauucacagccaaauucuaccagacauaccaauaguugguauuaauccuacugaaacuauuccaaaaacuugaggaaggacucuucccuaacucauucuaugaaacccaaucuaugaaaccagcauaauucuaacaccaaaaucugguaaagacacaccaaaaacgaaagcuauaggccaauaucccugauuaacauagacacaaaaaugcucaacaaauaguagcaaacugaauccaacagcacaucaaaaaguuaauaaaccacagucaaguaggcuucauuccuggaaugaaaggcugguucaacauaugcaaaucaauaaaugcgauucaccauauaaacagaauuaaaaacaaaaaccuuaugaucaucucaacagauguagcaaaaaccuucaauaaaaucuagcaauccuucaugauuaaaaaaaaaaacccucaacaaauuaggcaucaaaagaacauaccucaaaauaauaagagccaucuauuacaaguccacagccaacaucauacugaaugagcaaaagcuggaagcauuccucuuuugaacuggaacagcauaaggaugcccacuaucaccacucuuauucaacauacuacuggaguccuagccagaguaauuagguaagagaaagaaauaaaacacauccaaauuggaaaaguaguagucaaauuaucucuuuccugaugauaugauucuauaauuagaaaacccuaaagaugcugccaaaaggcuucuugaacuaauaaacgauuccaguaaaguuuuaggacacaaaaucaaugugcaaaaaucaguagcauuucuauacaccaaugauauucaagcugagagccaaaucaagaacacaaucucauuuacaauaguuacacacacacaaaauaaaauaccuaggaaaauaucuaaggaggugaaggauaucuaaaagaauuacaaaauacugcugaaagaaaucagagcugacacacacaaacggaaaaacauuccauguucguggauuggaagagucaauaucauuaaaauguccauacugcccaaagcaaucuagagauuuagcacuauuccuaucaaacuacucacaucauuuuucacagaaauugaaaauacuauucuaaaauuuauauggaaccaaaaaagagcaguccuaagcaaaaagaacaaaacuggaggcaucacauuacccgacuucaaacuacacuacaaggcuacaagauggauuaaagauuuaaauguaagaccuaaaacuauaaaaauucuauaagaaaaccuaggauauacucugcuggacauuggccuuggcaaagaauuugugaccaaguccucaaaagcaauugcaacaaaaacaaaaauugacaagugagaccuaauuaaauuaaaaagcuugugcaaugcaaaagaaacuaucaacagaguaaacagacaaccaacagaaugggagaauauauuuguaaacuaugcaucugacaaaaaacuaauaucaagaauugugauggcuaauacugaaugucaacuugauuggauugaaggaugcaaaguauugguacuggguauaucugugagggugcugacaaagaagauuaacauuugagucaguggguuggggaaggcagacccacccuuaaucugggugggcaccaucuaaucagcugcgagcgaacauaaagcaggcagaaaaacgugaaggguugaggcuggccuacucucacagccuacaucuuccuccugugcuggaugcuuccugcccucaaacaucggacuccaaauucuucaguuguggaacucagacuggcucuccuugcuccucagccugcagacggccuauugugggaccuugugaucaugugaguuaauacuuaauaaacuccccuuuauauauauauuucauuaguucugucccucuagagaacccuaauacaagaaucuaugaggaacuuaaaaaaaaaaaaaaaagcaagaagaaaaacaaauaaccccauuaaaaagugagaaaaggacauagacacuuaucaaaagaagacauaaaagcagccaacaaauaaaaaaguacucaacaucacuaaucaucagagaaaugcaaauaaaaucacaaugagauacuauuucauaccagccagaauggcuauuacuaagaagucaaaaaauaguagauguggcaagguugcggggaaaaaggaauuacacacuguucuugggaaugugaguucagccacugaggaaagcugaagacugagccacugaggaaaguuugaagacuucucaaauaacuaaaaauagaccuaccauucaacccagcaaucccauuaccauguauaaaccccccccaaaaaaucauucuaccaaaaagacacaugcccucauauccaacacagcacuauccacaauagcaaagauauggaaccaaccuggguguccauuaauggugaauuggauaaagaaaaugugguacauauacaggaugaaauacuguauaugugcagcccacggagggugagcugaagcagggugugguguugccucacccaggaagcgcaagggguaggggaacuccuuccccuagccaagggaagccaugagggacuauccugugaggaacggugugcacucuggcccagauacuaugcuuuacccauggucuuugcaacccacggaccaggagauucccucaggugccuacaccaccaaggcccuggguuucaagcacaaaacuggguggcuguuugggcagacacugagcuagcuauaggaguuuuuuuccauaccccaguggcaacuggaaugccagugaggcagaaccauucacuccccuggaaaggggucugaagccagggaggcgaauggucuagcucagcauauuccaccccauagaacccagcuagcuaagauccacuggcgugaaauucucccugccagcacagcagucugaaguugaccugggacucuagagcuugguggggggaggggcauccaccuuauugaggcuugaguaggugguuuuucccucacaguguaaacaaagccgccaggaaguucagacugggcggagcccaccacagcgccacaaggccacuguagccagacugccucucuagauuccuccucucugggcagggcaucucugaaagaaaggcagcagccucccucaggggcuuauagauaaaacucccugggacagagcaccugggagaagggguggcugugggcacagcuucagcagacuuaaauguuccugccugccagcucugaagagagcagcggaucucccagccagugcuugagcucugcuaagggacagacugccuccucaggugggucccugacccccaugccucccagcagggguugacagacaccucauacaggagagcuccggcuggcauauggcgggugccccucugggacgaagcuuccugaaggaaaaacaggcagcaaucuuugcuguucugcagccuccgcuggugauaccuaggcaaacagggucuggaguggaccuccagcaaacuacggcagaccugcagcagagaagccugacuguuagaaggaaaacuaacaaacagaaaggaauagcaucaacaucaacaaaaaggacauccacacagagaccccauccaaagaucaccaacagcaaagaccaaaaguagauaaauccacgaagaugaggaaaaaacagugcaaaaagguugaaaauuccaaaaaccagaacgccucuucuccuccaaaggaucacaacuccucaccagcaagggaacaaaaaacgcagggguugcaauccuagucucugaaaaaaacagacuuuaaaccaacaaagauaaaaaaaagacaaagaagggcauuacauaaugguaaagggaucaaugcaacaagaagagcuaacuauccuaaauacauaugcacccaauacaggagcacccagguucauaaaccaaguucuugagaccuacaaagagacuuagacugccacacaauaacagugggagacuuuaucaccccacugucaauauuaaagagaucaacaagacagaaaauuaacaaggauauucaggacuugaacucaguucuggaccaagcagaccuacuagacaucuacagaacucuccaucccaaaucaacagaauauacauucuucucagcagcauaucacauuuauuccaaaauugaccacauaauuggaaguaaaacacuccucagcaauugcaaaagaacggaaaucauaacaaacagucucucagaccacagugcaaucaaauuagaacucaggauuaagaaacucacucaaagccacacaacuacauggaaacugaacaaccugcuccugaauaacuacuggguaaauaacaaaauuaagguagaaauaaauaaguucuuugaaaccaaugagaacaaagacacaauguaccagaaucucugggacacagcuaaagcaguguuuagagggauauuuacagcacuaaaugcccacaggagaaagugggaaagaucuaaaaucgacacccuaacaucacaauuuaaagaacuagaggagcgagagcaaacuaacucaaaagcuagcagaagacaagaaauaacuaagaucagagcagaaaugaaggagauacagaugugaaaaacccuucaaaaaaucaauaaauccaggagcuguuuuuuugaaaagaugaacaaaauagauagaccacuagccagacuaauaaagaagaaaauagagaaucaaaaaggcacaauaaaaaacgacaaaggggauaucaccacugaucccacagaaauacaaacuaccaccagagaauacuauaaacaccucuaugcaaauaaauuagaaaaucuagaagaaauggauaaauuccuggacacauacauccuccugagacuaaacaagaagucgaaucccugaauagacccauaacaaguucugaaauugaggcaguaauuaauagccuaccaacccaaaaaagcccaaaaccagauggauucacagucuaauuccucuauagguacaaagaggagcugguaccauuccuuuugaagcuauuccaaacaacagacaaagagggacuccucucuaacucauuuugcaucauccugauaccaaacccuggcagagacacaagaaaaaaaaauuucaggccaauauuccugacuaacauugaugugaaaauccucaauaaaauaccagcaaaucgaauccagcagcacaucaaaaagcuuauccaccacgaucaaguuggcuucaucccugggaugcaaggcugcuucaacauaugcaaaucaauaaacauaauucaucacauaaacagaaccaaugacaaaaaccacaggauuaccucaacagaugcagaaaaggccuuugacaaaauucaacagcgcuucaugcuaaaaacccucaauaaacuagguguugauagaauguaucucaaaauaauaagagcuauuuaugacaaacccacagccaauaucauacugaauggacaaaagcuggaagcauucccuuugaaaaccggcccaagacaaggaugcccucucucaucacuccuauucaacacaguaacggaaguuuaggccagggcaaucaggcaagagaaagaaaugcaggguauucacauaggaagagagaaagucaaauugucucuguuugcagaugacaugauuguauauucagaaacccccaucaucucagcccaaaaucuccuuaagcugauaaguaacuucagcaaagucucaggauacaaaaucaaugugcaaaaaaucacaagcauuucuauacaccaacaacagacagacagccaaaucaugagugaacucccauucacaauugcuacaaagagaauaaaauaccuaagaauagaacuuaaaagggaugugaaggaccucuucaaagagaacuacaaaccacugcucaaggaaauaagagaggacacaaacaaauggaaaaccauuacaugcucauggauaggaagaaucaauauugugaaaauggccacacuguccaaaguaauuuauagacucagugcuauccccaucaaacuaccauugacuuucuucacagaauuagaaaaaaacuauuuuaaauuucauauggaaccaaaaaaagggcccguauauccaagacaauccuaagccaaaagaacaaagcuggaggcaucacacuaccugacuucaaacuauacugcaaggcuacaguaaccaaaacagcaugauacugguaccaaaacacauauauagaccaauggaauagaacagaggucucagaaguaacgccacacaucuacaaccaucugaucuuugacaaaucugagaaaaauaagcaauggggaaaggagucccuauuuaacaaacaguguugggaaaacuggcuagccauaugcagaaaacugaaacuggaccccuuccuuacaccuuauacaaaaauuaacucaagauggauuaaagacuuaaauguaagaccuaaaaccauaaaaacccuagaagaaaaccuaggcaauaccauucaggacauaggcaugugcacagacuucaugacuaaaacaccaaaagcaauggcaacaaaagccaaaauugacaaaugggaucuaauuaaacuaaagagcuucugcacagcaaaagaaaccgucaucagaguggacaaacaacccacaaaaugggagaaaaauuuugcaaucuauccaucugacaaagggcuaauauccagaauccacaaggaacuuaaauuuacaagaaaaaaccaacccuaucaaaaagugggcgaaggauaugaacagacacuuuucaaaagaagacacugauguggccaacaaacaugaaaaaaagcuaaucaucacuggucauuagagaaaugcaaaucaaaaccacaaugagauaccaucucaugccaguuagaauagcgaucauuaaaaagucaggaaacaacagaugcuagacaugauguggagaaauaugaacgcuuuuacacuguuagugggacuguaaauuaguucaaccauuguggaagaccguguggcaauuccucaaggaucuaggaccagagauaccauuugacccaggaaucccauuacuggguauauacccaaaggauuauaacucauucuacuauaaagacacaugcacacauauguuuauugcagcacuguucacaauaccaaagacuuggaaccaacacaaaugcccaucaauggguauauuucuuucuggauaaagaaaauguggcacauauacaccauagaauacuaugcagccauaaaaaagaaugaguucauguccuuugcaggaacauggaugaagcuggaaacuaucauucucagcaaacuaacacaggaacagaaaaccaaacacugcauguucucacucauaagugggagcugaacaauaagaacacauggacaccaggaggggaacaucacacacuggggccuguugggggacuggggaagggauaguauuaggagaaauaccuaauguagaugacagguugaugggugcagcaaaccaccauggcacauguauaccuauguaacaaaccugcauguucugcacauguaucccagaacuuaacguauaauaauaauaauaaaaaaagaacaccuggacauuuuuuagucaauauuuuucuucucuaaagaaacuguauacaaaugcaauuguggaaacuaguuacaaauugauuaaagaucauuuugauuuguaaauauauuuauuuaauagaauuucuucuuuucccaauaacaaaaaauagaaugcuaaaaaaaaaaaaaaaguagauuagugguugccuggggcuagggguaggaauuugcagcguggcugcaaauggguacaagggaucuucauaaaaugaugaaaauguucuaaaauugguuugugguugcacaauucuguaaauuuaguaaaaaaucagugaaucuuauaguauguaaauuauuuuucaauaaaacuucuauaaaaauuaaauuauuuaaauaauucaauaaacuauauuccagguuaggaacugaucaagucaguagucugcuaugacagaaaaguacagaguagcuuauaaaaacagagauggcucaaauccagagacuucucuuuuuaugugucuagaaagccuguuucuaagccaaauucauuauaaugaaaaaucauauauaaugaagaaugauuauuaauuacacuuaacuuggugauuauaauauuugcaauuacucuaagccaucacaauuugguuuauguagcaaaaaggaaaaauuccugccuuaauugacuaaaagcagaaaauaccauggauaaauaagcacuagcuaaaucuacauuuuaaaaacaaaaagugcaagcaauucuuuaaauacccccuauaugcugucaaaucccacauuuuuagcucuauccugaaauugucucuugaauuccagacuugcacuccaacugccuccuaaggguugccaacuggcuauguaauaggcauuuauuucaaauguaaugaccaacacugaacuacugcuuugcuuucuccucucaaucuuuuccuaugguauugcucacuucaguaaaucauaacuccauccuuuuggcugagagguucuaagucuuggaagucauuuuugacccaauccucuuuucucucucacacuacaucuacauccaacccaucaguaaauacuauggacacacauuugaaauguuuccagaaucugauuauuucaaucucucuccacugcaaccacucuggucccagucaccauuauuucucaucuggauuauuuacugucuucuaacuagucauucugcuucagacuauucccaacuaugaagccaaagggaugcuuuuaaaaguaaaaguagcccugcuacuccucucuucaagacccuccaauggcuugcaauuucauucagagugaaggccaaagucuuugcaauggccacugccuuuuauucucugcaucccucugucccaucucagugacuucaucuauuacucuucaguuggcuuauuccauacuagcuacacagcccuccuugcuguuuuuugaaaacaccaaucaugacaccauuucaaggcuuuuaaacuugcuguuuccucugucuggauugcuuuuuccccagauagccacaugccucuuccuuaauucuuucaggucucugcucaauugucaccuuaucagcaagggcuucuccuccaagggacucucagucauuuuuuuuccauugcauuuauuaccauaugacauauucuuuauuuauuuguauuugcuuauuguuugucuucuccaacuacaauguaaacucuacaaaagcaggaaauuuguccuguucaccucuuuagucccagcccuuagaacaaugucuagcacauagcaggggcccaauaaauauaugcugaauaaaucaaugaauaaacucuagcaaacuaaauuaaauguuauuuuguuacucuagcaaaauaaauuaaaugaccauuuuaaauuugugauuuugacuuuauuuuuuuugagacagaguuucacucuuguugcccaggcuggagugcaauggcaugaucuuggcucacugcaaccucccccucccggguucaagugauucucaugucucagccucccgaguagcuggaacuacaggugcaugccaccacaccuggcuaauuucuguauuuuuaguagagaacggguuucauuauguuggccaggcuggucucgaacucaugaccucaagugauccucccgucuuggccucccaaagugcugggauuacaggcgugagccacaacgccugaccuaaaauacuuuuaaauacuuaguagggcuacucuacuacucuuuucuauucauguucagauuauuucuggcuauuuucucauauauauguagguuaauuuuggaacauuuugucaaguaguguaugaacaauacugauuuuuggcaucuuaauugagcucacauugaauuuagaaauuacuuuaaaaaguaucaauacuuuaaaaaguauguaucaauauauuugcauuauauagagucuuucuaucuuauaacaagauaugccuuuucuuuugguccagucaauacauuaaccaaauauaucugguuaauauauucuuuccagucaugaccagauggccauucuauuuaaguuuauauauauaucagguugcuuagguaauaauuuuuucagcuuuguuaagguauagcagacaaacuguauauguuucaggcauuuaauuugauauucugauauacauugugaaugaucauaaucaagauaauuaauacaucuaucaccuaacauaguugcuacuuuuucuuuuuuuuguggugagaacacagauguacugucuuagcaaauuucaaguauauuauacaguacuguuaacucuaauuaaugcuguacauuagaucuccagaacuuacucaacuugcauuaacuaaaacuuuguacucuuugaccaacaucuccccauuuccuccuuccuguagccccuggcaacuuccauucuacucucugccucucugagguugcccacuuuagauugcacauacacauguuuaauaauccagacacaggcaaguaccacgugaucucacuuauauguggaagcuaaaaugaacccucagguucaucuguguugucacaaaugacagaaaugacaggauuuccuucuuuuuaaaggcuaugugguguggguuuugcaugugucuguguauguuauaaaugugguguggguuguguguauguguguguaguauuucuuuauacacauaccacauuuucuuuauccauucaucugucaacauuuagguuguuucuauaucuugacuauuugcuauaaugcuguaacaaacaugggagaacagauaucuccuugacauacugauuucauuuccuuuggauauauauucagaagugggauugcuuaaucguaugguaguucuauuuucaauuucucgaggagccucuauauugauuugccuaauggcuguaccaacuuacauuccuagcaacagugcacaaguguucccuuuccuccacauccuugccaacacuuguuacauguugucuuuuugauagccauucucacaggugugagugauaucucauuaagguuuugauuugcauuucccugauaauuaguaauguuaagcaccuuuucauacacuuauuggccacuuguaugucuuccuuugagaaugucuacucagguccuucaugcauuuuuauagcaagguuuuggguuuuuuuuuuuuuuuuuuuuuuuugcuauugaguuguacuuauuacuuacacaguugggauauuaaccucuuaucagauacaugguuugcaaauauuuccucccauucuguaaguugccuaugcacucugucgauuguuuccuuugcuguacaaaagcuuuugaguuuggugaauuccacuugucuauuuuugcuuuuguugccuggcuuucagagucauauccaaaaauauuauugcccagacuaaagccaagaagcuuuuuuucuauguucucuucuaguaguuuuauggauuaggaccuuauauuuaaguuuuuaaauccauuuugagcugauuuuuguaugaguugauuuuugucuaugguuuaagaguccauuuucauccuucugcaugggacuauccagguuucccagagucauucauugaugacacuauccuuuccccacuguguguguuugguacccuuuugaagauaaguugacuauaaacacauggauuuauuucuggguucuccauucuuuuccauuggucugguauguguuuuuuuuugccaguuccauacuguuuugauuauuguagcuuugaaauauauuuugaaauuuagaaagugugauuucuccagccuuguuuuucuugcucaagauuguuuuauuuguggucuuuuguggucccacaugaauuuuacgauuguuuguucuauuucuguaaagaaugucuuugggauuucuauagggauugcagugaauuuauagacuacuuuggguaguacaaaaauuauaacaauauuaauuauuccaauucauaaauauggaugucuuccauuuaucugugucuucuaaaauuuccuuuauugauguuuuauaguuuucaguguacaaguuuucaaccuuuuuguuuaagguuauuccuaagcauuuuauccuuucuguugcuguugcaaauggcauuguuuucuuaauuuccuuuucagacaguuguuuguguacagaaaugccacugguuuuuguacauuaauuuuguauccuaaaacuauauugaauuuauugcaacaguucuuuuuuauugggcauuaggguauucuacauauauaucaugucaucacaaacagaaguaaccuuacuuuuuuuuuuuuuuuuuuuuuuuuuugagacagggucuuucucugcugcccaagcuggaauucaguggcacggucaaagcccacugugaccuugaauuccugggcucaagugauccuacugccucagccuccaauguagcuaggacuacagguaugugucaccaugccugguuaauuuuuaguuuuuuuauuuuguagaggcauggucuuacuauguugcccaggcuggccacuccuggccucaagugaucucuccaccuuggucccccaaaguauugcaauuacaggagugaaccaccacacccagcucuacugcuuucuuucuaauucguaugccuuuuauuucuuuuucuugucuaauugcucuggcuaggacuuccaauacuauguuaaacagaaguggcaaaagugaggaauccuugccuuauaccagaucuuagaggaaaagcuuuguuuuucuucauuaagcaucauguuaccugugagauuuucauauauagcuuucaugcuguugaaguaaguuccuucuauuccuauuuuguugagagaguuuaucaugaauggaugcugaauuuugucaaaugguuuuucugcauguauugagaugauugugugguuuuuaaucuuucacuauguuacugugguauaucacauugguugauuugcauauguugaaccaccuuuguaucccagggauaaaucugacuuggucaugguguuugacucuuuuaacaugcaauugaauucaguuugcugguauuuuacugaagauuucugcacuuauaucaaucagauauauuggccuguagcuuucuuuucuuguguugucuuuguuugguuuuggcaucaggguggugcuagccucauaaaaugaguuuggagguauucccacuucuauuuuuauaaaaguuuaagaaggacuggugcuauccuuucuuugaauauuugguagauuuaccuaugaagauaucugguccugggcuauucuuuguugggaaguuuuuuuuaauuuuuaauuuuauuuuuuugagauuuuaucccauucugucacccaggcuggagugcaggggcaugaucucagcucacugcaaccuccaccuccuggauucaagugauucuccugccucagccuccugaguagcugggauuacaggugugcaacaccacaucuggcuaauuuuuuguauuuuuuaguagagucgggguuucaccauguuggccagagggucuugaacuccugaccucaagugaucugccugucuuggccucccaaagugcugggauuacaggcaugagccaccacauguggccucuguugggaaguuuuugauuacugauucaaucuccuuuuuucuauuagucuauucaggauauuucuucuugauucaguuuuugaagguuguauguuucuagggauuuaccgaggugggcuuaguuuauucuucuuuuucuaguuccuugagguauacaguugaguuguuugagauccccucuuuuaauguaaguauucaucacuauaaaccacucucuuaguacuaauuuugcugcauucuguaaguuuugguauauugugguuuuguuuuccuuugccucaagauaucaaaauucuguuuuuauuucuucuuugacucaauacuuguucaagaauguguuguuuaguugccauguauuugugaauuucccauuuucuuacagcuauuaauuauuaguuuuauuccauucugguugaaaaagauacuugaaaugauuuuuaucuucuuaaauauguuacgucugauuuuauggccuaauaugagaucuauucugaagaagguuucaugugcacuugaggagugcguauucuucaauaggguauaaaggucuguauauaucuguuaaauuccuuuggucuauuauguuguucaagucagcgguuuaaaugauuucugucugggucuuauaauauguauccacuauugaaaguggauuauugaagucuucuauuauuguauuaaagucaauuucucccucagauuuguccacaauugcaugauauauuuaggaguucugauguuggguauguagauaauuguuacaucuuccuguuaaguugacccuuuaaaaauuauauaauggcugucauugucucuagagaucauuuuaaggccaggcgcgguggcucacgccuguaaucccaaccaacuuaauucaaaugauccagauauuuaaagcauguaaacacugaaccaguuuugugcuacaaaaaaguuacuaauaugauacagaagaaaaaaauguaaagcacagaaauuaaaaaucuggaaggguccuuagaaaucaucuaauuaccuuucauuucacaaaaaaggaaggucagagguaaaaugacuugcccauauaacuuguauguagcgaccaaacuggucuuuaaaaauauguacuaagaagucucuacucuugccuaacaugccuuuuuuccuccuuuaaaauuauuugaaucuaauuuuccuucaaaaauaugacagccuacacgaagguuuguugcaaacauaaaaagaauagaaaagggagaauacaaagugucaagcacaaggccugagacagacacuguguuuguagcuaugaccuauagcugguaguuacuuucuccccuaccuucuaucucuucaacuaagauauacaagcagagaugaguuaaccauuccuacuguuugugaucuuuccuagauugcacccaaaaggcauuucccuauguaugcuuuuauucauuuaucauuuagcaugaauuaaccuuagguugauauuuacuuuuuuuucuuuuuuuuuuuuuuugagacggagucuugcacuguugcccaggcuggagugcaguggcaucaucucggcucacugcaagcuccgccuccuggguucacgccauucuccugccucagccucccgagcagcugggacuacaggcgccugccaccaugcccagcuaauuuuuuguacuuuuaguagagacaggguuucaccguguuagccaggauagucucgaucuccugaccucgugauccgcccgccucagccucccaaagugcugggauuacaggcaugagccacugcaccuggcugauauuuacuuuuuuaauguagaaauguucucaaacucuacauaaauucaaauauuaacuuagaaaacuuagaaacuuagaaaacacuaaacuuaaaauuuauaacacugauuuuuuuuuaucuuuuuuuaaaauuuuauuauuauacuuuaaguuuuaggguacaugugcacauugugcagguuaguuacauauguauacaugugccacgcuggugcgcugcacccacuaacucgucaucuagcauuagguauaucucccaaugcuaucccuccccccuccccccaccccacaacaguccccagagugugauguuccccuuccuguguccaugugaucucauuguucaauucucaccuaugagugagaauaugcgguguuuaguuuuuuggucuugugauaguuuacugagaaugaugauuuccaauuucaucccugucccuacaaaggacaugaacucaucauuuuuuauggcugcauaguauuccaugguguauaugugccacauuuucuuaauccagucuaucauuguuggacauuuggguugguuccaagucuuugcuauugugaauagugcugcaauaaacauacguauaacacugauuuuuauaugauuaauacgacaaucaaaggcugugacagccauguuuuuugccuauuuuuaaaggauacauuucuuuuuuuuuuuugagacggugucuugcucucucgcccaggcuggagugcagugaugcgaucucugcucacugcaagcuccaccucccggguucacgccauucuccugccucagccuccagaguagcugggacuacaggugcccaccaccacacccagcuaauuuuuuguuuuuuaguagagacgggguuucacccuguuagccagguuggucucgaucuccugaccucgugauccgccugccucggccucccauaaaguauacauuucuuaauugaaaucaaaaacaaagguuucaaaugguauucuucagaaauuuuuaaacaggguuuucaaauuuuuggucugaugauuuaaaaaugaagauaaccuggucaaaggguagauauauaaggauucuauauauccugugucaacauuauggguuuucuuuuuccuuuuuuuuuuuuuuucuugagacagcaucucccugucaccuaggccagagugcaguggcaugaucauggcuuacugcagccuugaccucccuggcucaaguaaucuucccaccuuagccuccugaguagcugggaccagaguugcaugccaccacauccagcuaauuuuuguauuuuuugaagagacaggguuucaccauguugccuaggcuacucuuaaaugccugggcucaagugauccacuugccucugucucccauaggugugagccacugugccuggguauuuuuggauaauuuuuaaguuagaaaugcuuucucaaaaggcaaugugucaacaccuuuuaguauggcuacuauuaaacaaauaggaaaaagcaaguguuggggaggacauggggaaaucugaauacuugagcaucauuagucauaauggaaaauggugcagcugcuauagaaagcaauauggucacugggugcaguggcucacgccuauaaucccagcacuuugggggacugagucagguggaucacuugagcucaggaguuugagacaagccugggcaacaugguaaaacccugucucuauguaaaaaggcuguggcaaaauuagcugugcgugguggcuugcgccuguagucccaccuacuugggaggcuguugggaggcugaggugggaggauugcuugagcccaggagguggagguuacagugaggugagaucguuccacugcacuuuagccccagggcaauagagugagacccugucucaaaaaaaaaaaaagaaaaaagaaaagaaaagaaaauaguaugguaguuucucaaaaaauuaaaaauagaauauaugauuuagcaauuccacuucuaaauauacacccaaaaucuuuaaaaggagggucuugaagagguauuuguauacucauguccauagcaguauaguuuauucacaacagccaaaaggugacuguaacucaaguguccaucaacugacgaaugcauaaguaaaaugugguauauacacagaauggaauuuuauucagccuuuaaaaaggagauucugacucauuacaauaugggugaaccuugagaacaucaugcuaggugaaauaagccagucacaacagaacaaacacgauaugauuccacuuauauaagguaccuaaaauagauucauagagauaguaaguacaauggugacaguagucaaauucauagugauagaaaagaauguugguuuccagggccuaugggaggaaauuauuguuuauguggcacaggaauuucaguuuugcaguauaaagagaguucuggagguaguaguuaucauuguaccacaauauuaauguacuuaauauugaacuggacacuuaaaaaugguuaagacaguaaauuuuauguuauguauauuuaccuuaauuuuuuuuuaaaaagguaauaauguccaaaaauuacuuacacuuuaugcugguacucacgcuuacuggaaccgagcagucuacugcagcugaaagagaaagguaauaguuuaauaauauugucaguauuuauaaaugacaaauaccaaauguggaaaucacaaaauguuccagaccuugcagcuguuuaucauacuucuagcgauggaaaacacaagauccuugauuaaaaauacacuguugggauuaauaacucauucaauacugcagaagaaaauacuagugaacuugaagacauagcaauauaaacuacucaaaaugaaacagacuuaacauacuuauaauguagucccaaaacaagcuuggggaaaaaaaagcaaaauggaagacuuacacuaccugauuucaagacuuacuguaaugcuacaauaauuaaggcaguguggcauggggcuuaaagauagacauauagaucaacagaaccaaggaguuaaguccagaaacagacccacacauauggucaacugacuuucaaaaaguacuaggacaauuaaauagagaaaagauaaccucuucaacaaaugguacugggaaauuuggauaugaagaggcaaaaaaacaaaacaaacaaaaaaccucaaaacccuuauaucacaccauauacaaaaacuaacucaaaauggaucgcaaauuuaaauguaagggcuaaaacuuuaaaacuucuagaagaaaacauauuaagaaauucugagugaccuaagguuaggcaaauauuucuugaacagguuaugaaauaaccuguuuaguuuauaaaacuaaaaaacuaaacgacuucacgauuuucaugucacaaaauauuuuucuuuuguuuuuuuagucauuuaaaaauauaagcaucauaaaauauaaacuaaaauuuaaaaacuuuagcuauuuaaaugagaaaauaaaaauuuaaaagacauuagucaaaaauuggugaaauucaaauaaggucuguaguuaaugggauugcaucaauauugauuuccugguuuugauaacuauaccacgguuuuuaagauuuuuaacauuaguggaagagcagaguacaggguauaugguaacucccuauacaauuuuuaaauguuuauguaagucuaaaaauuucuccagaauacgaauuuuaacaagaaaaugaaaacaccagcuacagauugggaaaaaaauaucugcaaaacauauaucugauauagaaucuguauauaaagaaacucacaacuuaauacuaaagagacaaacaacccauuuuuaauaauggguaaaagauuugaacagucauuucaccaaagaagauauacagaugggaaguaauaaggcaacaucacuagaaaucagggaaaugcaaacuaaaacuaugaagugauacuauuucauauucacuagaaugguuaaaaaaggacugucaacgccaaggguugguaagggugcagaaguaauggaaauguaaaugguauauucacucuggaaaacuguaguuucuuauaaaauuaaacuuauacuuaauauauuaccucacaguucuacuccugacacauaaauuuacccgagugaaacguaaacacaugcgccaaaauuauaugugaauguuuauagcagcuuuauuccuaauggccaaaagugagucaaaacaauccaaauguuuaacaacuggugaaucauaaacaaauuguggucuauucauuaaaugaaauacuccuuaacaauacaaaagaauaaauggugguacacagaacagugugaauuagucucaagaucauuaagauaacugaaaaaagccagacccaaaacgauacaugauuccauuucuaugaacuuauagaaaagguaaaacuauaggcgaaagagcagaucagugguugccagggauuugucaggaggggacugacggcaaaggacuagggggaacucuuugagguaauggacuuuuucuauaucaaggguuggcaaauuuuuucuacaaagggccagguagcaaaugcuucaggauuugcagggugauacagucuguuacaacuggucaacucugcuuuuuaguguaaaagcugccacagacaauauguaaaagauugaaaaugauuguuugucuauggauaacuacauuugaauuucaggucacaaaauacuuuuuuuuaaauuuuuugcuaccauuuaaaaauaugaacaccauucuuaguucaugggcuguacagaaacaggugguaggaggguuuggccugaacgguguaguuagcugauuccuguuuuacagcaugguuguaguaguauuuauacaaauguguucauuuuucaaaauauuuaucuguacacauuauaaucaaugcauuuuauaauguaaguuuuaucucaauaaagcugacaaaagaaaaaaauuaaacagaaaaauagcaucuucuuugugcaacuuccauagauguguaaacaaaaaagcagauuauauauuuucauauuaaaagcaauaucuaacaaaauauuauuagcaauagagauaaaaaacgaaauaaaauaggcaauauauagauuucaaauauaguuaacaaaaauggguaugaauuugcuaaguaccuagagucaauaguuuguaucacacuaaaccaaacaaauacaaauccucucauauauauaagguauucauuuuugcuauagauauauuuuaaugagaagugaagcuggagguuuaaauugaguacagagaguucacauuugcacauuuuuaccuuuggcugaaaggauuuuauuauagugaacagccaugugauucuugaccagcuggagagugcuuagucugagagaagaggagucagugcaaaaagcuaaaaauuaaaacauaaucauuauauauuuaaaacuaauauaaaaaucaugagauaaacaaggcacugauuauuuaacucauucuuauaaaauguucugaaauucaaccagagauauugauauaugacauugugaugugaagcuuuaaucuugcacugauaaugccaaugagcuauugaccauuuggguucaaaccuuccugagaauaaaauuuuacaagccugagacucuggggaagagauucuaggauaugaucugucauuacauuuacagaacuauuuuuuuuuugacagcucucaaucuucuaacuaaggauguuuagcugcuugcuuaauuaguuaccauuguuaauacuuaaucaacggaauuucagaaauucaaugacuaccaaaucccaaaacccuacauacaaaaauuauauuccaagaagcaaauuucuaacuuaaaccugaaaacaagaucuacauaccaguuuacuacauucuuuuugaaguacuaaaacuaucuuauaacaaguguaaucgcaaagaaauuccaugacauuaaacuccuugguccucauucaaacuguuuaaaagaaaucuuagaaauaguuaagcacuuacacacaaguauaaaauauaaauauaggcaaagcuuuuuuaaacauuaaaaacaguuuuugagaaguaauacacgcaaugugguuaaaaaaauucaacagcuaaaauggcauauggaguuugaaaaagaagugauuucucuacccugaccuuuagucucccuucccagaaauauacuauguuacuguuuaaaugcauccuuccagagacucugugcauaauacaagccuaugcaauaauuacgagcuugaugccacuacuaaaaauauuuacugaauaaaugccauuuaccaugcauuguucuaaacucuuuauauguauaaacuuaucuagucauuauuauuaucauuuaaucgaagugaaaacugaggcacagagauaugaguuacaucuucaagguuacacugcugauaaaggaugcagcuuccaugugauccaaggcagccucauacuuaaaaccaccauaccuauaccagcucuauauauauauucuuuaaaagaaaguuagcaaacuuuacauauuguucuuuauccugauuucuauguauguauauuuuaaaucuaguuuuaacuuuuuauuuaaaauuuaguuuuuaaaguuuaucauuauggcuauguuacauacauauauauguuacauacauacauagccacaaucauaaacuuuaaaaaauacacuguaauacaaagaaauaagugaggcaacugaaaaugagauccuuccaccacauuuggagguaacaguaucaaagauuuuuccuguaaauaaggaaaauaaggcuuuaauuauuuugccuaaggacauagacuuauacuucuaagguauaauuacaaaaauuuauuuuaaaaccuaccuuaaaaauguaccuugaaagcuuuaaaauauaaaaauaucacagcaccuagaaauccaguuggauaaagaggcccauaggccuuugcuccuaauaggaaauguauuauucaagugcucuuuuucucugcacagcuuuuccuuuucagugcuugcgucuuuaauaccugcuacucaccauuuuaacaaggcagguaugccuuaaaucaggguaguuuccuggcaaaaguagagcugggcugcuguagcagcugggagcaggagacagccaaguccacauccagggcacaauaauaguuugaaaucauagacuccaaaauucucuaaucucaagaacgccuauauuucauuaaaauuaauaauaugaaguucaaauauucgucaaaugaaacaauuuuuccaucaugucauauaauuugccaguaaaggaaacacucagacaaucuucuaacaaagcugccguuuuaagcaccucacuuaccauuacuuuuggugcucaaguguccuuuaaauaggcacgguggaccauaucugggaaggacagagguugcucugacuuuuaacaagaaaaaaaaaucauaaauuaggauaaaugaaacacaacuuuuacaaaaacaacaauauucaauauuuuuuaaauaauaaauuuaucacaaaauaauuucuuuccuaaaaggugauugcguuuuuaguaguaaucuccaaaacaggaagucugaguuacagcauuaaauguaauuuaauaugcaaaauauaaaugcuuuaucccccaaacagagauguuuuaagaggguaagauggcuaguuugcuaucaggugggcuguuaaaagcuauaacaaggaggacacauagaaagucuagaagauauauggaugacuaaauauagaaaaaagaaguaucgagcuaggagaacuaaaaucuaagaccagagaacaaagcuugucagaauagauuaaaacagaaaaacaaacugaggucagaauaucuaugaagcucuuucuaugucacaggucagagugcaggaaggaaaaaaauauuuaggacaauacaagucaaggugaugccaucugaacugggaaaaaagauagucaugaaaugagcauagcuucuaccaagaaagaaggaggguaagaccuaaacauaagaaaaaauaccaacaaacucucagaaaaaccucauuucuccagauagaaagaacugugacuuuuuucuuguccagaauucaaugccucuucaccuggaaaugacaacucaacuuuccuuugggcgacucuucccuuacucuuagcccaggugguucaaauagagcugaccccacugucaggguuaggcauaaaacccaaauguggacagcuguguugacagcgucagcaaugcuaugcgauccaagucccaacaugagauacacaauccugggccuuugacaggaacuauuaggaaagguacuuucauuucacugggcuugcuaaacccagugaagggucuaagcaagcccuguauugcugguggccauccugaaccuuauaaaggaaccugucugagaaugaagccuacacagucaaguggaaccaagauagaaagcgauuucuuggugacaucauuugaguaccugaggccaaccauguuugaagcucuuccuucccuagacguuucuuuacauuagccaaaaaaaaaaaaaaauucccauuuuagcuuaaaccaguaugaguugauuucuucauuuguagucaaaaggcuaauuuauugagugguaacccugccaggcagugcuccaagcacuuugcugguauaaauucauuuaauccuuacaauacuauaauucucccuacuuuauagaugaggguaauugaagcacagagguuaaacuuguaauuugccaaagauuacacaagaaugugacagauuugggaucugaacccaagcagucuguuuccugggucuuaaucauuacacuaucuugaccaauauaaacugcucaguacuugaaccauguucuaagcuacuaaaucaugugaaacagaccaagaagauaucucagcuguauguaguuuauucccuccaaauuccauucuauucuauguauguuucacuauaggucacagaaaaaggaaaaacagguauacccagagaagugugaaaggaugaaaagagaaugaaaaaaggcuggaaccuagugauaaugcucuggauagaaaugcuuccccacccaucuguaagugacagcugugaacaaggugguuaauauuuggccccaggaaucaauccagcugcucuuuagcauaagauggugauaagaacaaacauggaauuuagauguuccuugaugucuauguucccuugucuauuuaccaucagacguacaccaaggcauauacucauugguuucuaauauuccuauagauacaugucauauuaaaaaugacagaauuagggcugagcacaauggcucgugcuuguaaucccagcacuuugggagacugaggcaggcugaucaccuaagcccagaaguucaaagaccagccuggacaacauggcgaaacucuaacugcacaaaaaaauacaaaauuagcugggugugguggugugugccuguagucccagcuacacaggaggcugagaugggaggaugauugagcccaggaggcugcaaugcacuccagucuggguaacagaauaagacccugucucgaaaaaagaaaaaagaaagagaaaggaaaaaaaaaaaccuaacagaauugaggggagaaauaagacgauuuaauucaucuacccucucauaguuucugguuccuccuuuguguccuguguauaggucacauuuuccuguuuuuuuguuuuuguuuuuuugcaugacuugcaauuucuuuuuguugaaaaguuaacauuuuagguaauauauugcagcaacucuagauacagaauccucuccugagcuuguuuucauuguuguucacuuguuuguuuagugacuuggcuaagcaauuuaucaaagucuauuucccauggaaugugaagccuccgauaucacuccucggugaugaagcuuugggcaagugcacaaucacgccuucucuaaugaggucugaaccccagucuuugggagaaacucucuuucaaauuguccuucuuugaguacuuucccguaauucuagguaccaaauacaguuuucuuaucuuuuuaauuaauucauuaauuuguuuuauauacuagagacagggucuugcuauguuacccaggcugauuacaaaccacugaccucaagugaugcuccugccucagccuccuaaaaugcugagauuacaggcaugagcugacacgcccagccccuuacaucuuauaguuacucuuuuaugaaaguauaacaauucuuuaacuuuuccuuguauaaaaaucacuguaugguuucuaucuccugacuggacuggacccagaaugagccaaaggggcauggagaaguagccucaaaccaaaugccaaggaaaagaacaucauucucuaacuauuaggacuaaaaucuugucaaugagauugaaggucuuaguggugaaauucacugguauaugagagcagcccauuuuccuacacaauuugauuaaaauagccagaagaaaguccagugaggaaagaugaaaguguuucuuguggcaagguuucucuggaaaaccaaagguuuggaaaucuaccauugauaagugucucuaugagaccaacagaucaaaacaauuuuuuuuuugagauggagucuugcucuguugcccaggcuggagggcaguggcaugaucuuggcucacugcaaccucccccucccagguucaagugauucuccugccuuagccucccgaguagcugggacuacaggcgcacgccaccaugccuggcuaauuuuuguauuuuuugguggagacaggguuuaauucuguugcccaggcuggucucaaacuccugaccucaagugauccaccugccucagccucccagagugcugggaaaaaauuuuuuuucaaguuacuuucaguaauauacuaauagguugucuccucuccuuccuaaaggucauugauauuagagugaauggcaguuuguuauucucaaucuuuucuucaccuucccccauaggaagcuggaaaccaugccuuauauauaccuaguccaagcccccauuuuauaaauaacugaggcccagggacguacagugacaugcugaagauuaccuaguuaguuaguaggaaacaaagauuacaaacaagacuaaccguuuuucagucuggugcuguacuauaccaccauuuagaaggcuugccuuacaaaagaaugucuaaaacgugauuacaguaagagcaugacaaaagauaauuuuucuuuagauguuuuaauauuuuaugcucugaaauaacuaaaagcaccuccuaaugaaaucuaagaaauuuauucucaauuauuuuagcugugucuaaaauuauuuaugguuuccuauuaauuuacaguacaugaaagcugacugcccugguuauuuggugauuacauuuauuuuaaaaauucaaaauaacaguauuugacauuaucauauauuauuuccuaaaaaugaagcuaauuaaauugugcaaguuguaaaaauauaaaccuuuuuacauuuggcaugaacccaauuuuuaaaauaauucaauaaacaaauacugacaacuuacuaaaucuaccauacucuaaauguuacauuuauccuuucccccugcccaucccuaccaugggauaguaaguaaaugcauuggcuucagauuuauauucuucaccuagauucaaauccuguucugccgcugugaucuuggcaaguuauuugugaucuuuugcuuuaguuucuucacuaugaaauaaggcuaaugccuaucaagguauuuuuguacauuaaaugagauaauuuggaaauaguuccuaguacauagcaaggguuuaauguuaguuuauaugcaaaauuucuuaagaucauaaagcguuuugauuugcuuuuucugaaaccuagguuggugaagugucagaauaguuugcugaucaaugaauaguuaucuccuacauucggaguagcacuuauuuugaucaaugacuauauaauaaaggcagacucauucaaagaaagacaucaaggaaucaucuagcagcuugguuuaaaggcagucuuuuaaauagauaaaaacacugaauugggaggggcggggagucuauaaagauugccucauuugacucgaggaaagaaugauacuggcucagaaagugugaaaaugcaaauuauuugguuugggccgauuuguagauauuuaagauuguauuuccccacccccaaccccaccacaugauguccaccugacucaagaaaucaguagagaacagguguauauggugaguacggauugcugcuaaaacugcaguccgcugaccagcaacaccgcauuacuuggaauuuauuauaaaugcaaaaucucagccacccccaagggaccuacugaaucauaaucugcauuuuaacaugacccugaggggauuccuauucacagaaaguuacagaaacccuggguuacucaguagcuuugggggagguaguucguuacugggagauuucguauuuacugaccacuucaaaugcgccaggaucuucucuauauuaucugcauuuaauccucaagaacuccauggccuggguauuugacccucacguucaagagauaagaaaacugagggucgucuccauggagagcagagggguuugauuuggggcccggggaggucugacuccaaagaccaaaccugguuccucugccugggagcuacugagguuuuaaaggcugcacgacccugaguucaggagacaggggccccuggugucagggcgacaaauucagggcaaagaagcggaccugcgaggcuggcaagcaggcucucccucuuccuuugcgcaggccugggcagcuccaggcaacacuggcgacucagccagggguaggaagcgccccaaggggcggccuugcacucagcugcccggacccgaggcugggagcgccgccuggagcgaggggcgaggcggcgguagccccugacagcugcccuuuaccucuccggcugccauccaugcuuaguccucuugcagccgccgcagggacacgcuguauccccuucgguccuucccgcggccgggcccagccccggcaguggaggacuggaaaagaggagccgacgggggcugcagcagcagggaaaccguugccaggccguugcuaagggcuggguccagugagucgcuauugu

SEQ ID NO: 192380 - RNA, 177923 nt, Homo sapiens
cuauggaguggcacacaucuaaacaaauuuucccaauagaaaaaaggcuauaaaaauuuuauuccaagagugauuaaauuguauaauguuguauaugugaauuuaacacuuuuguuuacauguuaaacaaauguguauauauuagacuacauuaaauaugcaauucuuucuuccaguuaaauacuguugcucccuaaaacccuuacauuguacaccauugggaaugauuguucaucauacuacuuuuccauuagugaggcuacaguuauguuuuaaaugugcgauuacagagauggcaucugaacauaaacugauggcucgaaaaugaaaauggaaauguagcagccauauacugcuaacuuuggaucuguuccugaauucaaaacuacuaggagaaaaguguccuuuauaaaaaaggaccuuauuaaugccuaaaaaacaucauauucucuaggaaagcuugugucuguuuccuuagggaaaauguuugccuuuuaaaaacugugauccuuuaggaugaucaugacuuucccuuuccuuauggaaaugcaagaauaaaauauuucauuaaacaaugaaccuugaaaauaaaauauaaacauuaagaaaccauuuugcuaaaaagauaaugaaaauuauccaaauuggguuuuugaguucuucuguaaagagugcucuacccuaaauuuucccagcaggucugccgaaaucacacacuucccaauacagggggacuuggccuuuaccaucaaguauucgauccuuccuugaaauggcauuaucuggcaguguauggauuacggauuauacccagugcauauagcaaauauuuugaacagaucagucuuucacuauuuugaugauucugggcauuucucccuguuacagucuuggguuagcaccacuugaccaugcaggguuggguuuugguuuuucuucucuguaauucuggucucaaaguuaauuucuguagucaucucagcaucucucagugagguguauguacacauuuccagacaaauaagcugcaaucagagaagaaaauugcagggaguuaauuauguuuuuagauuuucauaacaguuuaauauuuuucaguugugcuuucagguuacauguguaauauuuuuccucuuuaacuccuuuuauucuguauuugcauaaauaugagauucugaagagccaucugguuauacuaccuucuacuaauguugacuagcugauuucauaaaccaaagcuguaggaguuguuguauuaagucucuuaacuaguaacauagucugcucuucaugggcugagaaaguuacuaaccugcagucaucaccuccagcacuaacaacaugucgaucaccacugguaaaucgaauauuugucacauggggcgaaugacccaagaaccuuuuguguuuugccuaaaaaacaaugacagacaagcucagggcauuuggugcacacagaagucaaaggcucuuauuaggaacuauaaucucuaugacaagagcuguggagagaguagggaguuagcaccgcagccagugauuagaaugcuuuucagcaugaguaguggaucugcaaaaccaggcugugugggcagucagaugucuccagguacucugaccauuuuucucuaaggaaaagcauuugaaauuugauaacugauuauagguuuggugaaaagcuaauuacagcuuuuguaggaugguuccaaagaugguauuacucgagggagaggauuuguuucuaauagcuuuuauuucaaaguaaauagauuuagaaaguuuggggaaaaauuuagaaauuaggacaaaacauuuuaaauauauggggaaaagugcugaugauaagacaucaaaauuaggaguaaacugauaauaguaaacaaaacacaaacuuacaaauuuuucuggacaugggaagucaaauaacuuaaccaugccaaagucaucuccuguaacaagacugauuccugaaugagauacacaggcacaguugacaucagcuuucucagcaugucuggaccagauucccaaaaccucaucuccuagaauacuagagggaaggaacaaaagaaaacucaucauggcaagugcgggcagguugacuauauucaaaaaguuucuuggcaauuaaucucuaaguacccuaucauguuacuuaaaauacaggaaguaaauuaugguaaguuguuuggagaccugaauuucaucaggauaucaacuccugccuuuuaaaaaugacauuuuauaauuugaaggguuucuagauuaaucuuuuuaagauuaaaguaguacuuuaugaaaacugauagaacuauuuuuucuuuuuuuuuuuuugagacggaguuuucgcucuuguuacccaggcuggagugcaauggcaugaucucggcucaccgcaaccucugccuccuggguucaagcaauucuccugccucagccucccgaguagcugggaucacaggcaugcgcuaacaugcccggcuuauuuuguauuuuuaguagagacaggguuucuccauguuggucaggcuagucucgaacucccgaccucaggugaucacccccgcucggccucccaaagugcugggauuacaggcugagccaccgcgccugacugaaaacugauagaacuauuuuucaaauuaaaagugcuacuuggcuggguccagcagcacauaccaguaaucccaacauuuugggaggcugaggcaggaggacugcuugaggccaagaguuugagaccagccugggcaauauugugagaucccuaucucuacaaaaauaaaaaugacuuaugacauaggaauuaaaaaaauuucagagauggggucuugcuauguugcccaggcugguaucaaaacuucuaggcucaagugauccucccaccucggccugcuacaucagagauuacaggcaugagccacuauaugccuggcugauacaggaauuugauggcauuuuucauuggccaaaaaaauggauagucaugguuaccugucauacagccaggaaauuugaacaaauuuggaagcuuugacuucuaauagauucaagauagcauuccuuuagauagagaauuaauaacaguugcuuaacagcacccaauaccuuuuugccagucauuaaauuuagcauuaagaaaaauaucaggguaucuuuaaaguuaaaacuuugauuuccuuaaaaaaaaaacuugauaaaucauggaaacugauaaaacauggaaauauauucaauaaaaaggggucccaacaugaacauaccauuucaaaauaugguaacaaaaacuugaaacucaauuacuauuccuuauuggaauggcucuaacaguucagaaauaggauuuucuaacuggccuucaaagucaguucuugccuugugaauauauaaguauuuaccuaguccauguagcccaaguaauucugucaauagcggcaugauccauaagauguuuuccugaaggcacuucauagacaugccguuuauagcagccacuagagaccuuuuucaucagauuaaaaugggacaagaauuccauuaggugagagacaaaauccacaggggguuuacagaauacuagcauauugcuacuugauuuacaugucuaacauuauuaaguaugcaaaagaucacuacaaaaacuuaauaggagaaaagcucugauaagugggggaggaaaggggagcuguaggucagaagguacaaagggaggaguugagaagcuggagcucuggagcucaggaacuuuaaaugcauucacuaacacgaaauguaaaagcagaagaacuugccaccuggguauacaguauugguacuguaccuggagauaacugcuaucugcagagaaguccauuugaaugacaaagcuuggaaugucuuugcaguagcugauucuguuaagaguggggcccagcguuaggucauaaaaauccacugaguucucacuagaaccuacugccagauaccgggaauccggacuaaaucugaaucaaaacaaaacguaaaaaguauuagaccacaugaaguauuauaaauacuuaagaucagugacuuuuccuuucuaguucuuaaaaguaacgugugauaaggccucaaauagauuuaccugucagacacaacugaucauguauacugagauugucuggguuacaugaaauaaggaagcuuuauauuuuacuuaaauuuuaaauauuuccccaauugucaucucccaauuccuuuaaaaacgucuaauggcuuaaaaaaacuuucuuaggccaggcccaguggcucacaccuauaaucccagaacuuugggaagcggaggcgggcagaucaccugaggucgagaguuugagaccagccugaccaacauagagaaacccugucucuacuaaaaauacaaaauuagccaggcaugguggugcacgccuguaaucccaucuacucgggaggcugaagcaggagaaucgcuugaacccaggaggcacagguuguggugagcugagauugcaccauugcacuucagcaugggcaacaagagcaaaacuccaacucaaaacaaaacaaaacaaaauuuaauuuuuuaaauagaggcggggucucacuauggucccaaacuccuggccucaagcaauccuucccccuuggccucccaagguacugggauuacaggugugagccacaacacccagucagaacaucucagcuuuuaaaagccauuagcauuacauaauuaauaagcuaacaauucauuaagauaguuuucuuccaucuggaaaaaacguugucuuaauauuaagcaaagaacacagcccagcuuaacuaaccuccaguuauuaaggugaaaugacacaacuugaaucuuggaagaagaauuuuuuuuuuuugagacgaagucucgcucuugucucccaggcuggagugcgauggcgcaaccuccgccucccggguucaagcgauucuccuguuucagcccccugaguagcugggauuacaggcgccugccaccacgcccggcugauuuuuguauuuuuaguugagaugggguuucacuauguuggccaggcuggucgaguacuccugacuucaggugaucugccugccucggccucccaaagugcugggauuacaggcaugagccaccgcgcccggccugaagaacuuauuuaaaagacaaagugaaaugcuauuugccuagcaaucuuuggagucauaugggacaauucagucucuugaaauggcccaugagucuuacugagguacgauagagacauguaaaagcuaagggaagccacuguuacuauuuuauauauugaaguucugaggaagguuucauuuguaaaaggauuuuacugaugaaaaguguacaagcuuuugacagaccuagauucaauaaucuuaucuacugaucacacggaaguacuccguaaaugguagccacuguugaaaaaugcuuaagcacugaaaaacaaagguuuaagaaacauuuaaauuaauuuggauucuggaacauuuaaucaauagguauugauuaaauuaaugaacuacauauucccaaacugagguuacuaagagaagauauguuugaaaucacaacuuuaguuuuccagggugacaacuuuugaagggcagauagcucucuuguauuacagugggagauaccucuuggugggaugaacuuaauggacauggcuaaguguuaacaugaauucaucaaacauuaccuacuaguacuugcuauuauaguuggugcccaguggguuuauaauuuagcaagaagaauuaaguaguauacaaacagccauauuuuagcauacaauuuauaauacgggaaaugcuacaggcccuggggaccucuuuuugaaggcaaggcuauggaaaauuuuacaaauggaaguuaaaucaaguauauacuagaaacucuauuccauuuguucacuaaccugauaucauggauugcacaucuccugucucucuucuuuccccauauuuuuagagaacucacuaguaaaaugauaaauucuccauuuuucauuccaauagccaccauguccccuucagggcuguaacacacaguacgagcagcaugucccaaauucacuuuguuuaacaucuucugcauuuaaaaaaaaaaaaaaaaagagucauaggaaacauuaagugaaguacuucuaaauuauaccaguuuccccucaaaaugcucaacagaauucuggcaguucuuuaaguacuagcaauuuagaacuuccaacuuuucuuuuuagaaguuguaaccucuuuuaaaaaaauuaucuguacuuacuuuaucagcaauaucccaaagucucacugucccaucuucugcagcagaaaggaaaaaaucccuggaaggauguguugcuaguccccagauuggcccauccacaugaccguuaacuaaaauauuacaagcugcauuuuucucuccaacuucgauuauuucagcauuccuugucccaacaaggaucuugcccugaaacacaagcaggaccaauacagugaauguaauacaacagcugcuuuucuucuucauaauauaaaaaugacccuauugaccugcuuucagagaacuuuuugcuuugagcuaaucuaguagcaaggcagucauuagcucaugcaaauuuuucuaugacuacaggcacacaucuaucuguaagcacaaugggcuagauuacauauuagaguccaugcuacagaauagaacuuuucuguggcaguacaccuggauucuucaauaaucaaaguuuuuauuugauaaucuuaggauuuccaaacuggggucagugcagugggauauaggaaaaaauaauagaauuuauuuuuuaguuaaaaaguaaaagcuuaacuacaauuuaauaugcaggcugaagauaauauccguaugauuuauaaauacacuuaauaaguacaaacacgcucaaaaauuuucauaggaguuguaguuuugaauuuuuauuuugaaauugacacauaauuauacauaucuauagggcauaggguaauacgcauaaccaucaccucagacauuuaucauuucuuugugauggaaacuuucaaaauccucucuuguaaauaccugaaaauacauaaauacgugauucuuaacuauagucauccuacaguacuacagaauacuaaaacauacuauuccuaucuggcuguguaaacuuguauccuuuaaccaguccuucccuaucccccucccccucccccuuguccgccuccaguaaccacuauucuacucuccaccucugugggaucaacuuuuuuaguuucugcacaggagugagaacauguauuuaucuuucugugccuggcuuauuucacuucacaucauguccuccagucucauccauguugccaccaagaaugacagaauuucauuauuuuuuauggcugaguaguauuucauuguuuguuuacugcacguuuuaucuagggaauguguguuuuuuuaaaaaauggagacagcuguccuaauaugagucaacugccaagggcuuucaauuaugucuacuagaguuguuaaauuggcagauucuagaaaauauuggagguuuacauacaguauuuagacagaauagcuuccuagcuuaugcaccacacuggugcuaacuuuggcaaagaaagcagcaaagacagaguaauguuggcaagcaaauccaucguuaugcauuauuaaguauuguucauuaggcugcaaagggugagggaaucacaguaauaaccacuuucuguuuucugcugcacuguaucagcucauggaacaucuuacuuugccucugcacacagaacgaacacaaucuguggcuuguccugucucaagccugaaggcacggcaccgccucaguuccugaucccacaguuuaaccgcuccuccuucuuuugaccuaaguaaauaaccaagccagaguaaguguucauuauuggcuacuauaauuuuuauuauaaacaaauaccaaguuauaagcagaaucuuuuuuuuuuaaaaaggcccugauauuuauaauuuaccucuaauauucuuguaaacuuucuauggcaauuugaggauauacuauaucucagucaaaauaaacauccaguuucagugaauuuuauuuugagaaauacucuuuuuuucugacaugagcauaauuuuauuuagccucuacaauacauuacaauacauuauccucucucauaauacuuuuuuuuuuuuuuuuaagauguagucucgcucugucucccaggcuugagugcaguggcaugaucuaggcuuauugcaaccucugccucccagguucaagcgauucuccuaccucagccucccgaguagcuagcauuacaggugugcaccaccacacccagcuaauuucuguauuuuuaguagagaugggguuucaccauguuggccaggcuggucucaaauaccuugaccucaggugaucugccugccucggccucccaaagugcugggauuccagguaugagccacugugccuggccucauaauacuucuugauuaggaagauguaaaaaaacaauuuuauuaaaaggauaauggaaauguaaggcaaaauaauagaauuacaaaugcuaugcuacagaguugauuuauuuauuuuuuugagacagagugucgcucugucaccuggccuggagugcaguggugugaucucggcucacugcaaccugugccucccagguucaagcgauucuucuccuucagccucccaaguagcugggauuacaggcaccaugccuggcuaauuuuuguauuuuuaguagagauggaguuucaccauauuggccaggcugaucccaaacuccugaccucgugauccgcccaccucggccucccaaaguguugggauuacaggcgugagccacugcaacuggcccagagcuuauuuuugaaggccaaaacagaagcauauuuauucccuaucagguguuaaaauaucucacuggaacaguuuagcaggcuucuagugagugggggugugcaggaguaaaugacgugggaaauacaaguguuggaggacgaaauagagcccauuuauggauuuuauuccuggaagggcugaaaaauguauuccuuccuuuucugcuagaugaauugcuugucugaaagcaugccuaugugcauucuuccuuuauguaaaaggcacaaauucugcgcuuguguuuaauuaacauauguggguucuuucaauccuguauugaaauguacuucuuagucaacuauaugucacauuuuuuuuuguuuuuguuuuuguuuuuuaaauggggucucacucugucacccaggcuggagugcaguggcaccaucacagcucacuaaagccuugaccuccccaggcucaagugauccucccaccucagccuccugaguagcagggacuacaggcaugugccaccacacccggcuaauuguuguuuuuuauagcgaugggguuucaccauguugcccaggcuggucuugaacuccugggcucaagcgauccaccugccucagccucccaaagugauaagauuacaggugugagccacugugccuggccuacaugucauguuucaacaugcauaugacuauguuggugacaaaucaaaucauaaguaucugguuacuguugggagauuugaaaaucacucagaagagaccucuucucaaauuuugaggucuuguauaaaacaguuuaaauuugccucaagcaaaaggaaacaaggcaguucucucuaguucccucauccuuuucuaaagcaacaaugugcauucuacuccuuagaauccauucugaacaaaaagagagcaggcagucaaaauacaacccuggcuccagauucccccaugggccuccuacucagcaaaucauacacaggcauacagacauuaagaaaaguaacucaacuuguaggacaacuaccuauccacaccucagaaaaaguaucaccccaacaugaaaaaaauuggaagugaauuaagaccagaaaugagaaucaaauagaaggcacauaaaagguaauaaaggagaagcauaugaggaggaaggucggagaggacacucuguguagccuagaaacaacuagaauaauuaacugcaaaccucagguaggucacaaaugcauaaauauucugugaaaagaaagaggacucacggccuuuccuuucccccagucacgauaaguccaucucgcagggugguguacauggcaaacacaggcccguugugagcucucgccacgauucuacacaauaugugaucuuuccacacacagacaucaccacugaugguaccuguaaacgucaaguuauucugaaaaggagugggggagggggagacaaacucaucaaaaguucaaauagaguuuaaauagauaauuuucuauguauguguaaugcugucucacccuugauacaaagagcaugcaucguguaguggcagcagcacugaauucacgagucaggaaaccugaacgggaggcuuagcuuugucaggaccuuuuccuuuccaagucuguugcuuauuagcuagaauaaccuuagacaauucuucccuuccaauucuaacauacuauaauucuaggguuuauuuuuuauuuuuuugagacggaguuucgcucuuuguugcccaggcuggagugcaauggugcgaucucagcucaccacaaccucugcuucccagguucaagugauucuccugucucagccucccaaguagcugggauuacaagcgccagccaccacgcccggcuaauuuuuguauuuuuaguagagacagaguuucaccuuguuagccaggcuggucuugaacuccugacuucaggugaucuucccgccuuggccucccuaagugcugggauuauaggugugagccacugugcccggccugagccacggugccuggccuggucuuauauuaagaauacccaaaauguucaacugaaauuugacauggcacaaacauuucaauagucuuuuucucaaaaauguaaguguacuuaaauauucuaaaauuauaacuuuuccuauaaguauugcauaaucacaaaaacaaaaaaugcacuuaguuuuucgaugcaccaaaggauuuauacagccuagccaaugcaggauauuaaaggaaagagauguggauuggaagccacagguccagaugagauggaauaaagugagaggagagcaggucuccugaacacccuucugucagggccaggaauugugcuauuuccuucugucucacuaccuccuucuucccucgaaguagagacacuggcccagagcacuuccagcuguaugauaagcaguguguuaaaugauaaaaagcaaaggaaauccuaaacccuaguaccaccuuaaaucauuugaaaaucauguuucuugauuuaccuuucucucugacaaauuuuuaggacuaugaagaacuacuaggaagacagaaauuuuaggauauuuagggugacaauuagaagauuaaggaaggcuuuugaguauaacaguaguccaaggaaucaaauguucaucagaauccuuauuaugguggcucaugccuguaaacccagcacuuugggaggucaagaugggaggaucacauagcuuaggagcuugagaccaccuaggcaacauagcgaaacccugucucuacuaaaaaugaaagaaaaauuagccuagcauggugguuccugcccuguagucccagcuacuaaggaggcugaggaucacuugaaccugggagauggaggcuacagugagcuauaaucgcaccauugcaccccagcccaggcgacagagugagauacugugucaaaaaaaaaaaaaaauccuuuucccccucucauuaacauucuuuucacucccuaauuucugaaagaacuagauuuuugaaagaugaaauauaugcuugaccagggcauguaaugauuagcagaucacaguaucaucucaacaacauucauguggcugaugaucuaaggcaagagaauguaaaguagucaaagucacacuaugugcauuuuaagagacauacugcaccaaaugcaauagcgagcauggucugcauccgggcaucuuccagugugcucaguagcccuuuuuugcuaagaagagcucuuccugccaggguccagaacuucacauguuuuacucccacugagacaaacuggguaucugaaucuggucggaauucugccacaaaaauacguugauugugaccagcucugcuggcaauuuuggcaccugacaagauacaacaaaauuaucuagguuauuacaagaaccaagcuaaucaacagcaucaaacaaauauguaaaauacauaguucaaaaaacaaaggcuuagaagagaggccaauggccccugcucuacuaccuagcaauacaugauuuacaauuauuuguguauugaguccuuuucacuuaucuucgcuccauuaacuuuucuuuauauaacguaaauguuuugucuaaagugugguagguaauauuauccugcugaucugccauuaucauuagaaauauacauaauuuucauaagaaucuccaaaaccaaucaaaucauuaauaauaaauacauaguuucuugcuggaagaaaauagcagugaaucauuuauaaugcuaauaaugguuucauuaauuuaucuguuuugugagguuacaguuccacugggcuuuuaaagugaaauauaccuacaguaccacuguguacaguauauugcauaggccuccacugaaugauuguuucaaccaccaacuuuaagacaaauauuaaauacagaauuccuacuaccuuuguauucuuguuuuuuuaaaaaucaaacacacaaaagaauccuaccuuccugccaucuccaaaugguaauaguauguucugggucuagucccacagacagcaauaguuugccaguagcacugaagcugacugaacauacucccuuugaaugguagcaucuuaggauagauaaagucugcuuguucauugcaucccagaugugaauagaaggagcuguagcuaaauaaagauaguaucaaaaaguuguaaucuaccuguuauaaauauuucuguuucuaaagcuuaugcauauucaucugugaaacauggacaaauguguaccaaacaaaaacuguacuuaacaaagaacagcucaaaacuaaggcuaaauuuaagaaaggaaaaggaguuuuggggguggggaggaaagaaaaggaaaauauauagaacacuucuucaggccauauuccaaauugcacuuuuggaaaaacagcauuuagacaagcaaaucaggcaaucucaacuuuaaacaauucaaaacaaaugcauguuuuauguauacuuuuaaucuuuauacaauuauauggagaacuauacaaauauuaaacaauaaauauuaaacaccaaguauacauucaguacugauguuaucugaaagagaagugaaaagcagacacaaauagacaaaggcaguagauaggaaaccaccugaauagaucucaaaagaaauuuucaaccauacagauagacaucugguaaaaagcuaaguucauaucacuuuauaagacauuuacuuaaaaaggauuucaugagaaagauaaaacugcuaaucuuuaaaaaaaugugguuauuauuaaucuuguguagcuuguuucugcugcuuaaaaaauuaucccaguucuccauauuuucuaaauuaaaaaaauuauaguuuuauauuuucuuuuuuaugaacugcacccuauaaaaauggauaggucaauucagcaguuaauucaaucucagaacauaaguacuuuuaaugaagcaauaaaaauacuaaagugcauuugcuucaaauuauaaauguuauaaauguuuuaaaaauagagaaacauuaagacaagcugccuuaaaucauucaaugcagaaauaaauguuggucucuaaagaaaauauucugauaaguuuagauuauauuuuauaccaucugcuauuuguaauacacaaugauaaauuaaaucuggcaguucuucaaagcaguuaaaauauauuaaaccagagacuuagaguaucauuaaguagaaauuguucaaagauuuaugcaacuguaaaauaucaaaacuacacggaaacauacauaaaaguuuaucauauaauaaaauagguuauuuauguuuguaaaauuuaugacaauaaugucaguauugaacuaaaauuaauauauuauucauucauuaaaagucaaaguaccccaaggcauagguaaacuuaaccucaauaaagaauguuagguggcuuaaauuuaaaauguaaauauauaccagaucacucuauacauuuugccagugauaaauauuauauaaauauuuuuauauguuuacaaaaugcaccucuaggcaauucacauguuauauuugccaaaucaugaugagguagacaauagauuuucaagaaauaucacuaacuuugccuccaaauuuaauaugccacaaguuuuaaaguuuuauuuaucuaaauuuaaauagcaaguaaucuuaaauucaaugacugagcuucucauauuuuuauaaaaaauuaaaggagauggcaagaaggugaaaccagaauuuauguuuuaaaacguauagguacguaagguaauggaauugucacacacuuagacuguucuaaacuuacaucaguaacaguauuuaaaacuaaaauuacugcaaauuuucaggaccucucgaaguuacuaaagaugaaacuauguuuauuaaguauauuauauuuucuccuaucauuuggaaauggucauuccugaugcuuggguaacacauaaacaauucuuccuccaccuguuccaggaggccaugagguauuaaguaccuaucauggcaggcauguuacuggggacaucgcauauuuucuaaugcuuaccuucuagguagguacguuuuuuccugaauucagccucagagaagauaacugacuugcccuaauacaacucagagcugggagaggcagcacagguaugcuguucucaguauccagguuccacucuugcucuuuuccccacauguagcucccuccagaaaaucaaucccaguaacuuuucacuaccguuuuucacucuuaguuuccaguauagagaugccauaagugucucuuuaaauuuuuaauugggucuuacaagaaucaaaguuuuaaaggauauucuuuauccccuaguuugccuuugaugcaguauaauaaaaacuguauuuuuuuuuuuuuuuuuuuuuuuugagauggaguuucgcucuuguugcccaggcuggagugcaauggcaugaucucggcucacugcaaccucugccucugggguucaagugauuauccugccucagccuccagaguagcugggauuacaggcaccugccaccaugccuagcuaauucuguauuuuuaguagagaugggguuucuccauguuggucaggcuggucuugaacucccggccucaggugaucugccugccuuggccucccaaagugcuaggauuacaggcaugagccaccaugccuggccuaauaaaaacuuuauuuuaaaagaaaauuuuaacaugggucauuagguaugccaaguguauuuuguccuuuagucucuguagugaguaacuccuuacugcauacucagcauccauuacauccuuucuuccuaccaaggcuccaguuuuauucaggaaucuacuccuuccuagagcguaagugauucaggggaaacaaacugcaugcucaacuaauaagucugagcccacugugauaauacugccuccacucccaacccagaccucagugauuaguuuaauaacccagacuuaaaccaaucagcacaugguauuccccuaguaucuucucaguucgcaguuugcuuuguguccucacgcaaagucaggcuaaaaugacucagucaggcuaaacggaaggauuuuuaggucauggcucugaaaaggauuuuuuugcuucuuucccacuggauaacagcaaggaagcacauaacuccaauugcuacugcagccauuuucaugaccacaaaugcaaccagccuuaucggugaagccaacacuguggauagcagagcagaagagacggaaagucccuggguucuggaugacaucaugaaacuccugaaguagcacacuccggaggcuacccucccucuucauucuugugugcuaaggaauuuccuuauccucugcuguaaaaugcagacacccacugaaguuauuugaugggcaacugccugucacuacaaauacuaccagagagugaguuuucucugcuuaauugccuuaaggaucaaaaauaucaaauucugaggugcagucuuaggagggcugaaauuacuuuaucagagacaaaagauauucccauaguguccacugaaaacauaucuaauguauucaaugcuaacuuuucuuuuuucuuuuugagacaaggucucacucugucauccaggcuggagugccaugaugugaucaugacacaccgcagccucgaauuccugggcucaauuaaucuaccuaccucaaccuuccgaguagcuggaucuacaggcacaugccaccacacccaucuaaguuuuguauauuuuuguagagaugggguuugccauguugcccacacuggucuugaacuccugaguucaagcaauccacccacuucagccucccaaagugcuaagauugccgggcacgguggcucacgccuguaaucccagcacuuugagaagcugaggcggguggauaaccugaggucaggaguucgagaccagccuagccaacauggugaaaccccaucucuacuaaaaauacaaaaaguuagcugggcgugguggcagucgccuguaaucucagcuacuugggaggcugaggcaggagaauugcuugaacccgggaggcagagguugcagugagcugagauugugccauugcacuccagccugggcaacaagagugaaacuccaucucaaaaaaagaaaaaaacaaaacagaaaaacccaaagugcuaugauuacaggugugagcuacugcgcccagcucauaucucuucuaauguauuuauucucccacauugcaaagugacaauuuaaaaucuuuauccuuguuccaaccuaauacucauuccccaccuccucaaucucaguugaugauacagggaaaauggaagucaucagacaguacuuccuuauuuuuccauccccaaaucuaccagucuucuuauauuuguacaagaaagaauguccaauaaauuucacuccuuauaucuguggauaauuucuuccugucaaacugauuucucucaaaguauuccccaucccauuuggcucacuguucaagcaaaaaguucaacuggccuugauuccucacuaugucauacgcccauacccaauuaaucagaaaggauaacuggcuuuacuccagaauacaccccauauuugucucguucucuccacauucacuccugccacccugcuuaacuguuuuuugcuuggacuacuauaacggccaccuaauuuuccaauuuucucucuucccccucuacauucucaauaauauagugagagugguuuucucaaaguauaaauucggucauaucacucccuugucuaaaauucuccagugacagccucugcacuuagcaugaauccaaacucuucucccugagcuacagcauccugcaugagaugaccacuaucccucucuacauucaucucagaggccuuccuccagucacacugaccuuccaguuucuugauccagccucaggguuuaugcaggaaagauuuaauauaagcaggguacuugcaggguaccaaaaagcagugcaaaggcccaagguuacugucaucagaagggccugcuugcugggcuagcucuuggccaguguguaagaacuucugaaguguucuccauguugacaaagcucuuuuguccaccuggggcgcugaacacuugcuuucuucagggcguuugguauuuugguaguuaaggcuggucuuuaucccuaugugaccaacccccaauaaaaacucuggacucugagacuucaguaggcuugccuaggcagaaacaccucauguguguugcuggauuugacugcuggaggaagaagcagguucuguguaaucccuggcaugaggguguuggagagacauagaaacccuguaacuagaugcuccggauuccaccucauaugucuuuucccuuuucuguucaauguaauaaacuaaagccuuaaguaccucugaguccugugauuucuccuagugaacugcugaaugugugggaagucuugggaccccugaaacuggucugagccugcagcccccagaucaugccucagcuaucuacuccuggcauagcugaauguuaccaccucugaaaaaacaaauacuuuguuuuauugccaucaucucauuuauuguuuuuaacacauuucuugccaucucaucucaaaucaucaagguauuuuaguuuuuauuuauuuauuuauuuauuuuguagagacagggucuugcuguugcccaggcuggacuugaacuccuggccucggaacuccugucucagccucccagagugcucggauuacaggugugagccacuauaccccaccugucaucucauuugauuacaauacaauccaugcuucacugugccuuaaaagugugauauucaaaaacuauuuuuguuuuuuguacccuugucuugacaugauggagauuuacugguuaaaaaacaaaauaaaauaacaagagauaacagauagugcucaaagucugugaauuauaauuguguuacuggaacuugcagaguaccaaaaagcagugcaaacagaugagugucaucuauagccucuguagcuacuacacaccucugccauuguagcacaaaagcugccacagaacauauauaacuucauaagcauggucgugucaaauaaagcuuuuauuuaaaaugcuuauacuuuuauuaaagugcuuaaaacagugcugagaacagggucucacuauguugcccaggcuggucuugaacuccugggcucaagugauccucagaccuuggccuuccaaagcacugggauuacaggugugagcuaccaugcuuguccaaaaaaaaccauuacuauuaccacagauugaguucagaaucaugacauuaaaauaauguauucuucauuaaaaaaaauccgcaaguuuuuuauagaguaacaagauacuugaugauaugguuuggauauaugucccugcccaaaucgcacauugaauuguaacccccaguguuggagaaggggccuggugggaggugauuggaucaugggggcagauuucccccuugcuguucuugugauugugaguucucaugagaucugcucguuuaaacguguaguaccuccccuuucucucucuuccuccugcuuccaccauacaggacauaccugcucaagcccuuugccuuccaccaugauuguaaauuuccugaggccuccccagccccauuuccuguacagccuguggagcugugagccaauuaaacacauuuucuuuguaaauuacccaguucuuuaauaguaaugcaagaacggacuaauauacuugaacuuaaguuuaauaugcacuaucauuaccaaacaauauaaauaaagcagaaaauguuuaguuuuccuuaccugacaugucugcugaaucaccuauaauggaaaauaauuaucuauaaauaacauaaaucuguaaaaucuguaaaaacccaaauaucauauuaauuauaauuuaaacuauuauauacaaaauugguuuuauuacauuugauugaguaaacuguaagagaaggcacucauuucaaucauacauacuuauuaacaugcuauguaugaucuuucaaucuuccuuuggauaaaaauuuuguuuucuuugcauuuaaugaguuacauaaacuuuuaauuauaauaacuuuuaaaaugauacugauaugauuuaaaauuauauuacccucauuuugguuuauaaaaauguacugcuaauaauagacucucuggaguuuuaaugacagcaaagguuacuauauaacucaagaaaggaaacaaguucuuucuuucaacuaaagauuuuccguaugcaucuuuuaaugcaucucugucuccagggaagaauuagaucuaaaccuucugagcugagagacaugauggcaaagcuuacuguauaacucaagaaaggaaaaaaguucuuucuuucaacuaaagauuuuccauaugaguacaaguuugccaagaaagaaaaugugaaagcucaugcucauuauauuugugguagaaauaccuaauaaccaaacuuuucaaaguagcagucuuuagaacaagaaagaaaauaaaaauauaggaauccauugaagacaggugauuguuuuuugcuuugguaaagcuuuauauccauaugaaauaaugauuuaaaaaacauauugauaacauaggaccauagugccuugaccuggaacaugaggaaaaacagaauaaaguacuuaacucugcugagcagaccacauaggaaauaucauuuuuaguuaugaauaugcucuauuaacaaccaaauggugagagggcuuggaacuuugccaccugaagccugggugaaagacugggaguguuuggucuggagagacuagguuugucucugaauauuaacagggucugggacagaaguacaaaugaaagcuugaaugucaucggccuaaauauuuuaaagcuauccaucaagauaaaacuuaucaaauaaaauauauucuagccucuuaccuugaugaguacacuccuauaaugaucuggaaggcagauaccaauuuagaacuccuuagaguuugggcagcaugagacaaccugucucauucucuuccaucccacaccacaaagaaccauggaagcucauguguggugcuaugaacuggaugucugucuucccccaaaauucauauacugaaacccuaaucaccagugugaugguauuaggaggugugaagguuaugaggauggagcccucacaaugagauuaguguucuuauaagagacaggagaaagauaaucuuuuuucaccaugugaggauauaaugagaagacagccaucugcaaauacagagaaggcccucaccacaacuugaccaugcuggcacccugauuuuggacuuccaaccuccagagcugugaaaaauaacauuucuguuguuuaagcuacaaacucugugguaucugucauggcagcucaaauuucuuaagacaugugguuauccuagcuacugcauuagaacuccauccaccccuacacaaagaacagcuuggccaccccucaagaguauacacauugguuguacagucugucacugggaggacagacgcagagaaaaggcucaugcagggccauuaguagguucaggaccaucugguagagaauucugggauuucauauacccaaaacaugguccaguggagaaguaggcucccccauggaaagcaauccccuugcucucauguacaccuuguuccauggaauguaguuggagggugccaaaggagaccuuuuaaaagagaagcaaaaggcugggcacgguggcucaugccuguaaucccagcacuuugggaagccaaggcgggcagauaacaaggucaagagaucaagaccauccuggccaacauggugaaaccccgucucuacuaaaaauacaaaaauuagccaggcaugguggcgugcaccuguagucccagcuacucaggaggcugagacaggagaauggcgugaacccgggaggugggggcugcagugagccgagauugugccacugcacuacagccugggcaacagaacgagacucugucacaaacaaagaaacaaauaaaagauaagaacuagauaagacucagggagaauaugcuagcugucuccaaaacuggaagauaaugccaugggaaugugauuagauguucuagauacaccaagaaugagggccaaagaguagcaaucacagacagauuucuguuguauaugaagaaccacuuuauaacuaagcuucccagggaaacguuuacuucauuagguauuaaguggcagcaggguucaaacacacuguaacagagaggacaaaaugauauacuuggcccuaaaauuccaagauucuauccaggaaaaaaguuugaauguaacuggcuaaaauaguacaaaaucaaacauuucaauuacucuaugaucuauaugauuuuuaacagaaggaacaauaaacauuguaaaugcuguuuuguguuuuguggguauuaaacaagccugacagcaaaguaacaaaacaauucucuuuaugugugaggagaaaaauaaaauccuuucuuauucuuuagucuucccuugagucuaucuuaauuagucaccaguaauuuuuguuaucugucuucuggaaggguacaaaugguguaaagaauggagcuacauauauaaucuaaaauuuaccucuguacuccccagauuuugacuuggaaagaaagaggagggauauaauuaaacauuucauauuuucuauaguguugucuuucaaaauaaaggggagaaaagggccaaauuccuaaaagauuaauuugugaccaugacauuucuuaacuaagaaagaaaaccacagcacuaaaaugauaaauaaguugccuaacagagggagagcaaaggaaagaaaaggagaagccaaggugggaaaugaaagaaccauauucuagaauucuauuugcagaacguaaaucccauuaauacagggauuuugccuuuuuguaaguagcccauauccccagcaccuaaaacaauaccucgcacauggcagguguucaguaaauuuguugaguaagugaauuuacucaauaaaaauuaacuaaacaguaacuauguaccaagaggcauugagcuagguacuuagguaacauaguuucuucauuccucaaggagaugggccuuguuccuugugcacagugaaaauaagacuucacuuuccaaaaucuuagcacaaacagaagcuagaccuauguauuuauaugcaaagauuagaauauuuucuguauaauggguaauguuccauuuacuuuuaaaaguagaaaacuguacaaaaaggaaaaacacaagggucuauguggcauagcuucagaaccaggcaacccagacaacaaauuccugacuaucaacuuaguacucgcaugaaaaauaaagauauuaaaaguauaaauuaucuuagucaagaagaaaagggaccuggaaagcuagcuuagccaucaaggcccaauaaauuccaacaaacucaaugauuucaauaaauuuuacaaacguauugaaguuuaugaaacuucugccauauucauauuuaguaaucacagguuggcagauauguccuaaacagaccugccauccucucaucaguuuggcuguagaguuauggccuuuguuuaacaguuuuucacagagguaaaagaauacagguauauuucaaaacagcucaagacaguuggugaauuaggucaaugacaaagaaaagaaaaaggcagaagggauuuaccaacaacaaacagacuuggguccucucuucuuuccagccugaacccccacggaagcaggguucuaccccgcccagucuaguuauuucuuagcuucccuuuguuuacuacuuccucuucaaacuccucuuuucugcuuuauaugcuauugacuuaaaccuuuuugcugaccagaaauuccugcuaaaggacuaaauccaacuauuucaacuaccauacaauaguuuccuuuaaauuuuggauugucaagaccaacucagauaaccagagugagugagagaaagguaccugaaagcaaauaauaugguauaauuggguagggcuuuauguauacauagauuuugaacaaucgauaaaucaauaaaauuuugauuuuuuccuuggauauugaauuuauuugaacaaagcaaaugcuuuaaauuguuucuuuuuaaaauacagaaacauaccuacuuggccaguugccacuauguugauaaauuuggggugcugguuuacugugaggcacagaauaucaucauuauguuccugauaaaaacucugagaaccuacaaaaaagaauuugagaauuaaguuugaaaauuuuaagauguaacagccaaaagcacuuacccagaacaauaaacuacucuuuaacuuauuugcuuauucaaaacauguuuuugagcacuuacuauguauacagcaucauaaggauagaaaaaugauucagaauuauguaaugggauagagccguaaaagggauaaacaauacaguacaaggcugaagauuccaagugccacaagagaguugggaucaaaaugcuaugggaauucagagcagaaaagauuaaucucaucaugggaauaugguacuccuggacugacccagauagauuuuacaaauguaaaagucaguggggaagggccuucuagacagaggaacacuuuaagcagaggccuaaaggcaggaaaguguuguguauccauauaacaggcucauuuggcugaaguguagggucaugaagaagaaagaugaguaacaugguuggaaaggcagcuugggacuagaguuagggaggauuuugagugucagcccacgauccuucuguuuugguuucucaaagaaaaggauuugccagagucacacagaaaccaguaguaauuuuccauuuaauaauuugggccauauugagucacauuuuauauuuguucuuaugucaguggaggaagaacugcaaucuguuuuuguuuuuuugagacagucucacucuguugcccaggguggagugcaaugguguaauccuggcucauugcaaccuccacuucccugguucaagcaauucucaugccucagccucccaaguagcugggauuacaggugugugccaucaugcccagcuauauauuuuuuguauuuuuaguagauacgggguuuugcuguguuggccaggcuggucucaaacuccuggccucaagugauccgcccaucuuagccucccaaaaugcugggauuacgggcaugagccaccgugcccagcaggaauugaaguuuuuugaucaaauaaguauaaugugauucaucugguaguaguaacagugaagagaccuuguaaggcuaugacaguaguccaugcagaagggaaaaaagauagacuuguggaaguaaaaugaagagguggaaaaugaguucagagcaguagguuggauccagaggauagagaaaccaugaauacuacuaggccccccaaaaagcaaaacaaaaaucaaacaaguggggcacuucaacaacccacugauaguguuagaucaucaagguagaaaacuaacaaagaaauucuggacuugaauucaauacuugaccaauuggacauaacagaaagaacacucugcccaucaaccauagaauauacauucuucucaucugcacaugaaacauacucuaagauugaccacauguucagccauaaagcaagucucaauaaauucaagaaaauugaaaucaucucugccauacucucuacccacagugcaaaauagaaaucaauaccaagaagagcucccaaaaccacacaauuacguaaaaauuaaauaacuugcuccugaaugacuuuuggguaaacaaugaaauuaaggcaaaaauuuaaaaaaaaucuucaaaguagauuaaaacagagacacaacauaccaaaaucuuuggcauguagcaaaagcauguuaaauguuaagaggaaagcuuacagugcuaaaugccuaucucaaaauguuagaaagaucccaaauuaacaaucuaacaucacaccuggaggaaauauaaauacaagaacaaaguaaccccaaagcuagcagaagaaaauaaauaacaaaaucagagcagaaaugaacaauacugaaacccaaacaucuauacaaagaaucaacaaaauaaaaaaaucgguuuuuugaaaagauaaacaagaucaauagaccacuaguaguuagcuuaacaaaaaaaagaagaucccaauaaacacaauaaaaaaugacaaagaucacauuacaaccaaucccacaagaacacaaaaggcccucagagacuauuaugaacaccucuaaauacacaaacuagaagaucuagaggcuaugauguuaguugugggccucuaaaaaaagaagaagaagaagaagaaaaaucuagaggagauggauaaauuccuagaaacacacaaccucucaagauugaaucaggaagaaacugaaaucuuaaacagaccaauaaugaguuccaaaauugaaucaguaauaaaaaaccuaucaaaaagcccuggaccagauggauucagagcugaauucucccagacauacaaagaaaagcuggugccaauccuacugaaacuauucuaaaaaauagaggagugggcacuccucucuaacucauucugugaagccagcaucacccucauacaaaaaccugccaaagacauuugaaaaaagaaaacuacaggccaauauucccauagaaaacuacaaaacaucccacacaaaacaucauucccauacaaaacaucaucccuaugaugaacauagaugcgaaaagccucaacaaaauacuagcaaacaaaauccagcaggacaucaaaaaauuaauucaccaugaucaagcagguuucaucauuccuggcaugcaagguugguucaacauaugcaaauuaacgaaugugauuuaccauauaaacagaauuaaaaacaaaaaccauaugauuaucucaacagauauggaaaaugcuuucgauaaaauccaacaucccuuucauguuaaaaaccuucaacaaacuaggaauugaaggaacacaccucaaaauaaugaagcauuuauggcaaacccacuuccuacacuaugcacaauguauccucaaacuggugagaaaccaaauauaauaaaaacuaaagcagguggccuagucuccaucugcccucucucuagacaccccaccacuagaaaagugauuaauuacaaaucagaaaaguaaaaauaaaauuauaaguauaaacaugagaguuuacacauacauuccuuucuuguuuaucuuacucuuccucauucucucugaaggacagacagaccucgauuaagaaggauuuuucucucuaaucaguauguuuuaaauggcccaaauuauuaaauagaaaauugccacugauuucugugugauccuggugaauccuuuucuuuaugaaaccaaaauagaaagaucauauugaugguuaauaccgacaagaggugguggauuauaauucacaucaucaaucuacucuuuacccauucaggaugaagcuaucagaggaaaaccagaaugaacuagauaaccuuuauuuuuacuucuaacuuucagacuuuuaugaaguuugccauuaaauuguaauaaaacaauucaaaauuaaauacuuaauguuacuaguagcauuaucacauuguucaugaaaugaugcuaacagaacauuauuugcucuugaauaauccaacugaauaacccaaucaguuaaaugaacaucaagaaauaauuuucucaccuucuuggaucaaacaagguaucaucauagagccacagauaaacagcuuucuuagccuuucuuccuuggcuuuccaaggccucaguaagaacacuuccagccccagcaaucacucacccaacaugcuacauucaaucacuaucagaaaccaccauccaaaccaucuauucucaucaugagguuaugggaaaauagaauuaaaguuacaaacgguuucaacauaaaacaugguuuuaacauacaguaaaaccucuacuucuaauagagacuuaugagcacuuugcauuaugaauuccuuuucugcuguauuauacucucuuaaaacugaaauuuguuuacuugaaauauuacuagaaaguucugaaauaugaaauauuuuuauucuggaguguuucuccuacauuucaauuacuauuuauagcuuuaacaaagauuuuaagcugcuagaucaaaauuucuaaguuaaaaaaauugauagagggauggagaaucaggguuuccuaccuguagcaacauugugcagaauuccaacagaugcagugugauaaauuauaucaucaccaucauuuaaauagugaacauuauuccuacagucucugccucgauaaccaaaaaugagcuccaacacaagguccuauaaugauaauaauaaaaccauuauauucuuccucauguauaaauguucaccacuguuuuguuguauacguaauacuaguagugucugcagucaaaauggaguaugcauuuuugauguuuuacaaacuuaauauacaaaauuaagcuacucauacuucuuuauauaaccuguuuugggcagcuuaaacauacauucuauacuuuucuauauaaaguuaugaaaaggaaaauggaaucacaagguagucugauuccaagaacuuuaguucuuaagauuucacauguaaacacugagguacaguuggccuuacauauccaagaauucaaccaauuccagauagaaaauauuggggaaaaaaacaauaaaaaauaacauuuaaaacacaauauuguauaacaaauauguauacagcauuuacacuguauuagguaucauaaguaaucuacagaugguuuaaaguaugcaggagaaugugcauagguuauaugcaaauuacuaugccauuuuauauaaggcacuugagcaccuguggauuuuggcauccccagggggaaucuaucccccauggacauagagggacuguauuuuuuguguccaaaagaagaaaauuuuauguucauuguuaaucaaaguaucugaccuacauacaagagucaggauaaauuauguccaagucacauacuucgaagaacucaaacaguacauucaucaucgguggauaaaaacuaaguauacugucucugacaauucaugcuaaaguucuggcagauaauucugcaacugaaaauguacauuucauugacuuuguaggacuagguuggggagggaacgacagcaaucaccaucgcacagcuuuacgccuuguuuacguuugauuuagcagaguuugguuguucgcuacugcuaccgggauuaugaaaugccuaaagagccuuccuucuuccucaauuauuacguaagguuacuuuggcuggaagcagagacagaaggagaaacaggcuucaugaacccuguacagugaauauaucgcacagggucaaaauuccuauuugguauaaguacuuacucuuuaauuuacaaauuuaagccacuaaauuuuagauacugccaaggugucugugcuucuauaagcaaaagaucauucacacauacuuagguuuaggacuccucugagauacaguucaauuaggguauuauucacagaaaaguaaaaggaagacuaauuuaaaaaauuaagagaaacagagaauauccauccaaaacucagacuuacauaagaauuaagucaaacaaaaaacaguacucaaauacacugauuuucaugaaaacuaaugacaaaacuuggguguuuuauaaaaaagaacucuggauacauuucaguaacacuggagagugaguuuuccuuaccucuauaggucucuuuuucuugccuacauuguuugucuggaguuucucuggcugugguggggcccugcucacuggaggccugcaacagagaaguggggaggaggaaaggcaugcagcacucagugccuucacugagccucucacaccaucccucccagagaggugucuugucacaccuucccaaagaugacccauucugugguccacuagacugcccucuucaucuugagagcuucuaaagcaggaagguagaaagaaaauauuacaacuuuuauucauuuuauuuuauuuuuuuugagacggagucucacucugucgcccaugcuggagugcaguggugcaaucuuggcucacugcaaccucugccuccuggauucaagcgauucuccugccucagccucccgaguagcugggauuacaggugugugccaccacaccagauaauuuuuguauuuuuuuaguagagacgggguuucaccauguuggccaggcuggucucgaucuccugaccucaggugaucggcccgccugggccucccagagugcugggauuacgggaucaggagugagccaccacacccagccuuuucucuucuuucuuucuuucuuuuuuagaccaaguuucacuuugucacccaggcuggagugccguggcacauucucgccucacugcaacuccaccucccggguucaagcaacucuugugccucagccuucccaguaacuggaacaacaagcgugcaccaccacacucagcuaauguguguauuuuuaguagagaugggguuucgccauguuggccaggcugguuuggaauuccuggccucaagugauccgccuaccucggccucccaaagugcugggauuagaggagugagccacugugcacagccuuacuuuuaauuucuuugguguacgugucauaauguaaauaacagcacaagaguagauuguuuauaaacaaaugugaaaauguuaauuuaacauacucaaauauuucuugauagguacauuaacaacaaagccuggauuacuguucuaaaguaucuaacagaguaucuucacauggcagguauugaauacauccuucuugaaagugaauuuucguaauauuucuaugaacguuccacacuguuagcaacauaaaucacauccgaguucaaauuuguauuuaucuguuucuccaugcccuucaccuucucuacuugcugaagucccuaguacugguuaauggcauugccaucagaugguuacucaaggaagacauuuuauagucacaaagcacuguaaaccauacaacacacuauaaaaggaaauaacuauuauuauugcuuccaacucuuucucuucccuuauucucacuauuuacuaaaaauguaucaacuuuaccuacacaguagcugucaaaucucaaaucuagccccucuucucuguucaggaucuauuuauaaugugccgugucccaacagguauauugaguucacauuuugaauuacuuaaauguagaagcucuucucuagaaccuuuaauuuuuuuaaaaaaugcaauuuaguuuauuauuuuuaucucaaccauuauucaaauacugaauaaccggaacauugaauuuaaaucaaucaugcaccaaucccuuuccaaauuuuaaguuaauauucaauuuguaacaccuaaaucaggaaauaauacaaauuaaccuucccauauaaaagacuccaacauuuaugaacaagucucauaaaauuaaaggcauaaaauauacuugcauuuucaaaaugguugucaaguuaaacaucaauaaaaguaaaugugcuauaucuuaaacauccaauaagaaaugaaugggauguugauacgcaauaugaggcagcauguaaaauauauaagcaugacuggugucauaaaaaguaaacauccuuuucaagaauauauaaacaauguuuucaaaccuucuucauauacuuuuuuggaugcccacaaguaaaaauaaaacugaauuuaucauauuuaacauuuaaaaauauuucugacaggaccauuucaaagaaugauagaagccuugcuuuuuuccccaagucaauuuuguuggugaauauuauucuauguuacugucugacagcuuuaaauguaacccaaacaauaaacagguaauuuuuaucuauauaauccuauauaacaauuaaccacauuuuaauuuuuauaaagaucauuuaagcauauuuuaauuuuuauaaauaucauuuauauaagguauaucauugcugaaaauaaaauuauacaacuuauaaaauuauacaaguugaauggauaaguuuuaguaaagcaguuacuuauacagaguaaguccaauaauuaagauguuauucauuucagugauaccaauuccaaaggaaaaaaaugugcaaaacugugaagagagguaaagaacacuaaguaacaguaucccauuaaugcuaaauauggaagaugacaaaaauacaaaguuaggcuuuguaaacacagcaaagagaggauuaccuggaaccucuuuucagcagcagauaaagagggaaaaagauuacaacauaaauuugaauugaaaacacuagugaaauaccuccuguaauaaaauauuuuaacaaguuuaaugcagacagcuauauugcauaauauuaaaggccuguuguuuuuaguuuauaaucccagcacuuugggagcccaaggcaggaggaucacgaggucaggaguucgagaccagccuggccaacauggugaaaucccgucucuacuaaaaauacaaaaaacauuagccaggcaugguggcacgcaccuguaaucccaucuacucaggaggcugaggcaggagaacugcuugaacccaggaaacggagguugcagugagccaagacugcaugcgccacugcacugcagccugggcgacagagcacgacuccaucucaaaaaaaagaaaaaaaagaaagaaaaaagaauaaagaaaaggcauaaggcugggcacaguggcucacaccuguaauccuagcacuuugagaggccaaagcaagaggauugcuugagccugggaguuugagaccagccugggcaacacugugagaccccaucucuauaaaaaacacaacaauuagccaggccuguggcaccuauagucccagcuacaugggagggugaugugggagaaucacuugaccuggaaggucaaggcugcagugagcugugaucacaucacugcacucagccuagguaacagagugagaccgucucaaaaaaaaaaaaaaaaaaaaaaaggguuacuccauuaauuaauaacagggaaucacaagaaaggugaaaaaagaaaaaaacaaauaaaugagaauucaauauauuucauguugugaacuuuaaagcuugccauucuuauuuuucugcaauauaaucugaauuuuaaacaaaacauuuaagcuuauuuuuguuuuuaagaaugggcacuggcacuaaaauguuaauuuaaaaagcugguagcacuggagauacuucaaaggaaauugucuaaagagccuaaguuccaccuguucugaccuaagaggguuccccagucagugaauccaagcaggcagaauuagucacucgggacuaugcugaauuuagaauuuugcuaguaaaaaaaguaaucuuuaaaaaguuuuuuuucucucuuaauagcauaaugaucaaaacaaaauuggaaggaaucaugaaagucauuucauccauuuucccacugagaccaggaaccuucuuuacaugucuagaacaaucauuguacagcuuugaugacaacuaaucaucuaaacucuguauaaauacugcuugugacaggucucuucuacauaaaaagccauucauauccaagauaacaaugauaucuccauuuaguuuucuuguuuugaaacaagauucccagaauaauaauuauuauauuuuuuugagacagggucuugcucugucacccaagcuagagugcaguggugugaucauggcuuacuugagcuuugaccucccacgcuccagacaucuuccugccacagcaucccacguagcugggaccacaggugcacaccaccacacccugcuaauuuuuaaaauuuuuuuuguagagacggugccucaucagauuggcuaggcugaucuuuaacuccuggccucaacugauccuucaaacuuaacaucccaaagugcugggauuacaggcauaaaccacugcacccggucaauuaacuauucuuuauaugaaguggccucccaaccucccuuccuccugugcuuucuucuagcccauuauaaacuauccaagucuccuuuaaaauguagagaucaguacugaguaagcuauucuagaugugaggcuagauccgggugcuuuauuucugguaaaauaguauaagauuuuauggcccauuuuagagguugcuucauacucugaacucauaucuuuguacacaccacucugcuuaaaacagaugauggauuccugcuguagauauaauauuaacaggugccuauuauuugaguuucugcaccaucuggucucaagucuacuguuuucauccuuaucucccagcauuuuccuagugauaccuuccucccgccaccccccacccccgaaacagggucuugcuguguugcccaagcuggaguguagugaugccaucacagcucacugcagccucaaacucccaggcucaagagacccucucaccucagccuccugaguagcugggaccacagggcugccaccacacccagcuaauuuauuuuuacuuuuauuuuuuguagagacagggucucaucauguugucuaggcuggucuugaacucccaggcucuagcaauccucucacuucggccuucccaagugcugagauuacaggccugagccacaauuacaggccugagccaccgugcccagccaugauaccuuuuuuaauuuauaaaacagacuagccauuuccacacugucguuucagaaacucuuucaagacauuuucacaucaccaaagguagauauaaaaguaacccaaagagucuuuaccuacaugucauuuuauuaaacauacaaauaccauaguuacccucuuuucaucuuuuuaaaugaauggauuaaacaugcauuaaaucauguuaacagguuuaaaauugaauagucuuucacuuaaauauaugugugguuagguuuguuuuuacgagccucugaaacuuaaagaaaaccaaaacuauucauuugcauuguaguaguuuguacagucauauguaaaacaauuuaucauaaugaagacccuuauaauaacaaccauauaugcuaucuaaaaaugcaacucuuuuauagaauuuguccuacuucauuuuauaaugcuuuguugacaaauguaguuaaauguuuuauagggaaaaaauaccuuaaaauaccauaaagaauaaaauaaaggguaaauuuuugaauaaaauauuuucuuuuauaaaacacuuaccuuacuacucccugccuucaaaaggagcaagggggaaaaaaguaggaaaacauauaaaaauugaugaugaauagaauacagcauuuuagcaaacagaagaaaggcaacaugucaacagaauuuuaaggaaauacaaaaaugucuaacuuaugucacauugguuuaaacauugauuuaaauauuuuuauucacaaauacuggaaauuugacaaaaauuaacuacuuuaaauacauaauauuuguuauaaaaacauuuauuggcugggcaagguggcucaugccuguaaucccagcacuucgggaggcugaggugggugaaucacuugaggucaggaguucgagaccagccuagccaacauggugaaaccccgucucuacuaaaaauaacaaaaaauaacugggcgugguggugccugccuguaaucccaguuacucaggaggcugaggcaggagaaucauuugaacccaggaguuggagguuguagugagccaaaaucgugccacugcacuccagccugggcgacacagcaagacucugucucaaaagaacaaaacaaaacaaaaaaauaaaaacaaaaacauuuauuaaaaaagaaaaagguaaaauuaucacuuaggaaaaacauccacgaaaguaucaaccaaauagaaugguuauugucaucagaagcauuuuuccuuuuaaguggauauuugauaaguauuuaauuguuuuuaauuuuuuuuucauuuauuuauucucccagagacaggaucccacucugcugccauagcuggagugcaagggugcgaucauagcucacugcagccuccaacuccugggcugaagcaauccuccugcucagccuccugaguaggaaccuccugguacaggcauguacuaccauucuuggcuaauuuuucuauuuuuuguagaaauggggucuugcuguguuacccaggcuggugcuaaacaccuagucucaagcaguccucccacuucagccucccaaagcacugagauugcaggcaugaggcacagcaccuggccuguuuuccauauaaagugcuuuauuucauauuuaugacaguaauauauguuacuaaaaagcaauuauuuaaauaaaccaugaaccauauuaucuccucacaaauauucuaaguugguaaaagagauaugaaccucuucauuuguaaucuccuuugauuuuuuuucauuuugugaaaaugaaaucacauugaugacuucugccuugucauuuucuuuuuuuuuuuuuuuuuuuuuuuaaggcaaagaguagagcuuggacucugccacgggggccaacagacccucucucucccuccccacaccuugucauuuucaaaauauuuagcaggguugaaauuguaaaguaaauugagaacaaaaugcaaagcaauuugaaaaauuacuuugaaaaaguuagcugcagaauauacaagcuaacaucaaagauuucaguuaugacaguguuaaucauucuucaugaguaguaaaauauuuccaucugucagaacaugccucacuucagcaauggguggaaauuuacauuuaaguguuuuaccgugaaugaagcagacuacagauuaaaauuaggucacauuuucugacauaccaaauuuauccaauaaauaauuuuuuuaaaaaaucaauauaacaaaugaaagaaauuuaugggaaugucuagagccccuucuuccccauagaacacuuuucacuuuucauuacuuaggagacauaauuuuccuuaagucauauuaaacacuacacuucaaauauucuaauuagaauauuuaaauaauauuauauuuucauauuuaucuguauuuaucuaauaaauacauauguagcgcuuauugcuuugugaauauuuaauuucagaaauaauguuuaaguauuuaccagguaucuccucaguuaacuuucauuucauuccaagggauaaggugucauuaaugaagaccuacuaucuaaauucuugauuuacauuauuucauuuaaaacuugaaauauaccauaaguuagggauuauaauguucauuuugccacugaggaaacugagguucagaaagaaugaauaauuuuucaaacucacacaacugguaaugaaaaaaaugaguauuuuacccauuugucugacuccagaauucauguccuuugcacuauacgaugcugcauucuagcaaguuacuugaaacauggaauucuguacaaguacuuagauuaugguauacugugcuuucuuaaaaauaucccuaauuuaauacuuugccucuuuauacauaaugaaaaacuggaugaucacucuccauccccuuuccuuaggugaccucccauugcuaugaucugagguacaugagguauaccaucagcaaacgacaccuggaaaaggagcugaggaggcacugcgcccuuaacacuccaucuagacuucccuggcaacgcgggggucagucaauuuacaagaucucucaguucucccuuccccauuacuaacguguuuuucaccuuaacuucaucccuuuccccgaauauaaaauccauaggugcaaacucaaaucccucugacgaagcuuuccuguagucauuucuaucucucugaguuccaaaauucuucagcacuauccuaaauggccacaaauucgcuugaauuuucuacaaauccuguucaacugugaaugaauucccuuuuaauuucucccucaaauuguccacuaacuucucauaauaaaguuuuccucaccacaaccuuguucucaccucccacucccucuguuccuucuuacuguuucuggaucuuuuccuuuuuuguucuuuaaaccucuuugcuucugaaguccaugccauucaaugcuccauaucccuuuuuauuguuuaccaccuuugauuuugaaacacuaguuucacaauuuauuucuuaaucugucaucuagcucagagacuuuauuaaaaagugaucucuaaauuacuuugggcaguauggccauuuucacgauauugauuuuuuccuauccaugagcauggaauguuuuuccauuuguuuguguccucuccuauuuccuugagcagugguuuguaccucucuuugaagagguccuucacaucccuuguaaguuguauuccuagguauuuuauucucuguguagcaguugugaaugggaguucacucaugauuuggcuguuugucuauuauugguguagaggaaugcuugugauuuuugcacauuuaucuuguauccugagacuuugcugaacuugcuuaucagcuuaagaagauuuugggcugagacaauagaguuuucuaaauauaaaaucaugucaucugcaaacagagacaauuugacuuccucuuuuccuauuugaauaccauuuauuucuuucucuugccuaauugcccuggccagaacuuccaacaauauguugaaucaaaguagugagagacagcauccuugucuugugccgguuuucaaagggaaugcucccaguuuuugcccauugaguaugauauuggcuguggguuugucauaaauagcucuuauuacuuugagauauguuccaucaaaaccuaguuuauugagaguuuuuagcaugaaggggugcugaauuuuaucgaaggccuuuucugcaucuauugagauaaucaugugguuuuugucauugguucuguucaugugauggauuacauuuauugauuuugguauguugaaugagcuuugcaucccagggaugaagccgacuugauugugguggauaagcuuuuugaugugcugcuggauuuaguuugccaguauuuuacugaggacuuucacaucgauguuuaccaggcauauuggccugaaauuuucuuuuuuuguugugucucugccagguuuugguaucaagaugaugcagaccucauaaaaugaguuagggaggagucucucuuuuucuauuguuuggaauagccagaagaaugguaccagcuccucuuuguacuucugguagaauucggaugcgaauccaucugggcuuuuuuuugguugguaggcuauuaauuacugccucaauuccagacuuuguuauuggucuauucagggauuccacuucugguuuagucuugggaggguguauguguccaggaauuuauccacuucuagauuuucuaguuuauuugcguagaggucuuuauagcauucucugaugguaguuuguauuucugugcaaucaguggugauauccucuuuaacauuuuuuauugugucuuuuugauuuuucucucuuuucuucuuuauuagucuggcuagcagucuaucuauuuugucaaucuuuucaaaaaaccagcuccuggauucacugauuuuuugaaggguuuuuugugucucucucuccuucaguugugcucugaucuuuauuucuugucuucuacuagcuuuugaauuuguuugcucuugcuucucuaguucuuuuaauugugauguuaggauguugauuuuagaucuuucccacuuucuccugugggcauuuagugcuauacauuucccucuaaagacugcuuuagcugugucccagagauucugguaugcuguauucuuuguucucauugguuucaaagaacuuauuuauuucugccuuaauucuguuauuuacccaguaguaauucaggagcagguuguucaguuuccauguaguuguaugguucagagugagucucuccauccucaguuccaauucaauugcacuaugguuugagagacuguuuguuaugauuucuguucuuuugcauuugcugaggaguguuuuacuuccaauuauguggucaaauuuagaauaaaugugauguggugcugagaagaauguauauucuguugauuugggguggacaguucuguagaugucuauuagguccguuuguccagagcugaguucaacuccugauuauccuuguuaauuuucugucucguugaucuaauauugacagugggguguuaaagucucccacuauuuuugugugggagucuaagucucuuuguaggucucuaagaacuugguuuaugaaucugggugcuccuguauugggugcauauauauuuaggaaaguuaggucuucuuguugcauugaucccuuuaccauuauguaaugcccuucuuugucuuuuuugaucuuuguugguuuaaaguagauucaaugcuauccccaucaagcuaccaaugacuuuccucacagaauugaacuacuguaaauuucauaugaaacuaaaaaaagagcccauauagccaagacaauccuaaguaaaaagaacaaagcuggaggcaucaugcuagcugacuucaaacuauacuacaaugcuacaguaaccaaaacagcaugguacugguaccaaaacagauauauagaccaauggaacagaacagaggccucaggaauaaugccacauaucuacaacaaucugaucuuugacaaaccugguaaaaacaagcaaugagaaaggauucccucuuuaauaaaugguguuggggaaacuagcuacccguauguagaaaacugaaacuggaccccuuccuuauaccuuauacaaaaauuaacucaaggugaauuaaagacuuaaacauaagaccuaaaaccauaaaaacccuaaaagaaaaccuagcuaauaccauucaggacuuggcaugggcaaacacuucaugacuaaaacacugacagcaauugcaacaaaagcaaaaauugacaaaugggaucuaauuaaacuaaagagcuucugcacagcaagagaaaccaucaucagagugaauaggcaaccuacagaaugggagaaaauuuuugcaaucuauccaucugacaaagggcuaauauccagaaucuacaaagaauuuaaacaaauuuacaagaaagaaacaaccccaucaaaaagcuaaggauaugaacagacacuucucaaaagaagauauuuauguggccaaaaaacaugaaaaaaagcucaucaucacuggucauuagagaaaugcaaaucgaaaccacaaugagauaccaucucacaucaguuagaauggugaucauuaaaaagucaggaaacaacagaugcuggagaagauguggagaaacagcaaugcuuuuacacuguuggugggaguguaaauuaguucaaccauuguggaagacaguguggcaauuccucaaggaucuagaacuagaaauaccauuugacucaggaaucccauuacuggguauauacccaaaggauuauaaaucauucuacuauaaagacacaugcacauguauauuuauuacagcacuguucacaauagcaaagacuuggaaccaacucaaauguccaucaauaauagacuggauaaagaaaauguggcacauaaacaccacggaauacuaugcagccauaaaaaaggaugaguucauguccuuugcagggacauggaugaagcuggaaaccaucauucucagcaaacuaacacaggaacagaaaaccaaacaccacauguucucacucauaagugggaguugaacaaugagaacauauggacacagggaggggaauaucacacacuggggccugucagggaguggggagcuaggggagggauagcauuagaagaaauaccuaauguagaugaugggcugauggaugcagcaaaccaccauggcacauguauaccuauguaacaaaccugcacguucugcacauguaucccagaacuuaaaguauaauuaaaaaaaagugaucucuccucauaaaauggccuugcauauguccuuacuuuuuuauuugcugauucuagacuaagaccaauaauucccauuaaagacaaccugccuuuuuagaaaauuuuugaaaugaggacugacuaugcuuaaagaaaggcacauggauaggcaggccuuuucaaaauugaaucacaauacugcucacauacuucuuaaaaaguacucgguauuggauucaauuuuuauuaucuccuccaaccucaucacacacauuuauaaaaguuagcaaauaagaugaaucauaucaaccuuauaaacauguauaaaucccuaaaccaauaguguuaacacauaguguuaccaucaauaggguuuuguuuuuguggguauuuuuuuuugagacagggccucauucugacacucagguaggagugcaguggcaccaaucauaacucacugcaaucucaacuuccugggcucaagcaaugcuccugccucagccuuugaaguagcuggggcuacaaacacacaccacuaaaccuggauuauuuuuauauuuccauagagacaaggucucacuacaucacccaggcugauaccaaaagguauuuaaagacagacauacuuucuaagaggugcugugaauugucuauagcaagaauaucacuguuacuuaguuuguguaaaaaagccacuuaaauaauaaauuccauuuuuaaugacaauaucuuuuucuucaucuaauacuaaacuaaauuauuaccuuucaucaauugaggguucuuuuuguuguaaaugaggcuugauuccuaacauugggcgaauauuuguugauaaggcucugaugguguaacugauuucauucucccuuguaacaucacugucauagccuacaauaaaaauauacgaguaauucuuuaagcaauaacugagaucaauuaugaucuuauaaauuggauacaaagauguucaacaauaugaaauaaauuaaguuguuauaagcaaauuaugaaguaauauacaaccagaaaaaacgauguagaagaauauuuaauuauauguaaugauguuuucaaaguauuacuaaguaauaauagcagguuaaaaaauaaguucaauaugaccauacuuuucuuaaaaaaauauuagcuacauacaucuuaggauauaccccaaauauuagaagagguguuaccucuguguggucaaauuauggaggcuguguuuaauuuuuauggcaaaauacauuuucuauaacgagcugauauuacugguauauuagaagaaaaucaaaauuauuuuaaaauaugagguuuaauaauauaaaauuuaccuuaacaguacuuauuuaaaauucagauauuuuucauuuguagauaaauaauaucaaagucauaaauucauggcaaccuguuguucuugagucacaaaauggauuuugauguuaaacagacuaaaaacaguaccacuacaauuauucaaacauuauuauuacuugcuuuaacuuccacagcuuaaacaaguugugcuaaauuuucccuauauuuuuguucaaguauuauaaaaugacguacccccaucuucuucagaaucaaugucggauucuucacuaucacaaggccuuuuuucucgauagccuuccaucucauuuguccacaccauuaaagacauaucuguaccgccuaggguaaccaacaugcugucaucauaaguccagcgaacauuugugacauguguacuaugggccacauaccucuuaaacuuuccaaauuuccccuaaagaggaagaaaauucaaacaaucuuucugagaaauuucauuauuuaaauauuuccauuaugauuuugaauuuuauuaauaauuaaaaauuaaucauuucaagugcaauguguuaaaaaaaaugagaaaauacugaaacucagcagaauaaaagauaccaauuccuaaaccuguuaaggacaagaucuaaaaccaguaguuucacaaaaugcugguaccccaggcaaaacucuuuaaaaaaccaacuugguauucugcauuaaaagcauaaaaauguucuuguauuugacucacccaucucccuuuuagggaucuaugcuaagaaaugcuaucuguguaaaaaaauacuuaccaugguauuuacuuauaguagugaaaaaaauuaaauaccuuaaauguucaaaguaauaguuaauuacaauguauauggaauaguguauauauauuaaagacaaugguuaugcagauguacuguuggaaauagauacaauaauugagaaaggauacacaugccuauguacagcaugaguauguuaacaaaaaguaacuaucgauugauugcuuugguacacauauauuuauauacccauguaaauaucuuucaucucaauucauuagugcuuuuuuuuguaagcaauacacauagaaauguauuuuccuuuuaaauaacaauaaaguuuaaguuauuguuauuaugguauuagcauuaccaaguuacauaaauuucagaucaaagcaucauaaagcagguuuuccguuaacaucuuuucaaagguguuaaaaugagagaugucuuauacaaaacacagugauagcaaaauuugugaauucccuaggaaugacgacucucuuuuuuuuuuuugauacuggaaugcaguggcacgaucuuggcccacuguaaccuccgccuccugguucaagcgauucuucuaccucagccucccaaguagcugggaauacagggacccgccaccgugcccagcuaauuuuuucuguuuuuaauagagacgggguuucaccauguugacuaggcuggucucgaacuccugaccucaggugauccaccugccucggccucccaaagugcugggauuauaggcguaagccacugcgcccagcaggaaugaugacucuuaauaauuaagucagggugagggaucugucaucaaagcauggcaagaagguaguuucucuaagacugugugguucuugcuacacuaaggugaaaacauaaucugcagaucaauauuccagaaccuauuccuaagggaucuacaccaucuggaacgcuggaagugaaguuucuggcaaauauuuuaguggaacacauuguuaacaacuaagacucuaccauuuacauguaucuaaaacaggaaucaguggaauauuuucuugggugucugaguuuucaaugagaauuuuuaaaccuguguuuucauuucaaugcugaucuaaaaauauuaauaugagcaguuacucaagaucaccaggaacugaauaccacaauaucauuucagugccauauuucaaauuuaucuuuauguucauguuggugccagaguauaauauauaacuuaauuugugaauuaagaaauaaaugcugccagauaacagugacucgcgccuguaaucccaccacuuuaggaugccgaggcaggaggaucaccuggguucaggaguuugagaccagcauaggcaacaucuggagaccccaucucuacaaaaaaaaauuuuuuuuuacauuagccaggcaugguggcaugugccuguggucccaguuacucaagaggcugaggugggaggauaacuugggucuggaaggucgaugcugcagugagccaugauugcgccauugcauuccagccugggucacagagagagacgcugucuuaaaaaaaaaaaaaaaagaaaggaaugcauuguaucuggacuugauauauaaauuuuauuuccguguuaaggaaaagccuaauauuuuacaguaguuugaacagagggaagugauaaaagaauuaaguacuugcacagcacacauuagcauagguacguagaaugccaaagaaucuguuggcgaggcccaguggcucacgccuguaauccuaguacuuugggaggucgaagugggcggaucacaaggucaggaguuugagaccagccugaccaacaugguaaaacccuaucucuacuaaaaauacaaaaaaauuagcugggcaugguggugcgcgccuguaaucccagcuacucagggggcugaggcaggagaauagcuugaacccgggagguggagguugcagugagccuagaucaugccacugcacuccagccuggcgacagagugagacuccaucucagggaaaaaaaaagaaaaaagaaaaaaaaaacuuaauauacauaagcaggaaguaaauaccaauuuuaagcagaaaaucaucaacaaaugaugcugaugauuuaaaaugcacauauauucugcuacgaaagcagaaaaaaagaauuuguaugauuugguuucaaaaaaagucauucauuacauuaaaucaauggugcuuaauuuuauaaguguaaguauuuucuauuuaauugguuaaaacaacuucaaguuugaagcuguaacuauaaagaguuuauauuuauuguuaauaguauauauuuaauuaaaaauugaaaaauuauugaaguuaauauuggggauaaaaggaaugugucucucucucugacacaggguuuugcgcugucacccagacuggugugcaaugacaugaccacagcucacuguagccuccaacuccugggcucaagcaaucuucccaccucagccuccugaguagcuaggacuacaggcaugugccacaaugccuggcuaauuuuuuucucuguuuuguagagaggaagucuugcuaugcugcccaggcuggccugaaacgccuggccucaagugauccucccaccucaggcucccaaaguacuauacugggauuauaggcaugagccacuguccccagccaagauguuucuuguaaaagggauauucauauuagucaauauugaaaaacacuauaggauaugauauauaacuuaauguaugggauuauaaauuacaauacuuaaaagcuauagauaugaaacauaauucugaaccuuucauauuacaacauuacauauuacauauguacaauuaauaacaaugaagugcuaugacaggacauuaccuuaaccauuucauaauugaugaucauuaggaaaguuaaagaaaaacacauacuuuaguaggauaucuaaauaacuucacaaaucccaaaucguccccgguagcuagaaccauuuugucacuggugaggcaagaagcaguuacaucuguaacuucuccaauuacuggccaaauuccuucacagcauaaaccaaguacacuuguccaugaugcccaagcaauuuuuucuaccuaaaaaugaaaaacaaugcuguaaguuuggauuauccaaaccuaaaguauuaacaaccaaaauguaaacauuuuucuuuguaguuaugugugucacaaguaaaaugaaaguuuuaaugaaaaaauaguuaaauuauuaguugucuugguuuuguaacuccccagagccuacuaauugcugcagaaaaauuuuaacauaguauuauucagaauauaauuauauauccacuguguguucuagaugcuaagcauacaguguuaauaauaaaaccguuucugacuuuaggauaaucaaguaagauucuuacaguucauguuuaaauuucuaauaaugcauuauguuuuccaacuaacccuuacuagaaauuuagaacuuuuacuuauggucucucccuucauuaagacacuuucauguuaaauuuguuaagccucucuuccuaggccaagauaaaaaauaaaaaaaaaaaggcuaauauugucaggcacaaaaugcaacacaauuuuucuuguuuuuuuuuuuuuuuuuuuuuuuuuuuaaagaagcaaaaacaguaaucugccaacaaacuucuuaggcauauggauuccuaaggacguggcagauaugcaauacuccaaucuuagauggcaugucuucuauuugcuauuucacgcuucuugucuuuuaaggaaagcaacuggagcacagcuagccgugcaagugauuuauuccuuuuuuuuuuuuuuuuuuaauacagggucucacuuugucacccaggcuggaguguaguggcaugaacauggcucacugcagccuccgccuccuagguucaagcaauccucccaccucagccucccaaguaacugggacuauaggcacaugccaccaugcccagcuaauuuuuuguauuuuuuuguagagaugggguuucagcauguuauccagucuggucuugaacuccugagcacaagcaaucugccugccucugcuuccaaaguguugggauuacaggcgugagccaccaugcccacugacuccuuuuauuaauauaguguuucuuccuucacccauguauucugacucaauaaacucaauaauauccaauauuuuaauaauuugagaacagacuucacguguaacuaaacgauagaaaguagguaucaguuuucuagccacuuuuauucacaugaacaacacugcaagcaccacuguuguccuaccuccacgcuggggaugguuuguuuuuucccucugggagcuucaaagaauaauuguuccuuagcaccaguguugaccuguaaaagcuuuccuucaaaaaaauuuuuaaaaauauuuacacauauaaaauacauacaaauauauauaccaucaguaugauguuuaaguuuuaugggaaaaaaucagcuuaaauauaaaaaccauuuucugcugcagucaacuuauaguaagaacauuuuauuuuuauaauuccauauuacuaaguaacuaaauucauaagugguuugauuuuuguauauguauauacauaaaaaugauuucuuugguuaugcauauguaaaaaauuccuagaaacaaauguuaaaauauuuuuuaaaguguaucuguuuaacuauauuuagaaaaacuuuaugaugcucaauuuauauaguugaauacaauauaguugaauacaugaaacaauaacauccuuaaaaagagaggauuuaaaauacuuaacauuuaucaaacauauuaaacucagucauaugccaugcauucugcuaaaauacaaacauacucauuaaguucuuuauguuauaugauuaugacucuuuuugaagauauauuucauaucaaacaaugagaaaaaugacuuuaaaaucuucauuaacauuucuuuuuaaaaauguauuucauuuuuuuuuuuuaggaauggggucucacuguguugcccaggcuggucucaaacuccugggcucaagcaguccuccagccuuggccucccaaaguacugagauuacaggcaugagccaccauaccuggccaacauuucuauauucuauuuaugucaaauuuauaugacaaagaucaagacaucuucacaacaauuuuuuugcacaauauuuaaaucacuuuacaaauuaaacaacuaaucacuuacuguacuauuauuugaacgauauuaggugaaguauugaaaaguguagguugggugcaguggcucaugccuauaaucacagcacuuugggaugccaaggugggaggacugcuugaguccaggaguucgggaccagccugggcaauauagugagaaccugucuguacaaaacauuuaaaaauuagccaggcaugguggugcaugccuguagucccagcacucaggaggcugaguugggaggaugacuuaagcccaggagguuaagguuguagugaacugugauuguaccacagcauuccagccugggugacagagugagaccugucucaaaaaaaaaaaaaaagaaaagaaaaaggaaaaagaaaagucucaacucuauaguauucaucuucagauguaaaauaguaaaaaauaauuuugagaauaaugguuguuuuucccaauucuuuuuaacucaucuguugaaucacuuuuccguuucucuaauauagcuauacuaaaucaaaugaaacuuuuaucaaguauuaaguuauuuaaagucuuaccucuaauaucccaaucaauauggguuauguaacugguagcuccuuugcauauuccuacucguuuacuacucauuacauuguauauaucuauaaagcugucaugggaugcuacagcaagauauuucccagaaccuauaauagaaacauauuugcuugacauuuucuaucuuuggaaauacuuuuuuacacucugcaacuagaguuaauuuuccuuuucuuuauggagaaaucuuagcuguuucauaaauuauaauaaaacagauguguuaaauaacaaaugauaacauuuuucaaguauauuauacuuaacaaaauaauuuuuuaguguaacaaauuaguucagugggaagcaaaugucaaaagcuauguaugauguaguuuugauacuuuguauuuaacaaaacucccucuaaauuuagaaaaaaauggaacuaaaccaacauaaguaaauuuugccuuaacauuaguaauugcuacauuacaguagguuuguaguagauaaugaauacauggaaauuaauggaguaaaaugagugcaauuucaaaagcauuaagaauauaacgaaaacaguuauccaaccccuuuuauaucacaaaugaggaaacaaaagcucagagaagcauccuggcucaagucacacagaaaauuuaguaacagaauuggcgcuaagacagauauuugcaccaaucuaacaacagggcuuuuaccucuugcuacacugccucuucuaguaaaaaaguuaaguucugagauaacauaacaguuaauaaaaauuauacauugauacauuuauacacugccagacccaaguuaauacucaaauacaauuucaauggaucuuaccaggugaaaaucgaauaucugaaaucauaucuuuucugugaugaaaagacacaagauccucuagaguauccgcauuugccauuaagaagcuuccaucguugagaccuacggcuaaagcuuuaccaucaggagaaaaacagcaacaccucccaccugaaagagaaagagcauauuaggcaauuuucccuuuuuucuaauuuaaaguaugggccaggugugguggcucaugccuauaauccaagcacucuggggagcugaggcaggaggacugcccgcggccaggagguuaagaccagcccgggcaacauagcaagaccccaucucugccaguaggcagaguaggggaaggggcaaggggcaaaggagaaggggcgagggggaagagagaagagggaagggaagacagguaaguaaguaaauaaauagacaggcaugguggcacacaccuguagucccauuuacuuaggaagcugaggcgggaggacuguuugagcccaggagguugagggugcagugagcuaugauugcaccacugcacuccagccuggguuacagagugagaccuugccucaaaaaaaaaaaaaauauuugcuaaaaagguugccucuuuauuauggcuucaaaucaauauuaaaaaggagucgagauacagauuaaguuuucuauagaagucaaugguauggaauucuaagcaggaaugaaacucacuucugaauacaacaaaagcaaguauggauauuuaccuuaaaagaaauuaaguugaugaaaaagaaugagagauuuuaauuaacauaaaaagccaaugauauauguggaaguuuugcagaguagguuuuaccuuuguagcuucuuuccaaaaaaacagaaauuuaagaaauaagucaucuuuauaaaaguaauuuuuuuugagauggaauuucucucuuguugcccaggguggagugcaauggcaugaucucagcucacugcaaccuccgccuccuggguucaagugauucuccugccucaggcucccaaguagcugggauuacaggcaugugccaccaggccuggcuacuuuuguauuuuuaguagagaugggguuucaccauguuggucaggcugguccugaacuccugaccucaggugaaccaccugccucagacucucaaagugcugggauuacaggcaugagccacagcaccuggccuaugaaacuaaaauauuuuuaaaaaucuaauaggccauuauuaaagguaggaagauacaucuguauauauacguuucagaaccauauaugaaaugauauuuuuauuauuaaugauaaauuaauaucguucauuaaugucauuaaugauguuaacauucguaaaaauaaggguuagugcugcauugauaaacacaaaaaagggcuuacccuaacagcaaggguugcagcaaacauauucaaaagcccuaaggauuuugguaucuuguaugaaaucugaugaggaaaggacaggguauauacagaaugaaaaguuauagcauaaguugagaacaaguagucauuuaauuaucaagcauacauuggaaaugaagaaaucuaagaugugauuucucagauuugagagucaagagaugaugaugaccuggagcuggguggcagcaguggaggugauaagaggaaggauuuggauauauuucaaagauagagcuggcagaacuuugaccaacuggauguggggugaaaggcgucaagggcaugguuuugcuugaguggugaugccauuuacugagaugggauaaacuagaggaggaaccaccagugcuuaguucuguacaaauuaaguuaaagaugccuaugagaaguucaagugaagacaugaaggagacaauuuaauauaugaauccuuuucaggagcugcauauaauguuuguuauauguauaucuuuauuuguguauauuaacuauuugacuuuucucuccuuuuucuccuucauauuuuauacaaguuuguuggagguuaacuuuacaauuuuguguuaaaagaauauuccuuguguuaaaagaauauaagaccgugacuaaauuugagaauagcguaggucuucucucuuuaggggugagaacuacuucacuuguaccaaggguagcugcaucucuuuggguagaaacauaagguuaguucugugauuguacugaaguucaaauguguguauaaagguucauguggauccugacuagccagaggggaagacugugcugguuauuaauuuauugccucucaguuccaaaucugccacuuugggccucacagacuuuuuugcuagcuugccaguagagggagcuggagagacacuacaaggccaaaacagaagugacucccuuccuccagugugcuguuuuacuaacagagcccgggcacuggcaugaagggggccugauggcauucaccagaguggcagccccaacugccucuuucagcaaguuucuccaccaucacuguaauggcucuaacaauuuagcugcaauuugcggacuucaggaagauucucuggcaggaguccucacaguucaaugauuuugcccuagguuaagcucuucaagcagugguucugaccauucagcucuggccugcugccucuggcaagcuucuccuucaccaagugacuacucucacuguuccacugagggcugcacccucuggcaagcuuuuucgccacaagcucacugaauguucugguggcagccacaccauuuccaaacaggucugaaucaccuuuaacuuguucacucucccuuaguacuaggguugcugcuuucuaugguggcuaccucuaaggcuuuuucaguagguaaucacuuuuugcuaguuagcaauucuuuuuauuaaauucccacuguucaaauaagccuuguagucucaucuucugacuggacagugaccgacugaaucuaaagugugaguguacauaugaaaagaaaaguccggggagaagcgcuggagcaguccuaaaugcagagugcaggaagaagagauagcacuagcaaaggaaacagaaaaagggagucagugaaguagagagaagaaacagacacgcacggguuccagagacaagugaauaaaguauuucagaaaaaaaaaagggaaugauaaauugugucacaaacugcugugaggugaauacacugagaaccaggaagugaucaacagauuggcagcagguuaaauggacaaguagggaaaaaagccuaauuggaguggguuauggagcuacugucaugugaacacacagagaagggcgccucaacuauuuugaggaguucugcuacaaaagagggaagagaaacagaauaguagugaggucaauuaucacaguucccuguuuuacucaaugcuuauucugcugguugggugcaggcauaaagcagguagaaaguugaguuuaagggaagauuaauauaguaaguauccuuuaaaauucauagcugagaucauugaaaaauuagaaacauuuucuaguuaucaaaauuaaaaggggagcagaaacccagagcaaaaaagccacauuuggaaggggaggggccaagaaagccaacuagaaacagcuguggucagaggcucccaccaagaagaccgaaaacggcaagugaauccugcaccagcaacugagguauccagguucucucauugggacugacaaggugguuggcaugacccauggagagugaggaaaagcaggguggagugacagcccaccugggagcugcacaggacaaggggagcuccuacucccagccaagagaggcagugagugauugugcuauccugcccgggaaaccacacuuuuuccauggaucugugcaacugguggaucaggagauccccuccgugagcccaugccaccaguuccuugagucccaagcauagagcugcacagauucucaguggccacuuagcuacagacugccgaagacuaccaaguuccugggggaagggacggcugucaucacuuuggcugucugcugccucagaugacugagcucccugggcgaggggcagcagacaucacugcagcuccagucugccauuucuccucugauggugccugggaaaauagacaguuuagacccaggaggaauucaccacagugcagcacagaggcuguggcagaugguggccagacugccucuuuaggucggacccugaccauaaccccucacugugcggggccucccugcaggaauuucagcaacuccagccagagguuuguggacagaacucugaucucccagggacugagcuccuagaggggaggggcauccguggucuccauggaucagcagacuuagucuuucccucuaccagcucugaggaaucugggcagucaggacaagugggauuucccccaguguaaugcacccccucugccaagggguagucagagugcuucauuaaguggguccuggauccuguaccuccugacugggugagaccaccccaacagggguugcuagacaccuuauacaggggcguuuccacugguaucaguucagugacccucugggacagagaucccagggaaaggagcaggcagcuaccuuuacuguuuugcagccuccacuggugauaccucgaggugugggagggacccaggcaaagaaggucuggaguggaccuccagcaaaccucagcuggaagaggaagaggggucugacuguuaaaagaaaaacaggccaggcauaguggcucaugccuguaaucccagcacuuuugggaggccgaggcagguggaucauguggucagggguucaagaccagccugaccaagauggugaaaccccaucucuacuaaaaaaaaaacaaaaaaaauuagcugggugugguagcaggugccuguaaucccagcuacuugggaggcugaggcagagaauugcuugaacccaggaaguggagguugcagugggccaagaucaugccacugcacuccagccugggugauagagcaggacuccaucucaaaaaaaaaaaaaaaaaggagaaaaaagaaaaacaaacaccaacaacaaaagcaucaacaaaaaaagucccugcaaaaaccccauccaaaguucagcagccucaaagacugaagcuagauaaacucacaaagaugagacagaaucaaagaaaaaaaaugcugcaaacucaaaaagccagagugccucuucuccuccaaauuaacacaacaccucuccagcaagggcacagaacugggcaaaggcugagauggaugaauugacagaaguaggcuucagaagguggguaauaaugaauuuugcugagcuaaaggaacaaguucuaacccaaugcaaagaagcuaagagccaugauaaaacauuacaggagcuguuaaccagaauaaccaguuuagagaagaacacaaaugaccugaaggagcugaaaaacacaaccaagaauguuacaaugcaaccacaaguaucaauaacugaauagaccaagcacagggaagaauuucagagcuugaagacuaucuugcugaaauaagauacacuacaagauuagagaaaaaaaaaaaggaugaaaaggaaugagcaaaaccucugagaacuaugggauuauguagaaagacugaaccuaugacugacugggguaccugaacagaacaaaguuguaaaacguacuucaggauaucauccaggagaacuuccccaaccuaacaagacaggccaaaauucaaauucaggcaauccagagaaccccaguaagauacuccaugagaagaucaaccccaugauacauaaucaucagauucuccaaggucaaaaugaaggaaaaaaauguuaagggcagucagagauaaagucaggucaccuacaaaggggagcccaucagacuaacagcagaccucucagcagaagcccuacaagucaggagacacuaggggccaauauucaacauucuuaaagaauuuccaacucagaauuucauauccagccaaacuaagccucauaagugaaggagaaauaaacuccuuuuuagacaagcaaaugcugagggaauuggucaccaccaggccugccuugcaagagcucccgaaggaagcacuaaauauggaaaggaaaaaguguuaccagccacugcaaaaacacacugaaguacgaaaaucaaugauacuacgaagcaacuacauuaagugugcaacauaaccagcuagcaucacgaugacaggaucaaauucacacauaacaauauuaaccuuaaauguaaauuggcuaaaugccccaaauuaaaagacagagaauggcaugcugauaaagagucacaacccacuggugugcuauauucaagagaucuaucucauguguaaagacacauacaggcucaaaauaaagggauggaggaaaauuuaccaagcaaauggaaagcaggaaaaagcagggagugcaauccuaguuucuaacaaaacagauuuuaaaccaaaaaagaucaaaaaagacaaagaugggcauuguauaauggaaaugggaucaauucaacaaguaaagcuaacuauccuaaauauacaugcacccaguucaggagcacccagauucauaaaacaaguucuuagagaccuacgaagagacaacuuaaacucccacauaauaauagugggagacuuuaacacccuacugucaacauuagaucauaaagacagaaaauuaacaaagauauucaggacuugaacucagcuccggaucaagcggaccugauagauaucuacagaacucuccaaccaaaaacaauagaauauacuuucuucuuggcaccacauagcacguacccuaaaaucgaucacauaauugaaaguaaaacacuccucagcaaguacaaaagaacugaaaucauaacagucucucagaccacagcacuaucaaauuagaacccaagauuaagaaaaucauuuaaaaccacauaacuacacagaaauugaacaaccugcuccuaaaugacuccuggguaaauaaugaaauuaaggcagagaucaagaaguccuuugaaaccaauaagaacauggagacaagauaccagaaucucugggacacagcuaaagcaguuuuaagagggaaauguauagcccuaaaugcccacaucaaaaagcuagaaagaucucaaauugacacccuaauaucacaacuaaaagaacuagagaaccaagagcaaacaaaccccgaagcuagcagaagacaagaaauaaccaagaucagagcagaacugaaggagauagagacacgaaaagcgcgucaaaaaauauuaaugaauccaggggccgguuuuugaaaaaaauuaauaaaauagaucauuagcuagacaagaaaagagagaagaaucaaaucgacacaauaaaaaaugauaaaggggacaucaccacugaucccacagaaauacaaacaaccaucagagaauacuauaaacaccucuaugcaaauaaaauagaaaaucuggaagaaauggauaaauuccuggacacauacacucuccaaagacggaaccaggaagaaguugaaucccugaauagaccaauaacaguucugaaauuuaggcaguaauaaauagucuaccaaccaaaaagagcccaggaccagacagauuuacagcugaauucuaccagagguacaaagaggagcugguaccauuucuucugaaacuauuccaaacagcugaaaaaaagggacuccucccuaacucauuuuuugaggccagcaugaucuugauaccaaaaccuggcagagaugcaacaaaaaaaagaaaacuccaggccaauaugacugaagaauauugaugcaaaaguccucaauaaaauacuggcaaacugaauccagcagcacaucaaagauuauccaccacgaucaagcugucuucauccccaggaugcuaggcuuguucaacacacacaaaucaauaaacauaauucaucacauaaacagaucuaaagacaaagaccauaugauuaucucaguauaugcagaaaaggccuuugauaaaauucaacaucccaucacguuaaaaauucucaauaaacuagguauugauggaacauaccucaaaauaauaaugauaaacccacagugaguaucauacugaaugggcagaagcuggaagcauuccccuugaaaaccagcacaagacaaggaugccuucucucaccacuccuauucaacauaguauuggaaguucuggccagggccaucagacaagagaaagaaauaaaguguauuccaauaggaagagaggaaguaaaacuguuuucuguuugcagaugauaugauaguaugucuagaaaaccccauuaucucagcccaaaagcuucuuaagcugauaugcaacuucagcaaagucaaaggauacaaaaucaaugugcaaaaauuacaagcauuccuauauaccaacaacagaaaacagagagccaaaucaugaaugaauuccuguucacaauugcuaugaagagaauaaaauaccuaggaauauaguuaacaagggaagugaaggaccucuucaaaaacuacaaaccacugcucaaggaaauaaaagaggacagaaacaaaugaaauaauuccaugcucauacauaggaagaauaaauauugugaaauggccauacugccuguuauuagucuguucucacacugcuaugaagaaauaccuggcugggugugguggcugacaccuguaaucccagcauuuuggaaggcugaggugggcggaucacuuaauaucaggaguucaagaccagccuggccaacauagugaaaccuugucucuacuaaaaguacaaaaauuagccaggcaugguagcgcaugucuguaaucucagcuacucaggaggcugaggcaggagaaucacuugaacccaggagguggagguugcagugagcucagauugugccacugcacuucaggcugggcuaaaagggugagacuucaucucaaaaacaacaacaacaacaacaauaaaaacccugagacuugguaauuuauaaaggaaagagauuuaauugacucacaguucuguauuucugaggaggccucaugaaacuuacaaucauagcagaaggcaaaggagaagcaggcaccuucuucacagggcagcaggauggagugaguacaaacaggugaaaucccagacacauaaaaccaucagaugucgugagacucacuaucacgagaacagcacaggaaagacccgcccccaugauucaauuaccucccaccaagucccucccacaacacaugugaauucgagaugagauuuggguggggacacaguuaaaccacaucauucugacccuggcacuucccaaauuucauguccucacauuucaaacccaaucgugccuucccaacaguccaccaaagucuuaacucauuucagcauuaacucaaaaguccacagucuaacaucucaucugggacaaggcaagucccuuccaccuaugagcuuguaaaaucaaaagcaaguuacuuacuuccuagauacaauggggguacaggcauuggauaauacagcugucccaaauaggggaaacuggccaaaaccaagggguuacaggccccauucaaguccaaaauccagcaggacagucagaucuuaaaguuccagugaucuccuuugacuccaugccucacauccaggccacacugaugcaagagguggguucccauggucuugggcagcucugccccugugguuuugcagaguauagcccccuuccuggcugcuuucacaggcuggcauucagugccuguggcuuuuccaggcacauggugcaagcugucaguuguucuaccauucuggggucugaaggaugguugcccucuucucauaacuccacuaggcggugccccaguagggacucuguaugggggcuccaaccccacauuucccuuuugcacugcccuagcagagguucuucaugaggucccugccucugcagcaaacuucugccugggcauccaggcauuuccauacauccucugaaaucuagguggagguucccaaaccucaauucuugacuucugugcaccugcaggcucaacaccacauggaagcugccaaggcuugaggcuucugaucugaagcaacaguccaagcuguacuuuggccccuuuuagcuauggauggagcugcuggaaugcaggguaccaagucccuaggcugcacagaguagaggggcccguggccuggcccacaaaaccaucuuuuccuccuaggccuccaggccugugaugggaggggcugccgugaagacuucugacaugcccuggagacacuuuccccauuguuuugggaauuaacauucagcuccucauuauuuaugcaaacuucugcagcuggcuugaauuucaccucagaaaaugagauauucuuuucugucacagucaggcugcaaauuuccugaacuuuuaugcucugguucccuuuaaaaacugaauacuuuaaacaacaccaaagucaccucaagaauaauuuguugcuuagaaauuucuucuacuagauacccuaaaucaucucccucaaguucaaaguuccacaaaucuccagggcugagggaaaaugccaccagucucuuugcuaaaacauaagaagagucaccuuugcuccaguucccaacaaguuccucaucuccaucugagaccaccucagccuggauuucauugccugugucaucaucagcauuuuggucaaagccauucuacaagucucuaagaaguuccaaacuuucuuacauuuuccuaucugcuucugagcccuccaaacuguuccaaccucugccuguuacccaguuucaaaguugcuuccacauuuucagguaucuuuucagcagcaucccacucuacugguaccacuuuacuguauuaguccguucucacacugcuaugaagaaauaccugagacuaagcaauuuauaaaggaaagagauuuaacugacucacaguuccacauugcugaggaagucccaggaaacuuaacaaucauggcagaagccaaaggagaagcaggcaccuucuucacaggguggcaggauagagugaguggaaggaggugaaaugccagacacaugaaaccaucagaagucauuagacucacuaucacgagaacagcacgggaaagaccugcccccaugauucaauuaccucccaccaggucccucccacaacauguaggaauucaagaugagaucugaguggggacacagccaaacuauaucacugcucaagguaauuuauagauucaaugcuauucccaauaaacuaccauugacauucuucacagaauuagaaaaaaacuacuuuagaauucauauggaaccaaaaaagagcccauauagccaagacaaugcuaagccauaaaaacaaagcuggaggcaucaugcuaaucccacuucaagcuauacuacaaggcuacaguaaccaaaacaucauggccacuaguacaaaaacagacacauagaccaagggaauagaauagagaucucagaaguaagaccacauaucuauguccauuugaucuuugacaaaccugacaaaaacaagcaauggggagaggauuuccuauuuauuuguuuguuuguauuuuuucugagacagagucuugcucugucucccagacugacgugcaguggcacaaucuuggcucacugcaaccuucaccuccuggguucaagcaauucucuugccuaagccucccaaguagcuaggacuacaggcacacaccaccacaccugguuaauuuuuguauuuuuaguagauacagggucucaccauauuggccagacuggucucggacuccugagcucacacaaucugcccaccuuggccucccauagugcuaggauuacaggaaugagccaccacaccuggccagauucccuauuuaauaaaugaugcugggaaaacuggcuggccacaugcagaaaauugaagcuggaccccuuccuuacaccuuauacaaaaauuaacucaagauggauuaaagacuuaaauguaaaacccaaaacuauaaaaacccuagaagaaaaucuaggcaauaccauucaggacacagguacaggcaaagauucaauuaugaaaaugucaaaagcaauugcaaaaaggcaaaaauuggcaaaugggaucuaauuaaacugaagagcuuccucacagcaaaagaaacugucaucagaaugaucaggcaaccuacagaaugggagaaaauuuuuugcaaucuguccaucugacaaaggucuaauauccagaaucuacaaggaacuuaaacaaauucacaagaaauaaccccauuaaaaggugggcaaaggacauaagcagacaauucucaaaagaagacauuuaugcagcugagaaacauauuuuaaaaagcucaacaucacugaucacuagagaaaugcaaaucaaaaccacauugagauaccaucucacaccagucagaauggcgauuauuaaacagucaagaaacaauagauggugcuaaggcuguggagaaauaggaacacuuuuacucuguuggugugaauguaaauuagcucaaccauuguggaagacggugauucuucaaagaccuagaaccagaaacaccauuugacccagcaauguaauuacugaguauauacacaaaggaacagaaaucauucuauuacaaagauacaugcacacauauguucacugcagcacuauucacaauaacaaagacauggaaucaacucaaaugcccaucgauauuagacuggauaaagaaaaugugguauauauacaccaugggauacuaugcagccauaaaaaguaacaagaucauguccuuuguggggacaugauggagcuggaagcuauuauccucagcaaacuaacacaggaacagaaaaccaaauacugcauguucucccuuauaagugggagcugaacaaugagaacuaaggauacagggagaggaacacacacuggggccucuugggggacagggaggagggagagcauugggauaaauagcuaauucacauggagcuuaauaucuaggugauggguugacaggugcaacaagccaucauggcacacguuucccuaugugacaaaccugcacauccugcacauguaucccggaacuuaaaauaacauaaaauaaaaaaaaauuuuaaagccacaucugcccuaacggcauagcagacuagucuugcaccugaaccuccuagacaaaacuggaauucaugaagggacauacauuaauuguacucauuauaguacuagcuuucaaauuuuuguuaauuuuagguuccaaaauacucauagugauuaauaccauuauuucaaaauuuuaaaaaaaucugaucucugaaucauuagcauccagaguaaacacggguuauauuguuuugaaaaaaauuuucuucccucaaauuucacagagauaauaaaggucaacuaagcaaaacuaauacugugagaauaauucuuauucuagcuugaagacuuuuugaacacuggaauaugaacacaguauugguuuccuagaggcuguaacaaaugaccacaaacuguguguccuaaaacaacagaaacccauucucucacaguucuggagacuagaaaucugaaaucaagauguuggcagagcuaugcuccguugugaaaguucuugggaauaauccuuccuuguuucucucuagcuucuggugguuguagcaauccuuggugcuccuugguuuauagguacaucacuccaauccucugcuuccaucaucacgcugcauucucccagugugucuguguuccuauaucuucacauggccuucuuauaaggacaucagucacuggauuuagagcccaaccaaaucuaguaugccuuugucuuaaacugauuauaucugcuaauacucuauuucuaaaugaggacacauucacaaguacugggggguuagaacuucaacauaucuuuucagggggacacaacucaacucacaacaaauacaauaguaaugaauuauaauuuccuucuacaaaucauaaauuuaaagacaauguaaccuggaaaugcuuucuuuaaaauaaauauuauagcuugcuaucaauaaaggggcuauagccaggcaugguggcucaugcuuguaaucuuagcacuuugggaggccaaggugggcggaucacuugaggucaggaguucaagaccagccuggccaacauggugaaacuccaucucuacuaaaaauacaaaaauaagccagccgugguggcgcacgccuguagucccuguuacucgggagacugaagcagaagaaucgcuugaaccugggaggcggaggaugcacugagccaagaucaugccacugcacuccagccugggugauagagcaagacugucucaaaaaauaaaaauaaaaaauaaaaaaauaaaggugcuauagucccuacaaaaaaaaacuuuuucaaaaaaauguccuugaagccaucaaacaagagauaguauuaucugaugauacaagagucacaggaaauuuagaacuggauuauacuuauauuuucaucauuacucagacuaguguauagaauaguguauaguauaguguagcguauaguaagggccuuuuaggccauuggaaaaauuugcucaaaauuaauuacuuuucaacucaauaauacuaucauuaauaaacuuugcuccuuaagguugcuuuaaaagaaacaucaguuauuuuauuucaguguuuuaugcugaaacuuucuucauuuuaugaaguauuuacuuuuaauaauuuaccaauuaaaauacugcacagcuauacuuauauuaugauuuugucuuuuuguauuucaauauacuaaacauuaaauuauauauuuaguuucacuaauuuuuacuuuaaauuuuuuugacucaugaauaucuuaagaaauaaaauaguuauuuaauuacaugcaauuuuuuuggcaaaaacucuccaaacagcauauugucauuuucuucuaguauuacaaccauaucucaggagaaaaaaacagagaaaccuuuuuuuuaaaaugugucuggcaauaaagacuuuaugaaacaagcuuaucuauccuggccuggguucuccacagagaaggaaaaaucauacuugagaauucacaaacacaggguggcuuucauaaaccuuagauucaaauuuauucuaauuacaugauuuauguaaucccaguuaaauaaauuuucagugguucucgaugguagcaccccagacaccugaagagagaaacacaaaaucucuggaauucaugaagggacauacauuaacuguacucauuauaguacuagcuuucaaauuuuuauguuaauuuuagguuccaaaauacucauagugauaaucuaauaccauuauuuccaaauuuuaaaaaaaucugaucucugaaucauuagcauccagaguaaacacggguuauauuguuuuucaaaaaaaaguccucgauccagacaucaugggauucccacacccucaauccagacaucaugggauucccacagguaaaguccaaucaaacaugaacuuacaauacaaauuuaaaaugcacaagaagauggaccacuaggagggagucagcagaaaaaaaacaaaaaccaaaacaaaaaaacaagaaaacauccaaaagaaugguaagaaaaacacagcaaaaugagauccuuggagacaauuagauuuuauauucuuuaucugaaauggguaguuaagauuaaagauagaaaagaguaaaucuaaaauauaaacaagaaguaugauguuaaaauaucucaggcaaacuugaaaacaaauagaaguuauaaaaaugacaauuaucaaaauuaacuaauggguagcuuaaaaaacagaugggaaugaacugcuauaaagagaauuaaaaacuagaauaaagaucugaaaaaaucacacagacgccacauagagacagacagaaaacaugaaaugaacaagacaaggacuaauaguguagaauuaaaaaacagaaaguucauuuuaaacuuggaauuggccgggggccguggcucacgccugugaucccaccacuuuggcaggccgaggugggcagaucaugaggucaggagauugagaccagccuggccaagauggggaaacccugucucucuacccugacagcuucaucugcuuccuacaaaugggcucaguucuauuuacaauauccuuccucagcugucuacccuuaguuuuuaguucuuuuuugaauuuuuuuuaguccccacuaugccuuagaaaaguuuccaguucuaaauuauguauaauccauagucacaaaggagagaaaaacuuagcuucuguuuaccuucuauauucuuuauucaacaaguuauuggaaauuugcucacuuuaggcaugaugauaggaggucccauaaagccaagacugaguacaauuacguuucucuauguggcaccaugagcaaguagacauugaauaaauauuucaacauauuuaaagccuuuuuaaaaugugccuaguuuugcuuucuuauauuuguaaagguuagaaaacugugagagcuuaaucuacguucaagugugagagccucuuacccuuuuucagcuuccggacagccaacauacaaugacuaggugagagaucccauauucuuaagguuuuaucaucgcuuacaguagcacagaugggcagauaaggguguguagcuaaaccccacaccucuccuuccaugugucccuauaaagaaaacauaggaucaauuuaguguauguguguguauauuuauacacaguuuuauuuagaauaaagcuaaagauaccauucaauaauauaugauaauaggauaccgaauagugaguaaaucuaucaaaacuuuucuguuuaucuuugggaaacacaauaaaauaccucuguaacaacuuuagcuccacaauuaccauauaaucaagcuacaauuaaaguuagcuuauaauccuaaaacuuucucuggguggagagaauaggaauuggcugcucugcaauguuaauaauugccacacaggagguacuuuccugcaugagagagugaggagcuccacagaccugcucaccagugaaacuaguaaaaaucaauuaaaaaaaaaaaacgcaagcauuuaaagucucugaaaauaguuccaaggagaugcaacaaaggaaggaacauuuacucaagaaaaucuguuaaaauuuguuaagaacagugagagucuacgguauuuaaacugagauccacucccuuccucccuccucaucugguuggaaacuccgagacugaugcaaccaagaacacuaggcucucucuccccccagcucgcggucagagcacuaucuuuccagguagggcaggaugucagcauuucucacccugcccucagccuccuguugcugaggcuaaauucuuguugagcucagcugacaggugggagauaacuucugcccagccccuccuccagauggaggcucuacuuuggauguggugccucugagaauaaugggguccugggguaacccaggaaaagcugagacuacuguccccucuccccuuaccaaguacucagggccuaaagccugagauacucaaagauaaggauuccauugaccucacucucaacuccagagcccugguucagagauucugccuggagggagaggcaauccagaaauccagauagcuccuaaucucuucucaaaggaacugacuucauuuacagcagagugugaaaaagcucaugcauaaguacgucucaaaaacagugaaaauuguuuugaaaauuucuuaacuauucuugaauauuuuuucuucuauaugguuuuuaauaucuuuccagaauuuguaaaaaaucuaauaaaaaguaauugggaggagacugguaggcuaacuggaaauauaggcuaaaccguaggccagcuaguuuguccaagagaaccaguaaacucgcagagauagcugggaggagccugccuggagucagaaacaaaccucaaacacuaaucuagggaaguaucccuuuaaaggagccugaauuugauugguuuagccuguggcacaauuuauacccaaggaaaauguugaaaacaauagagcaauaugcuaccaauuaaaggaguuuaacaguuggguguggucagggaaagagacaaagaugagggaacccuuccugaauuauguuauacagccauuauuacccugauaucaaagccagacaaagauaucacaagaaaacuaaauaccaauaucucuuauaaauacugaugcuaaaauccucaacaaaauacuggcaaaccaaauccaauacacauaaaacauuacauaucacaaccaagugggauuuaucccaggaaugcaagauugacaacaucaaaaaucaacuaauacacuauaucaacagaauuaaaaaugaaaaacacaugaucagcuuaauagacauagaaaaagcauuugaugaaaaugcuccacaaauuuggaauaaaaggguaguaacuccucaacuuaaacuuaguaaggagcaucuacgaaaaacccacaguuaaccuuauacucaaugguggaagacuagaugcuuucacucuaagaucaggaacaagacaaggauguucuguucucaccacuuacauuuaacaauguacuggagguucuagucaagacuauuggacaagaaaaagaaauagcaggcauccagauuggacaagaagaaguaaaacuauguguauuuacagaugacauaauguuguacacagaaaacccuaaauaauccauuauaaaacuaucagaacuaauaaaugaggacggcaaguuuacagguuauaggguuaauguacaaaaucuacugcauuuugauacacuagaaaugaacaauaugcaaucaaaauuaagaaaacaguuguauuuauaacagcaucaaaaauaauggaaguuaaaaacucggcucacugcaagcuccgccucccggguucacgccauucuccugccucagccucccaaguagcugggacuacaggcgcccgccacuacgcccggcuaauuuuuuguauucuuaguagagacgggguuucaccguuuuagccgggauggucucgaucuccugaccucgugauccgcccgccucggccucccaaagugcugggauuacaggcgugagccaccgcgcccggccuguuuuauuauuuacaucuuuucacugauauuuaauuuucaguaaugaaauuuuagcauacauuuuuauuuuuucuuagaaacuuaagaauggccuaaugaagaguuucagagaaaaauaauugccuuaggcucaacaaauauaccuuauauaaauaaaauuaaaaacagacuggguuaaauuaauuacagcugguuuuucuuuucauggguccuuuauuuucugauaagaaauuacucaaaauauuggcaauuauuccauagaagaauauguauauuuacugacacccaaucauuucauuauaaccaaauuaaaauuuuuucuguauacauuaacagaaaaaaacaaauuuuuucuguauacauuaauuuuuucuguauacguuaaaauuuuuuucuguauacauuaaauuuuuuuucuguauacauuaacaaauauuucccuaauuuaacauuauuuuucaucacugucaacuuuuggcucuuauauauugaaauaaucaauuguauguaaagaaaaaaaaacaaauuagcauuuaaaauuaccugaaccagaaguguuauugggccacuuuuauccacuucuaguauuucaccauucuuugugccaacuaaaauaugaccauguccuaaugauauggcacguauagauggauuaucuuccaagagaagaccugaaauguuaaaugaagauguucuuuuagacauacaguuacuauaauacaacaguguauauauugccaauuaagcuauuuugacagugaaaaucacauuacaagguuuucuccuguauuuuaaguauucuaauaaauguacuauauuaaccucaaucauucaauuuaguaaucucuaaauaaguaccaccuaugucuuauaagucuaugauucuauucucacauucccuccuaccauuccaacagcuauuuguuuaccucuucuuauauuagcccuuccuuauccaucuccugccccucuuauuuacaauauucuuauuaguaauuuuaauucaauucaagauauauagucagcccucaguauccuugggggauugauuccaggacaaccacagauaccaaagucuauggaugcucaagucccucauauaaaaugguguaguauuugcauauaacccacauacaucauuccauauauuuuuuuuuucaguagggugggguugugccauuuugcccagacugaucucaaacuccugggcucaggaguuccacccaccugggccucccaaaguguugggauuacagaugugggccaccacagccggcccccaugugcuuuaaauaacuuuuagauugcuuauaucuaguagaauguaaaugcuauguaaauagcuguuauacuguauuuuuaauuuauauuauuuuuauuguucuauuguuacuuuuuauuuuucucuagcauauuuucuauuugcaguugguugaaucugaggauauggaacccacagauacagagggccaacuauauuuauuuaugucuacuuguccuagggaggcuucagcaacauauuaguaaagaugauagacucaacucauacccuuacagagcauacagugaggaaaacagacccuguguuaggggcauauugaaaugggagcacagagcaguggaaucuaacuuuuuugagaggagaugagggugggggaaaucauccuagaaaaaaucagguuugauauuugaaaaauaaguauguugucaaguaacuggagggggcaggaaggaagaggaaggacauguuuuaggaaaaaguaaaaacagguagaaaggcccagaagucagagagaguguggugcuaugccuuaaaggaagaaaugcacucaaagacgaguuaacgggugcagcacaccaacauggcacauguauacauauguaacaaaccugcacauugugcacauguacccuagaacucaagguauaauaauaauaauaacaauaauaauaauaauaaagaaaaugcacccucugggcccacagcccggaggauggucggcggacagggaguugggccugaugcugcccuugcacccuuccuccucuucaaaaaaaaaaagguaggccaagcacaguggcucaugccuguaauuucagugcuucgggaggccaaguuuagaggaucauuugaguuugagaccagccuggacaacauagagggacccuggcugcacaaaaauuugaaaauuugcugaguaugguggcaggcgccuuuagucccaacuacucaggaggcugaggcaggaggaccacuugagucuagggguucaagguuucagugaguuaugauugcaccacugcacuccagccugggcagcacagcaggacccugucucuuaaauaaaucaacaaacaaauggcaaagggaaaaaaggccugugaggcuacagaaacagggucaacaaaaugccaaggugaaacaaaauaucaaaguugcacacaaguuccugacuggugauaaaugugauguucacauggaaauuuucuuuggaaaauuaauguuaaaauuaggauucauaaucuuguauuucacuaauauuuuaccauguguaucauagaaaauagacuuuugaaaagauggcaaugauucugguauccaguuaagugauuucuuccacuuaauucugaugcccaacaagacggaaaaauacaugccauguguuccaccucagugaucacacacauuaaugagcaauuaaucuuuuuuuccuauacaaaaaccccacuaagucucaaaucaccuuuagauccuggggccaaugcagcucuuuuuauagcauaggucuugagacaucuuucaaaagagucaucccaaagagcuacuauaccaucuuuuccuccaguuacaaaccccuauggaaaaaaaaagguucaaguuaauaaagaucuaaauauuuuuuaaaauaguaaccuuuuuccuuauauugaaaacuucuagaaaaaagaacauagucaaaaguuacagcuuguaaagaacaggaauuagcuuaagaauccauuguguuuuuaaaccgucuacauggaaucugcaacaauauuuacagugacccuaaacauuuuacuuuuagauagggcuuuagaaacacaguuucuaaaaucuguaacuauaaguuagaucaccacucucagaaaguuacauauauccucuuggagucuacauaauaaccucauccuuaaaaagagaaaacaaaaaugguaacuaccugauggauauggugauuauauauaaacagccgauuuuugacacauaguaugagcuuaagaacaugaaguuaaacuuuaaaaaaaaacaaaaaaaacacaaaacaacaacagcagaccuggcuggcaccauggcucaugccuguaacacaauacuuugacggcugaggugggagaauagcuuaagcccaggaguuggagacuacccugggcaacauaaucucuaccaaaaaaauuuuuaaaaauuagauggguguggguggcacuugccuguagucacagcuacucaagaggcugaggcaggaggauuucuugagcccaggagcuggaggcugcagugagcuaugaccacaccacugcgcuccagcuugggugacagagugagacacuaucucaaaacaaaacacugcagaccuauuucauucuguguucgggaguuugaaaagagaaacaaagaaaggucaagaugacccuagcccacagacuacugcuggauaguccaggcaaguagaaaggcaguguuccuuuacuucuuaaaaugcucuacacuccaggacaaauuuuguuuaauuuaaaaucucuuuagguuacuuacuuuuuccaaugcaugcauacugaacacuggcccaucaugcgcuuucacuguuuuuacaagaaagaugucucuccagauacacacaucuccuguggauguuccagaaaaagccaucucuucaguccauccauacacugcacacaucauugugucauuuuuccccagugugccuauguagccuuuucuuccaaucaauccucccccuaguucacaaaaaauauuaugaaaguaccacuuucaaaauguacucaauuauaaagaagcaaaguuucuuuucuacuguuguuguuguuguuugaauaguaaggcaugcaacaguaaggagaauugaaaacuacaggugucucaaucagugauguggguaacaccuugcauaacugcauuuagaccauaacuuuuuagauaaacaaagaccuggacuaagucuguuuuaaucagcccuuagcacuuuugaugauguuuuuuaaaguuuuuauuaugacauauuuaagaauacaaaaaggcauuuaaaaaccccaauacaaugaaugccuauauauccgcugaccuacaaaaagaucccaaaguaacugaaaugucaugccaaccucaucucccuucuucacgcuuuaguauugugaaugugauacugauuauucucaugcauuccuuuacauauaaauauuugugaauuuuuaagcaaucucauuuuucauguuuuaaauuuuucuauaaauaucauccuguauguauucuuugcaacuugcuuuauucaccaaugauuuguuauagaguuuuuuacauguuagaaaacucacuuucauaaccacauagcauuccauuauauaacuauaccauggcuuauccauuuuccuauuaauggagauuuaaguuacuuccaaguuuuugcuauuaaaagcaaugcugcuuuaaacauucuuguaaaggccucuucuauacaagugcaagaguuucucuaggaaugccugggaguaguaauaggguaaugugcaaaaggcauaucauauagaucagagagguaucagcucuugccaaacuguuuuccgaaguuuauauaccaauguacacuccuacgaacagugaaaagaauuccuuguuucucaccuuugggaacaguuuguguugucacacuagggaauacgaaauaccaacugaauuuuauuguaguuuaaauuugcauuucugugaauauuaugcuagaucacauuuucauauuuuuacuggccaucauuaccuauugauaucucuugcccauuuuucccaauuggacucacaaauuccuuccuuccuuccuuccuucauucaagaaauauauuagcuggguauggugguguacgccuguggucccagccacuugagaggcugaggcaggaggcuagcuugagccugagaggcagagguugcagugagccaugauugugccaguacgcuccagccugcgugacagagcaaaacccugucuccaaacaaaaagagagagagagaaagaaagaaaaaagaaauauacaugccaggcacuauucaauguaccaggcauagacuuaugaacagaacaggcaagacaacaaaauucccuagagcuucauggugagagacagucaauaaauguaacaaguaaaauauacugugcuagaugaugaugggugcuuuggagaaaauagaagcauaaaaaggagacaggaagugggaggaguccacuuuaaguagggugguuaagguaagccucaucaagaagguguaucuaaaugaagacuugaaggagguagcaagagcaagccaugcuagaagaguguuccaggcagagggagcagcaagugcaaaggccccgauacaacaacaugacugaaaucacuaaguaacauccagggagacaaguauggagcagcaaagaaggggagacaguaaugggaaaugggguuggagaggucuaaggcaguacugcaggccauuguaaggacggccuacuuuugcuuuacaugagaugcaaaacauuugaauagugaaaugacaagaucuggcaauugauuuauuaagagguucauucugacuucuggauugagaauagauacaagggaggucaaggaugaaaggaguuagaaggcuauuucaaucaucugggcaaaugguaaauguggcagaccaaagugauaucauagaagaugacgaaaagugguuagauuccaaauguauucagaagacugucuuuucucaacauagaaggcagagucauuagugaccuuguaagagcagcuggguggaguggugaggugaaaaaaacuagauuagacuuuucuaaagagaaagagaacauaaacugcaaauugaaaguaggaacaacuguuuagaggugguuuagcauagaagaugacaaauugaucagcaacuggagaauaaaguugaaagaggguuuugugucacuuauuuaagauggcgaaaucacaucacacuuuuaugcugaagggaaagucaguagagaggaacauugaugauacaguagagaaaggguagaagaguuagagugauguccuugaguagaugagagaaagaaucuagugcacaaauggaagaacuggccuuuauuagagggcaaacuaucuucuagagcaggguggggaaacaacaggcugaaugccaaauccugccacuaccuguuuuuguacaauguccacuagagcagguuagcacucugagcugcagagaccaagucuguuuacuucucugcacccagggucugccucccugguuuguggcuguaacuagcaucugcccagagucugggcugguccccaccuacaagcuagagacucugcuaauggcaacugcuggguaucuggcaguggaaucucagucuaguaguugccccauuucuggucagcugcccaaauucagaagguugggcucuccaggaacagaaggacacacuaggaucuaugugucacugggguagugaagcucacuacaguuucacucccaaccaaaaccugccagacccauucccuggcagacagaaugucuaauggcaacugggugcaaacaggguaagcagggcaggacaguuuucucucuuguucuauaauuaccuacauaauacccuugauuuuguccuuuggccuagaaagccuaaaauauuuacuaucuggccauuuauggaaaaaguuugccaccuuugguucagagcauugacagcuggguuuucuugaugauacacacagcauaacauguuccuguuacaugaggucauauaaucagcucacauuauuauugcaucaaaaacuuucagaggcuccccaucccucugucccuaccaugaauagaguucaaaucccuuaggggagagauuaauaaaucauaacuugaaauucucaaagccuagaucuggaaugggaggcaagaagccccauguuaaccucaagccuaagucaucuccuucaaccuaguuuaccuaaaacuaugcauuuagaggguuaaacaauaguuagguuaaguaaguggauacuuauuucccaagugguuaaugaacucuguggaucagaaccccaaaaguaaggaagguugaaaugcucaccaaagccuuaacauucauccuuuuaugcuucacuuucaggucuacuauacgucuaaucaaacuuaagaaagaaaguuauucauuuggaaguauuuucacugcaagaauauuugcuuucuugaaaucuuauuucaaacaaauucauaguucuuuuccaagacagaaauacugaguaaaaucggccuuccauguucucagguuuugcaucuguggauuuaauaaaauguggauugaaaauauuccuuuuaaaaaggaugggcugggcacgguggcucaugucuguaaucccagcacuuugggaggccaaggcggguugaucaccuggagucagggaguucgagaccagccuggccaacauggugaaaccccaucucugcuaaaaaauacaaaaaucagcugggugugguggcgggcaccuguaaucccaguuacucaggaggcugaggcaggagaaucacuugaacccaggagguggagguuguagugagccgagaucacaacauugcacuccagccugggcaacagagcgagacucuguuucaaaaagaaaaaaaggaugguugcucuguacugaauacauacagacuuuuuuuccuugucauuauucccuaaacaacaguacaacaaacuauuuacauagcauuuacauuauauuagguauuaucgguagucuagaaaugacugaaaauauacaggaggaugugcauaaauuauaugcaaauacuauaccauuuuauacaagggacuugugcagcauggauuuggguauccuuggggaauccuggaaccaaucccugauauuuucugaugccaugagguacaacuguaguauaugcugcgaauuugcaauuacaagugacuaaggugcccaaaugaaguuuguuuaagcauguggaaacaaaauuacaaauguaaaaauacuucuuuuuacuuuguaaacgcauaugcuguuaucugaugaguuuuugauaaaguguuaaauccaagacugaaaauuaauucaugucccauguaauuuacaacuugaaaguuacuugaacuugggaaaugucuucacuaaguuuauucuuuucuaauaauguuuuacuucuuccuauauuuacauauuuucucugaacaguuucaauuuauugagauuuugaugucacauugauggaauuuauaaguauacuauuuagaaaacagacauuuuuuauuuuauaguuacaaaugacuaaaguaucauuuguacuauaaaugauacacuuuuguaucauuuaauagcauaugaguaauuuuuuuuaauuuucauuuucaguuuagacuauagaacaugucuuuaacagaagaaaaagucuggacauaauuugauuaaucucauauauugaauucuuuugcaaguaugaauacuacuguauuagucuguucucacacuguucauaaagacauacccaggacuggguaaucuauaaggaacgagguuuaauugauucacaguuccacauggcuggggagccucacaaucauggcugaaggugaaugaggagcaaagucacgucuuacauggugacaggcaaaauugcuuaugcaggggaacucccauuuauaaaaccaucagaucucaugagacguauucacuuccacaagaacaguauggcgaaccgcccccaugauucaauuaucucuaccuggcccugcccuugacacauagggauuauuacaagugaaggugagauuuggguggggacacagucaaaccauaucaacuacauaaaugcagccaauaaauggcaauaaaucuuguauuuguuuaaaaugcaucaauacaacaguaaauuacuuuuaaaaaauaaacuaauuuuagauaauuuuagauuuccagaaaagaugcaaaaguguuacagaguauuauucucuuauacacuucaguuucuacuaauguuaacaucuuuuuuuuuuuuuuuuuuuuuuuuucgagacaaguucuugcucuguugcccaggcugcagugcagugggagaucacagcucacugcagccuuaaccuccugggcucaagugauccuuccaccuuaucgucccaagaagcugggaccacagguacacaccaccaugcccagcuaauuuuuuuuuuuuuuuuguagagacagggucucacuaugcugcccaggcugcucuugaacaccuaggcucaagugauccucccaccuuggccucccaaagugcugggauuauaggcaugagucacugugcccagccaauguugacaucuuauauuaccauagaccauuuguugaaacuaagaaaccaacauauuugauacauuauuauuaaaugaacucaagacuucauucagauuucaucaguuuuucuccuaguguuccugcucuauuccaggaugcagucuaggguacacacugcacuuagcuaaauuacuuucaaaagcaauaauuucuuaaaauucuauggaguaaaaaagaagcacuuucuuaccugcuuuacgccaaaauuucauguguuuaauuccagcuguaauuaguuuaucaggcacauagggguucaucuuuacaacaaaaaucuuaucuuuacuuccucugaaauaaacaucgaaauguuuuagcucugaagauucaucauuccuguauuaaucucuugccuaauccauacccuaucuugauuacucuauuuacgaauauuuuacucccacuuaucucucagguuugggcuguguauuuguucuuuugucaucauuuuaauaugguaacucugcucaagagaaucucaagagacagaaauggucaaaacugaacuccuuuuggacagcaucuauaauaccuacuauaguacugugccauagggaaugcuauuuguggcaugaauggguuaaagucaauuuuaaaacaauacuuuguuauagcuuaagauagccuuuccaacuacaaaauuccucuuaaacuauuguuaauuugagcauuaucuauaugcuccauaaaaagcauuuaucuauauauuuaaagugcuuuaacaucgcuuuaauaaauagcagguuaaaaucucugacacuguugacuaguuccuccuuuaaagcauuguuaauauuacuauaaaaaauacaugcucacuguagaaaacuuagaaaaugaagaaaaauauaagaaaauaaaaaccuauaacuucuuugugacauauaugcauauauaucuuuuuucacuuuaauauauaauauaagcauuugaacauggucuccaacagcuauauaauagccuaucauacaguagaacacauucuaacuguacguggagauuuuagauaguuauauccaaugccauauuauaguuauauuuaaaaguggguucacaagggauaaaucuacaaagaaauucugaaaucauuuacuaugauuauauuauuuauucaaugguaauaaacauggaagcaauaaaaaguuacauauuugcuugauuucaaaauucuuuuaauuaaaaauuuuuuuaaguccaaaguaauucuaguauuuugcaaaugugauaucaaguuuuuuuccuaccuugcuauugaaaguuucucuccuuucuuccagucccagagcacaacaguauggcuaucaucuaugccaacugaugccaaacguuucccauccgcuguggaaaauuaaugagagagauaaacugacuauuaacauucagaagagagaaaacauucaguauauauucuaaacccacauccuauauuuaaaauuugauaaaauaauguuaaauguuaggcaugcauacaccuauaaaaagaaccagaauuuauaagggagggagaauaaaaguuucucaaauccucuaaauguaucugcucucaucgcaccugaucuccuuuucccuuaucuauccaucagguugggaugggaggagggagauaagaaaaauggaaaaaagagauuuaaaaaauagaaggaaagggaaaacuaacaaagggaugaagaaaauauuuaauuaaauucaucauaagaaauuuacuguaauauaagaacuuugaguaauuaugaaaaguuaaucaaaugaaaaacacguaaguuacaacaacaugcugccacuaauaugacuacuuuuaguaaaggucaaucauucaagcaauacauaaugaauauauuagacaaaucacugcgacaaaugaucagugaauauccuaugggugugcauguuuacaggcuguaaaggcucagaccacaagaaaauauuuuccauuuuaccacacuuugcaagucucaauuaguuccucacugcuccagugguauuuuucguggugacucacuuagcuugcaauucauuuucuaguuucuuaacuguuagcaacucuuugaauauauauauauauauauauauuucccucugaacucuacuauggauaauuuaucacuucagucagagcagcaaaagcauuaauucacuguuucuuaauauagaauucucuauuaauguauuuccucccucuucccaauucacacccuagcuuucaccguagaucuaucuguaguggucaaacuuuuaaacaaacagaaaagcgcuaauaugaucugaaauuauuuuuacaagacaguuuaaaauugucacuguauaaauaugucuaaaauaaguauuucaauucucaacucuuucuuugcuagccuuuuacccuaaacauuuucaaaguuuacucuggcuauaaaacgguaagugagaucagugcccucccagcgugggagaugcaaaccaccugugguaacugagaugaauuuagguuguuacguagauaaacauuuuuauguuaacagaaacauguaaauuuuaauaaguauuaaaacuauacucauuaaguuauaauuauaaacuagcuagcaaauccacacuuucauaguauuugauaaggauaacaguauacacauuugauaaaaacugugaaugucacagcuaaaugacaagcuuagguaacacugacuuagauuaaaaugcuauguguugccucugcauuuuguuaauucuuacugagacagcaaacagccuuaccugagaaaucaacggcacuaacaccauacuggugguggcccuuuaauauggacaaugguuuaauggucucuguaucccauauaugaauugagggaucucuaccaaccuaaaauagaauuauagaagcuauuaaauacaauuaaauuauuuauuuccauaucuacuaaaaggaaauaaaacaagagauuuuuacagcuugacuuauuuaccacagaaauuuauuaaauaaaaauuuaaagcaaacuauauaagugacugauauuuuuuucuuaugcuuguucaaaagcuaaugaggcuaggcucaguguuuccaggaaugauguaacuaacacuaugugacuuuuaucauauauuucaucaauaaagaugauaaaugcuuacugaauaucuauuguuuguaugcuagauacaacgagcaauaagacauucagguaacuuuugcaaacucacuggaaaaacaggacauuaucaaugaaagacaaacaccucuuaauagaugcuuaaugaacaugaaaaggcugugcagaaugaguccauagaagagaagguacuggaggugggccuucagaaagcacagaacuugaauauaaagaauucuagacuaaaauaaugggguaaacaaauauucagaggggguuaaaguaccaagcaugucuauagaccugaaaaggcaaaucuacugcagcacucugucacuuauuuuuuaacuugguuuaugauguucacuaaugcacagguaaacuaucaauucuuaauuauuccucuagacucaaguaaucacuuucuuuaaccauaagcauaaagagauauaauaucuuuguauauagagacaacuccugaaauaauuaauagagcugucaauuauaguuaauuuugagacugauuuauuuauuuuuuauuuuuuuugagauggaguuucacucuuguugcccaggcuggagugcaauggcgcuaucucggcucaccgcaaccuccaccuccuggguucaggugauucucuuaccucagccucccaaguagcugggauuacaggcaugugccaccacacccagcuaauuuuuuguauuuuuaguagacacaggguuucuccauguuggucaggcuggucucaaacucccgaccucaggugaucugccugccucggccucccaaagugcugggauuacaggugugagcuaccgcaccuggccgagauugauuuuauaaaaagauauaacaaauaacacugcaaucagccaauauuucacuaaguuauucagccaaacauuaccaguaacuuuuuagaaaauuuuuaacauuuuuuguggguacacaguaguaccaguaacuuuuaaguuuucuuuuuauauaaaaacuucuacagaauuugaugcuuuugaugauuuuacuguacuacucucuucugguucuccaguuuccuuuuuuuuuuuuuuuuuugagacaagguuucacuccuguugcccugcugaagugaaauggcaugauguuggcucacugcgaccuccgccucccaggcucaagugauccuccuugucucaacuucccaaguagcugggacuacaggcaugcaccaccaugcccggcuaauuuuuguauuuuuuguaaagaugggguuucacuacguguccaggcuggucuugaacuccugggcucaagugaucugccgccucaguuuucgaaagugcuaggauuacaggcaugagccacggcgcccagcuuccuugacuccuacuacugaguuuccuucucaauuuccucaccuguuacuuaaauacaaaccucucccaagguggucuuuaauucuccagucuucucauucuucauuuuugcccugagguaucucacuucuauaguuucagugguuaaaucaauaaauaccucccaaguccuucucucgagcaguuacuuuuccucugaauccaagacuuacauuuucaauugucuacuggacaucucaccuggaaauuaugaugaugacuaacacucacugagaaguaauuuaugugccagaaacuguucuaagcaccuuacgaacauugacucauguaccaaucacaacaacucuacgagaugggaacagauaacauccuuauuuuaaaggaugaagaaacgaagguaaagagagguuagguaauuugccaguagcgaauaaguggaaaggcuuggauuucaauaucacauuccaugagguauagacaguauuuaguauaauauugaguacuauuaaaguacacuuagggcaucucacucagggaugaaggggagaagggagagguugggagaguucucagauaggcuuagccuaagucuuaaaaggagcagaaauuagauaaaguuggaagguugaauagaaguggaggggaagaguuuuccaagacgaaggaacuaaguaaaagaugugaaauagcauuauacguguuggacaaauucuaucuaucucagaaggcaaaaaaauaguuuacaaagaggcaaauagaaagagauaaaaaggggaguuggagagucagacuugguuaaaugccuugaauugcauugggagucaacuuccaacucugcauuaauguuaugccuugaauugcauuuaaccaagucugacucuccaaccuccccuuuuuaucucuuaucauuuauagcuuguggcuauuuagacagcuguuuagacagccuacaggcuauuaacacuaauaaauaugaaagaauuuuaagacuuuuagaaagauuacuagugaaugggaaaaauggauagaggaaaaaagcagaagaccaauggcuauaguaauguuuuagaaauugugaagcauugauugucaguagagauauggaaaaauuaaagaugaaaagaauauugaagauaaagaauaaauauauauucaggugaaagaaugggugcuacuugaggacugacuagcuuuaggggugaagaacaagauuaacuuccaggcuuaggcaaccaaguuaauacacugcuauguucuaagaaggaaacacgaaacgaugaacagguuuggaagggaagauuaauccuauuuaucuccauuuuagauauguugaaucugaguugcccacaagacaucuaaaucaguguauuuuuagugaauuauaucuauauauacacacacacauauauacacacacacauacauauacacacagaauaauuuguccaauucuuauacuacauugugagcucccgauaguggcagccagucugaguuaucucuguguuuccccacaacauuuaaugcuuuugaauaggaagcacucaacaaguauuugcugaauuaaacaaaauuuccaaauuauaguacaauuagucauguuauucgacuuuccagguaaguuucuuucacauucuuucauuuccacuuaagaucacaguuacugacaagagguuauucuuuguauuuaauucuccaaaagacaaaacucucuagauuuuucaucuaaauuucuuuuuuuuuaaauuguuuuauuugggaaaagugcuucuuacaaaagggaagcugcaaaauacagagaccucugcaacaauuauuuguuuuuuuuucuuaaagugaaagaaugggugggauccaaggaaucaaaacaguagauggacaaaccaggagcaucccugaguuauuuucaggaaacaaagcaucaaaacacaaaggaaaaauuuccaaucaaggaauucuuccaacgacuuaacuuuaucuagucucagggauucccaagcccuccccuucaguggaaaagcaugacuuauuacugcaaacccauuacuccacuacaacaagcaccuuagaacagaguuuuuaaucacaucugucuaccugaaaacucagagguggaaugaggcaaauacccacaaaaacaaacacaaaaaccugacaacaaaaugucccaaaugaggacaaacguuucucagaaagugccuguaccggaaagguuagaucguaaaccauuaaauacaacugugcauccaagacccaguuuguguuaauauauaggauaaccagguaguuuuaaccucuaccuacccuccugauuaguuccucaacuaauguccauaaugcauucuaagauuugaacacugugaguuacucauaguucuuuaaauaagcuggguuuuuuuuugcccuacuuuuacagaugcuguaauacacuuagaaugcuuucccccaacuuccccucugccagguaaacaacucagcucaaaugucaucaucucuaugaggguuucuucgauucuacugggcaaaauuaaucauuaguucuucauuacauugcuaccaggcuuuguacauauuucuacauuuaaaaacagggugauuuugccuuccaagggacaucuggguacugucuggagacauuuuagguugccacaacucagggaaguggguguuccuggcuucuaauggguugagaccagggaugcugcuaaauauccuacaaugcauaggucagccucccacaacaaauaauuaccugccccgaaacaucaauagugcuaagguauugucauaaauauagaucagagaagcuucucugcucuauacuuaggacacuguaucacaacucagaaugugaguuuucaccaugacaagaaguugucuuauuuaucuuuauauuccuagcacauuucuugguacauagaaugugcuugaugaauguuuuugagugaaugaaagaaaggaagaaggagagggaaaggaaggagagaaagagcaaguaaggagaggcacaaagaaaggaagaaaaaggaagaagaaugggagaaagaaaaaagggaggaguuuucucuccuuucaggaaagcuauauaggaggaugcaaguugaucccuuuuccacauauccuagcuagaagguauauuuacacaguguuuaaagccagacagacugaaggcuuuaggcuuuacuaccuauuaacugauugaucuuaagcaaauuauuuaauuucuccaaaccuaaaccucaucauuuguagacugaaggaaauaauuuuacucucacaugguugaggugagaauaaaauaaauauacauuaauaaacuaguaaaguacuuacacaaaggaagaaucuauaaacaucauuucuucccuuccuucucuaagaauauccauauagagagguaucaguuaagauuuucucaggguuuuuuauuucaauauuugugcuuucuacuuugguaaaccugaauagauuacuaucaugguuguaaaauaaagagacauaguccuuugguuugucacaggacauuuguuaaauaauuuacauuuguuuuagguaacucaaccuaaagacaccagauuucuagucuuuauguuuucucuaauuuuacuaauuuaaaaaauuaauaucaugacagaaauaaaacaagccagagcuaugaguuccaaauuuaaauuaaaauaauaugaauuaaaauaauaaaaacucuaaaacuguaggaaaaaaguuugggguaaauuuuauuuauaaucugaaaauaaaacucauucuaaagaauucuuuacucuucauauccuagaacauaaaagagauaugugauuaauuuauuuaaacucaaacaaagguguagcuuaucuggcuuauugucagucuuucaaaccuaccuggccuguugccacguagucuuucaaaggaugaauaguuaggcagagaauaucaucaucaugacccagauaaaaacgcuguguguuuugcugucgauuauaaaugacacccacugcugccacaugguacacaauuucaccaauuugaguauaaaacagauuacuucgacagucauaaccucuguaacuaauauagaaaacaaaucauauauaauuaauuuuggccuuuuaucugaucaauacagaauauacaggggagaaguagguacccuuugggugaaucauucaauuuccaguuuuacaggauacuaaacaauuuuuuuucaagagauggggucucgcucugucacucaggcugaagugcaguggugugacugcaguucccugcaauuuugaccaccuaggcucaaacgauccucccaccucagcccuccaaguagcugggacuacugcugugcgccaccaugccuggcuaauuuuuguauuuuucauagagaugggguuuugccauguugcccaggcuggucucaaacuccggagcucuacccaccuuggccucccaaagugcugggauuacagguguaagccaccaugcccagccugaacaauuaaaaaaauaccaccaucucagauccaauaaacuuuuaugaacugcucggacugcaaauagcuaaaucuaagcuauaauacugagugaaaaaaacaagguagaaaauaguauguauaguauacuaccauuuacauaaguauaauauuaaaauuguauacuauaaaacaaaaacaauugcuuuuuauaaguaaaagguauagaaaaguauauuuguauuuguuguauaaguauuucugaaacuaaguaacaguaacuaucugcagagaggggaaaugauggcugggagggcagaggugggagaaagauuuucaaacuguacccuuuuauacacauuguuggaccaugagaauacaacguauauuccaaaaauaaguuuaaacuacaauuuuaaaauauuauccucauccaagacaaaguagucaaaucuuaaaauggucaauauaagucuauuuauagcaaccuugguuugcacuucaaagaaacccaauucauaaaauacaacugcauagaaacuacugccauuuuaacacuagagaaaaaauacuuguacuaauuaaauccuuuuucaaauucuugauaaguauuaucagucagguaagaaaacgaaugcugggugaaugguagaaaagagucagauuggaaaaucuguuucugccaagcugaaaugugagacccguauugccagauguucuaagagaauccagaacccguauuuuggugaaauuaaaauauuuaggcaaaaaugcucaugcaagaagaagucacaauaucauuccaaauuagacauauugaggggagaugauuaucucuuacauuuuacuuaauuguuuaaagaggcccauuuccauacauaugaaacuuucauaagacaaauuuauuuuuuauuuaauaaacacuuacauagugcuuauuaugugccacauaauguuguaagucaccacuagcauugccuuauucacuccucaucagaaccuuguaagguagguacuugauaugauucggauauuugugcuguccaaaucccaugcugaaaugugauccccagugugggauauuaggccuggugggaaguguuugggucaugggggcugaucccucaugaauggcuuggugccauccccuuggugaugagugaguucucucuugauuaguucauacaagaucugauugcuuaaagaguccagaaacccccuucccuuucgaucccuuuuuccuugcucucucucuugcuagguaacacaccugcucccccuuugccuucugccaugaguaaaagcuucuugaggcuucaccagaagcugagcagaugcuggugcccugcuuguacagccugcagaacacugagccaaauaaaccucuuuuccuuauaaauuauccagcuucagguauuccuuuauagcaaugugaaauggacuaacacaguacuauuaucuccauuuuacagacagaaaaaaagagacacagagagguuaagugacuuguuuaaagucacaaagcacacauaucauuaauauauuacacacaauguaauguauuacucuaagucaaauaugcccaguugucccaacaauguccuuuauaaucaucuuaaaaauccagauauuuuaaaaaauaucuuucaauuugguuuugucuaaugucuccucaugauuagauucaggugauguguuuuccccaugggcaauguuguauccuuucggauaugucauuucaggggauacagucaguucuaucauuagagauguuaagcuaguaagugugaaccaaaauucaaacaaauaaaugaaagauaguuguuuuauacccgugaacaaaguguaaucgaauacuauuuccuggagcccgcucucuucuuuuagaaguagcacuuuuuuguuucucuuugcacuguucuuuaagcugagguagaucuucuuuguaaaccuuuaaaaauguauacaaguagaaauauucuuagaauauauacuaauaaagguguucguauacucccaauauaacuuucagacauugucugaaaacaacagcuuuaauaguagucuuaaaugaaaaguuaauucaugaaauuuacucccucggaaagaacaaacaaauucacauuuucuacauaucacacugacaaauagauacauaguguuccaggaaauuuuuauacuucauaaaagaauauuguuaaaggaauaaaugugaguauacuaugacaaaauccuauaggcaaauagaaggcaagcauacuuaauauaccaagcauuuaauauaaaaaaaauuuuacacaaguguacucuaacacugacagugggaaaacuaauauagucauacauugcuugagaaauuaaagccacaaaagauaacaacagaugacuaacggggagcaagauaaagaagaaauuagacuuuuuagagaaaaaccaugugauauggaaaauuaccugucgacgguaggugagcugugucucuuguucaauuucagaauccaguucuggaacaucagacagaucugaaucugauucaucacuaugagagucagccagacuuucuguaauuuuuaaaaaugaaauguuacuuguuuaaagaagauucauuuucaaaacagcacugaaaaauuaaugauuaagagcuaugucaguugacauggagacaagccauaaaacaaucaaaugaaauuaccuauucaagugacacagaugucaguaaacuguacuacagauuaucuuccucuccacucacugcaaacucaauagcuccuuuaaaucccuucacuggcuccccaaugaccgcuacaucaaauuuaaaugucugugcaaauauaagugaauauaaccuauaauuaacaugaaaaauagcuaaaaauacuauaugcaacagaugaauugacauuagauaauuuuugucaauaaaagcauuuacaaaaucuagauacccaucucucagaggauauauuaaauguuuguuuugcuauuaauauaacuguuucuucacucauuauuugauagauuaaaacgcaaucaaaauuacuuuguauuucacacucugugacaucuaacuuuaaacauauagaacuaauauuuuaacuugaaauuucuacuaauaacaaacuacacuguuaacuuaugaggccagauuauacuuuaauauaaaauuguuauuuggggguuacugaagaauuauuugacagggaaacuguuuagcuaaugcauacuacucaccuuggggugcuaugugaacagcaucuuucaguuuucuuucaggaauaaauuuccacugaaagacagagugaucugcuccaccaauagaaauaacccacugauaaucaugugaccaucugacauuaguuacgugagcugaauggccaauauauuuucuaaacuuggccccuauaauaaaaauauaucuuuaaauugauaaacaaaugcuaaacaaaauaccauuucaaacaauuuuuauauaugaaccacuguaucauccuucuaucugaauuauaaacaaaugggaaaaaugcugacucaaaaauugaacaaaugaaugaaucuguaucaaggaaugcaaauaucuccucugcugauucacaaggaaccacaaaggcugugaggcauuaucuuaccacuuugagaaaaaccuggggaucaacuguuuuuauauuaaaacauuugaauguuuuggccugaggccuuugggcuuaagugaaauucaaaggacuaaucaacuagaccuuacccccauuauucucaacccaagcagccagaggauccuuuuaagacuuaagucaucaagaaaauauuagcaaaaugaauucagcaacauauaaaaaggauuacacaacauaaucaaaugagauuuaugccaggaaugcaaguuugguucgacauuaaaaagucaaucaauguaaugcaucauauuaaucaaagucaaauaugcccaguuguuccaacaauguccuuuauaaucauuuuaaaaauccagauauuuaaaaaaaaucuuucaauuuggguuuugucuaaugccuccucaugauuagauucaggugauguguuuuggguaagggcaauguuguauccuuuuggauaugucauuucaggggauauggucaguucuaucauuagagauguuaagcugcaucauuuggcuauggugguauacacccaauuucuccaauaauaaaggaaucauuuaacuuugugguuaauuuucuuaaaaaucuaugugauaauagggauauauuuuauuuauuuauuuauuuauuuauuuauuuauuuauggcagagacagggucuugcuauguugcccaggcuggucucgaacuccugggcucaagcaauccuccugccuuagccucccaaagugucaggauuacaggcaugagccaccacaucugacaggaauauauuuuuagaauauauucucuaucuccuccuccugguauguggcauuauacagauauucuuauuaaaauacacaggauacaaugaugcuuagcuuccuuuugauauuguuuuaaacacuuuauauuaaguuauagaagacuuguauaucaggaugucaaagccccaucaacgaaauucuggagaaaaacuuucaucuuagucauuaauuuaagauaacuaucaucauuaaugcaugagauagaaucaaaacucaucuaaaguuauaauuuacugcugcuuaauaguaauacuguuauuuuaggaauaaauuuuuuauguagcuuaauauaagucacuaauuuaacuucgcauaguucagcccagcaaaguccuaugagguaagggcucuuauauaggaaugcauuacuugccugucaagagggcuuuggcuacuacuacuaccuuugaugcaacccuuaagcacucuuagacaucagagagucugaaaaguuaaagccagaaauucuaacaaauaaaauuccaaguucuaagaucuacuaauuuguuauguuaggacaauuaaagaguuaucucagcaucugaucugccuauaccgagugauagagagagguacaaauaauccuguaagucccuuccaaacuuuucuuugagacuucucaaagacccucuuggauaaaccaaggcagcuaaacaagaaaguuguaaaauaagucuaagagaaaccaguauuuuuagucaaugggacuguauuaauuuuuuaauaaccaguuuaauuuuuaauaacuuguucugauaaauggguaucuuaaaagugaaccuagauaucauaucuuucaugaaaugacuuugacucaccaagaccaaguuacaugcuuccagaauucucugugauuaccccuugugauuauauuuauauaacacugaaauguaauagucuauuuacuuguuaacuccuccaauaaaacuauaagcucuuuaaagacagcaguggugucuuguuuaauauauaucucuggugccugguauauagcaaacacucauuagauauuugaagaaagagaaaaagaaaggaaaagcaaagauuauauuuccuuuugcucugcuuggacuuuugaguuggaaugcuagacuguaauguaggaaagaguaguaaaggaaacugagagggcaugaacaugauuccaaccccuauaaugcacagaagagggcaaaaguuugaugugccuuaaagaauauuagaauugaaaucaaaagacuagugcuugagcaucauuuaauagcacggaagucugagcauuccaccaaaccucuuuuggacuccauuuucucaguuuuaaauguaaauuggauuauaugcucacaagguaccuuuugauuaugaaaacuaugauaaaaaaugauucaguaauaagaauaguuaaggccuaaacaguguaucaucaauuaguacaaauaucucagagaaaaaauuuaucaagacaaacuauaaugaucauagaagcuuccuaauuuaaaagaggaugaaaauucuugguaaggauaaagaaauauacuaaaauauuuguguuucaaugauuccauuucuuuuauaauguguuuuaauguguauuuucacacaaggguaauaugaucuaaauauuuucaauauaugguaucaauaugacaaaagauuuuuuuccauuuaacuauguuuuaaugauauuaaacuucuagauaugggaauaauaaauauaugaaaauaucuuucugacccuaguaaaaguaagaauuucuuaauauacaaaacuacacuaccuauaagaaaagaaagagaaauagacuugacuacacugaaauuaagaacuggccaagaaaacacaucauuaagaaaauaaaaaggcaagccaaaaacugggaaaagauauuugcaaacuauaaaaauuacaaagcauuuguauuauuagaguauauaaaguaauucuuaaagaucaauaaaagaaauaacccaacagaaaauaggaaagagauaugaacccauguuugacagaggagaaaacacagaagaccaaaacauauuuuaaaagaugguuaaccucauuuguagucagacaaauggaaauuaagaccucaaugugacaucauuuacaccaacuggguuugcaaaaguuagaaaguauagcaauaucaagugcugaaucaauaggcuuuguaaaacuggauaaccacuuuggaaaauauuuagguauuuucuuauaacguucacauucuccaugacccagaaauuucacuccuaguuauuucacuccuuugagaaaccugcauuuaauaucaaaagaugggaaaugacccaaauguccaaugacaggagaauaaaugcaugaauugcagcauauacuuacaacacaauauuuugcagcagugaaaaaaaggcauuaaagcuacacgcaacaauauggaaaacagcacugaaucaguccccguuauaaauuuuucuuuguuagauauuugguuuuuccuaugaauuuccuggaaucuaaaugauauuuucuccaaauauaaauuuucauuugucaacaagaaguacagagggggucuuggccauuauuaacagugauggaggugaugggcuaacguaacucugcccucaccucuccauucucccugacccugaccugcucacuguccaccacagccccuaugcugcugccuaggaagaguccuggauucuuucagagagauuauggucaagagcaggugaaacuagagaaaaagaggaugauaaugaagaaaaaaauaugaagagggguggaaugcuuugggcugaaauuaaagugcaguauguaggguauaugugguucauaugaucauucucucuuugagcuaacuucguauauuuuuuguuucaauuacaaugauucuauaacauaaacuacuucuauuauuuaaaguccacauuuuguaaaugcugcacuucuaagaagucaccuaaugaauauuaccugaguggauaucuaaaauauauuaauacaccagcuacauuuuucuaaguuggacuagcaaugcaacuuaauaauuaaucuaaaagaaagaguauauuucuaguaauacugccaacuucaagguauguaauuaugugaauucaauuaauacauaaucuuuuuuggccuaaguggucugcaaaacauaaaaucuuaaaauacuuauauuaauccauuaaaaaugcaguagucguauucugucuuucccacuuaccuagcuacaaucucaagcugacucacaagugccuagaaauagaaaucauccuuacuagaaaauaaauuacuaacaaaaaagcuaacaaaugggaaacaaaaaagagaagcaauuuauacuuauguccuugaaggagugaauaaucucuuagacaagacuaauuuucuuaggcuuugguaaaauauucacacagcaguucaaagaacuacuacacauuuuauaaaugaaauaaaauuauugugcaauaauaucgacuucucucuugcaaaugauaaaaauaaucaauaaauccuauucacuugacuaagaaaacuaagaagauuaaagcauuuuuguuuuugcauagaggucaguaugugaaacaguaaguaggagcaacgucuaagaggaagaucaucaugacuacuacugaaucucacacuucauaaccaggcaaguaucaucuuaaaauuuguugugcauggugacucucauguccuggcuauguggugggacucagaaauaggguacuuuaauuguuagauauuuagccagucuuuugauaugguuuggcucuguguccccaccuaaaucucaucucgaauuguaauccucauguguugaaggagagaccuggugggaggugaucgaaucaugggggcaguuucccccaugcuguuuucgugacagugagugaguucucacgagaucugaugguuuaaaaguguucagcaguucagcauggcuggggaggccucaggaaacuuacaaucauggcagaaggugaaggggaagcaaggcacccucuucacaggguggcaugaaggagaaguccaugagaucacaggaaaaacuaccauuuauaaaaccauuggaucucgugagaauucacucacuaucacaacagcagcauagaggaaacugcccccauaauccaaucacuucucaccagguuccucccuuaacaccuggagauuacaauucaaaaugagauuuggcuggggacacaaagcuaaaccauaucagacccugcucaugccuguaauccuaguacucugggaggcugacguggggagaucaccugaggugaggacuuuaagacacagccuggccaacauggugaaacccugucucuacuaaaaauacaaaaauuagcugggaaugguggcacaugccuguaaucccaguuaccugggaagcugaggcaggaggguugauggaacccaagagguggaggcugcagugagcagagaucaccacugcacuccagccugggcaacagagugagacccugucucaaaaaaaaaaaaaaaauacaaccaucauuguacagucugacucuaugaaagaauucacgaagugaaaagaaaaacguuucuuugaaaagaaagagauauagugcauucauaacaacauaugaauucaaaaagaauuuucuaauaaaacuucaugaccaaaauaaaugcagcauaugacaauaauuuuugaauuagaaaaaugaaacccuucaccaaucaguguaauuuuaaaaaauaugaaauccuuuaucucaagacuaauuuucugcaagaacacgaaagucuucugugagagagagguuacuuaauauuuugaaagaaaagguaccuuuucuuaaacauggauaucggaauaauuuuauaauuccauagucaucagcuguaacuaaaacuuggccaauauaauuuccaucuacugaauuuauaucguugauaucugaauacuugggccaaauuccauuuacuucaaggccugaaacacauguccaugaagcccaaugaacaccuuuuauuucuucuguacuugucacuuccuuuccuccuaaaaauaaaucagagucuuaauuuaaaaaguuauuucauuugauuuucucaagccuaaacuguacugagaacauaguaaauuccaaaauuuaauguaucuucccaccccacuuagaggaaaauacauaaauagguagauaaguuuggguuaagagaaaagaaaacuaaaugcaagaaauuuauaaaaagcuacuacagaaauuauacugauucagagacacacauugccuugaaugauuagcuuagcagguucaauuauguggagaauaaaacugaaucuuauuuaaaaaaugauacagauuagucauaacaggguaaguuauaaaaaagguaaaagcuaugagaaaguggcaaaucagguauuaaaaaagaagccuaagauacauaguugaggaaaaagagagaacuggaaaagaccaagaagaaaggaugaguguaggauaauauauuuacauuagguaagaggacuuuaggacccggucagucuucauuacauauagacuguuaaugaaaaacuuuuggggagaugcauuaauugaauuaugcagcuaauuuuauauaauagguuauuggaagauagugacuaauucccuaagcgucacaacaaauaaaguacuaugcaguggcugggugcaguggcucacaccuguaaucccagcacuuugggaggccgagacaggcagaucacugaaggucaggaguucaagaccagccuggccaauaugguaaaacuccaucucuacuaaaaauacaaaaauuagcugggcaugguggugggcaccuguaaucucagcuacucgggaggcugagguaggagaaucaccugaaccugggaggcagaggcuguagugagcuaagaacaugccacuacacuccaaccugggcaacagagcgaaacuccgucucaaaaaaaaaaaauacuaauagguaauauuuugaugauucugcuuuuauuccauccauucaugcacucacucacuuguuaauuuauuuacuuauuuguuuaguuagagccacgaucuugcucuuucacccaggcuggaguucacuggcacgaucuuggcucccagcagccuugaacucccagcucaaaugauccucccacugcaggugcaugccaccacaaccugcucauuuuuuuuuuuuuuuuugguagacauguggucucaccauguucccuggcuguucucaaacuccugggcucaagagauccuuccacuuuggccucccaaagugcugggauuacaggcgugaggcacugcacauagccuauuccucucuuuuaaaaucuuugguugcaauucuguuuuucaaaguuaguuaguuauauuauuaauauuugcaaaguuuauuuguuuuuuuuuuuuuuuugagacagccucuuaaucuguggcauaguuggaaugcaguggcaacauaacggcucacugcagccuuauccucccaagcucaaaugacccucccaucccgaccucccgaauagcugggaccacaggugcauaccaccaugccuggcuaguuuuuguauuuuuaguaaaggcaggguuucgccauguugcccaggcuggucucaaacuccugggcucaagcugucgguccacuguggccucccaaagugcugggauuacaggcgugagccacuaugcccagccugcaaaguuuauuugagauaaacacaaaaaaaauguauuggucacacacuucuaguaauuauauucacuuaauuaguuccacccauaaaaauggcauuuuugacuaagauacagugguacuuuaccauacacuauacucaugguaugguauucaauaaaaagagaaucuguuuuagauccuccagccaaagcaguuuuaauuaagaaccaaaggauuuauaguaguaguugccagggacugggagagguagagguuggugggggccgggguggauauaaggagauauaaguuucaguuauacaggaugaauaaauucagaagaucuaauauacagcuuguugaguacaguuaauaaugcuguuacuguaugauauaccugaaauuugcuaagagaguggaacuuaaauguucucaccacacacacacaaaaaugguaacugugaaguggcagauacaucauuuagcuugauuguggaaaugguuucacaauguaucuaucaaaacauuacauuguaaauuuucaauauauacaauuuuuaaugucaauuauaccucaauagaguugagaaaaaacccaaaaggauuucaauauaaggcagccuuauuguauuauauuguagaauuauuguagaauacaauaauauauuguauuauauuguagaaaagucuacaaugccugaaauauuagcucagaucuucuuugauuuccuaugaucaaauguaacuuacacucugcuuccaguaaaacucuaaaauauuguauagguacuacaaaucuauaauuugcuagaaauuguuaccuggcauucuauaaaaaagucuuuucccauuuccaucauuugucugcaaauaucuacugucugaagaccaguccagaugagugaugaaacuaagggaucccaaacacucgccaacuuuuuuauaacgcugagcaacuccauaaauaucaaccgagcugucauugcauccaacagcaagguaaguuccaucuggugaauauuuuaacucaugaauugccuccuuccuaucuuuaauauguacaacuuccgucauaucucuguuaaaaagaaaaaaaugagacuacaugaacagaagucacaacagaauuaaugccguuucaaacaugucuaaaaugaccgugaagcuguaucaaguguuuauaaacuauaaaguaaacauaaauaacacaaguaguauuaauucagcaacaauacguugcugaacagaaauacauggaaacaauauaugccagauguacaggaaaaugcugaauuucaguuucuaaauuacuuuaaguacuucagagauccauacuaaauuucuggaguuaauaaagaauaaaggaaauaaaguaauagauuuuuaugguaaaagaaguucuuuguaaauauggaguuuaugaaaaauguuuaauuuaaacacuauaauuuucaaacaauuuuuuuuuguaaggagcuaaaugugcaaaauuacauuuaggaaauaauaaaggaugaauucaucuauauuacuucaguaauacuuuuuuuuuuuuuuugagacagagucucgcucuguugcuuaggcuggaguccaguggcaugaucucggcucacugcaaccuccaccucuggggaucaagcgauucucaccucauaccucagccucccgaguagcugggauuacaggugcacaccaccauacccggcuaaucuuuuugacguuuuuaaauagaacacacauuccucccuuagggaccauguugaccagugaaguggaacuuuuuuucaaugaugacuucuuauugaguauccaaaauaauacagauauuaguaacaaccaaaagauggauaaauauguaguaaaacaccacggaguuuccaaaguuguggaguuugugggcaggagaaggagaaacagagggagggagaaaagguagggggaaguaaaaauucuuauuuucaaucagugucagagacuuuucuccagaaaaauuuugcuuuuauugacuucuguuacacaugugcaagaauuaaucuucaguuguauuugagucacuauacagcugugggccuguuaauuacaguacuuacugauuaugcuaaccaacauaguacuagaaauagaaauagaaaaaugagccccaagauaaauccaagauuguauuauuugaagcuucuguacuuuuuuuuaaaguuucccuggucaacaucacuucugccucugcaacuugcaagguccucuuccuaugcauagacucauacagcugccucugcauuucccagggacuccuucaaguuaacauuaaauccauauaccguauugcccuuugcuccauauccauccauccauccauuccucccucccuauauggaguaagauuuuuaagaaaagucuaaggcacuauuuggcagcuuuuacuuuuuaugccuccuuuauuuaaaauuuuauaauuauaaucuucaugaccugcauuaaaaugcuucuggaaaauucuucagaaguauuuugguauuuuuuauagcauuuuuguuuagagacuuaauugcuuccaauuaagaagagaagaacgucuuauguccaagguuuucuguuaacauguccacugcucaccaacacacacacacacacacacacacacacacacgguagaagguaacagagagagauugugguugacugauugguauuuuaguauaauaucgcuccgucaauauugugaauuauaugaccacucucucacaugaagaguuucucugacaaauuuaaagcaaagacgacaacuauuagaugaaaauuuguuaauuuuuuaaaacauucugaauuaagucucugggagacuaauauaugaucacuaugguuucuuuuaagaagcagaaggaggcaaaagccugggaauacucauacaugaacaguucauaauacaucacaaaguaaagguacagaguugaucagagcauacaaccgaagaaucauuucuagcugagugauucuggggagacauaucaaaggaaguggaguagauagcuaugaugucuccauuuuguucugaggaaugaaugagauuuagcucagcagaagauaggaaauggagguaaaggaccuguuucagcagagacaacaguaugugaaagagcugauggcaagagaaaguauucaaguucagcuugugacggccacuguaguugaauggacacaaacaaggggacuuuggugugaacucagucugcugagggagaaucaugaagugggggccucauaugucuuauuaagauuuuuggccuuaauuugugagguuaagcuaggauaagauguaccagucaaaucacugauuugguuccaacguaaaaaacaaauaaggcugggugugguggcucacgccuguaaucccagcaguuugggaggcugaggcgggcagaucacaagaucagagagagaccauccuggcuaacacggugaaaccccaucucuacuaaaaauacaaaaaauuagccaggugugguggcauccgccuguaaucccagcuacucaggaggcugaggcaggaaaaucacuugaacucgggaggcagagguugcagugagcugagauccugccacugcacuccagccugggugacagggcgagacuccgucucaaaacaacaacaacaacaacaacaacaacaacaaaacaaauuaaaggagcauaguaauaggaucaaaaccaauuaaaagguuacugcagaugaugguuucucagacuucagaaaaaagugagcuucuuuaaaauacaauguaguauuauacuccauacuauuauaggacguaauacguacuauagguuaaagauauaauucuaaucuuauucacaaaccuuaauuaaaauguuccuagaaaauuaauuaggaaagcaaaaucaacaggauguggugcugauggauuacagaugguggguucaggagaaagagguaucaaggaaaacaccuagguuuuugcuuaggaacauggauaauggugccauuaacuaggauacggcccauagacagaugaucaguuugggagggauaucaugaguucaguuuuggaaaugcugaguugcaggugccuuugagacauccaagugauguuaaauaaguaacuggauaugcauagcucgaguuuugagauaacagcuggagcugugcauccagggucauuaggcuaugcgugguaacugacagcagaggcagaaugagacuaucuagggagaaaacauagaguaaaaagaagagaaagucuaggccugaguuuugaggaccucuaauauuuacuugcugggcaaaagauaauuagccuaugaagaaaauggggcuagagagguaagcugaaaacagaaagagaagaaacaccuaaaagccaagggagaaagcauuuugagaagcagcaagugguuaagagaaucaaauacugcuggaaauucaagcuaaaugagaagugaaaaaugucuccuaguuuuagggacauaggguacaauuagucaguguuuuucaacauaaagcugaaagcagaaggcauauaggaaugaggauagagguugauaauuagaagaaaagagagaauaaaguuagacaguuuuaugagaaauacuccugugaaagggaggaaaguagaaaugugauguaagagagagagacuuugguuugaggcaugaaacuuaagaugggacacauugagcauguucuaauagggcucuuuggugggggugcaaccaaccauuucaugugaaaaaauaauggacguacacaaagaguuacuuuuuuaaagccaggagacaacuuuuggaacuuacuacucccaagacgcagagcagaaaaaauauaaauaauuugaagaaaaauuuuaaaugaaugugugauuucuucagcaaaaacugucacgaucccuuuuaaaguugauaaaaugugguaguaacacugucagagagagacaaguggcuagccauugguagaaucuaaaaugacaauuugacuaggcaugguggcucgugccuguaaucccagcacuuucagaggccaaggcaggaggacugcuugaucucaggaguuugagaucaacugggcaaaaugacaagaccacaucucuacaaaaaauuaaaacauuagcuaggcaugguggcuacuuccaaguagucacagcuacuuggaagacugagaugggaggaucgcuugagcccaggaguucgaggcugcagugagcugugauugugcuacuguacuccagccugggcaacagagcgagaccuugucucaaucaauaaauaaaaugacaauuuuauguauuuacaacuauuaauagucuaucccauacccugugggaaaccuuacuccaucuucagcauaauucauuagccuugcuuaucaagcucuuccacuauuaugaagucucucucacuauucaugagaaggaaugggugccucugaggaguuugcuguugauaacacaguguagcuuacuguaagucaaaguuccauauguguauauauaauuuucuacuuuaaaauauuugcaaguuuucauaugacucuaugauaugagcuuuuuuuuuuuuaaacagaaaauggugggaagugaggacagcaaaaugguggaaaaggacuuuccaaugcuacuccccuugcagaaauaccaauuugaaucauccaugcauaaaaauaccuucacaaaggagauagacacaugaaaaucccuccaaaaaauuaauuaaucuaggaucugguuuuuugaaaaaauuaauaaaauaaauagacugcuagcuagacuaaugaaggagaaaagagggaagaaucaaauagacauaacaacaaaugauaaaggggauaucaccauugaccccacagaaauacaaacaaccaucagagaauaccauaaacacuucuaugcauauaaaccaggaaaucuaaaagaaauggauaaauuccuagacacauacacccuccaaagacugaaccaggaagaagcugaaucccuaaauagaccaauaacaaguucuaaaauugaggcaguaauaaauagccuaccaaccaaaaaaggcucaugaccagaugaauuuauagcugaauucuaccagaaauacaaagaggagcagauacccuuucuucugaaauagcccaacaauugauaaggagggacuccucccuaacucauuuuaugaggccagcaacaucuugauaccaaaaccuggcagagaaccaacaaaaaacuucaggccaguaucccugaugaauaucaaugcaaaaauccucaguaaaauacuggcaaacugaauccagcagcccaucaaaaagcuuauccaccacaaucaaggaggcuucauccccgagaugcaaggcugguucaaccaaugcaaaucaauaaacguaauucaucacauaagaucuaaaaacaaagaccauaugauuaucuuaauaggugcagaaaacgccuuugauaaaauucagcauccuuucauguugaaaccucucaauaaacuagauauugaaggaacaucccccaaaauaauaagcuguuuaugacaaacccacagccaauaucauacugaaugugcaaaagcuggaaacauugcccuugaaaacuggcacaagacaaggauguccucucuucaccacuccuauuuaacacaguauugaaguucuggccagggaaaugagacaagaaaaagaaauaaagcauauucaaauaggaagagaggaauucagauugucuuuauuugcagaugacaugauccuauaucuagaaaacuccaucgucucagcccaaaagcuucuuaagcugauaagcaacuccagcaaagucucgggauauaaaaucaauguguaaaagucacaagaauuccuauacaccaacaacaggcaagcagagagcuaaauuaugaaugaacucccauucacaauugcuacaaauaaaauaccuaggaauacagcuaauaagagaagugaaagaccucuuuaaggagaacuacaaaccacugcacaaggaaauaaaagagaacacaaaugaaaauauuccaugcuccuggauaggaagaaugaguaucaugaaaauugccauccugcccaaaguaauuuauagauucaaugcuauucccauuaaacuaccacugauauucuucaaagaauuagaaaaaaacuacuuaagacaucauauggaaccaaaauagagcccguacagccaagucaauccuaagcaaaaagaacaaggcaggaagcaucacgcuacugaaccucaaacuauauuacaaggcuacaguaaccaaaacagcaugaugcugguauaaaaacagauggguagaccaauggaacagaauagagaauucagaaauaagaccacacaucuacaaccaucugaucuucaacaaaccugacaaaaacaagcaagggggaaaggaucuccuauucaauaaauggugcugggaaaacuggccagcuauaugcggaaaacugaaacuggaccccuuccuuacaccuuauacaaaaauuaacucaagagggauuaaagacuuaaauguaaaacacaaaguuacaaaaaacccuagaagaaaaucuaggcaaugccauucaggucaugggcaugcgcaaagauuucaugaagaaaucgcuaaaagcagcugcaacaaaacaaaaauugacaaaugugaucuaauuaaacuaaagagcuucggcacaauaaaagaaacuaucaucagggcaaagaggcaaccuacagagugggaaaaaauauuugcaaucuauccaucugacaaaggucugauauccagagucaacaaggaacuuaaacaaauuuacaagaaaaaaacaaccccauuaaaaagugggcaaaggacaugagcggacacuuuuugaaagacaacauuuauguggccaacaaacauaugaaaaaaagcucaacaucacugauuauuagaaaaaugcaaaucaaaaccacauugagguaccaucucacgucagucagaaugacaauuauuaaaaagucaauaaacaacagaugcuggugagguugaagagaaauaggaaugcuuuuacacuguuggugggaaugugaauuaguucaaccauuguggaagaugguguggcgauuccucaaagaucuagaaccagaaauaccauuugucccagcaaucccauuacuggguauauacacaaagaaauauaaaucauucuauuacaaagaugcaugcauguguauguucacugcagcacuauucacaauaacaaagacauggaauccacccaaaugcccaucaaugauagacuggauaaagaaaaugugguacauguauaccuuggaauacuaugcagccauaaaaaggaaggagaucauguccuuugcagggacauggauggagcaagaagccauuauccucagcaaacuaaugcaggaacagaaaagcaaacaccacauauucucguuuauaagugggagcugaacaaugagaacuauggacacagggagaggaaaaacacacacugaggccuuuggggguggggugaggggagggggagcauuaggaaaaauagcuaaugcauacugagcucaaaccauuuaugccuagugcuccauuacuggaacgcuaagcuugugggaauuauuuauaucuuacugcucaaggucauugccaaggucugauuuuucauaaaaaaaaauuugcaaccccuggcauaaauggguuaauaccuaggugauggguugauaggugcagcaaaccaccguggcacauguuuaccuacauaacaaaccugcacauucugcacauguacuuuguaacuuaaaauaaaaauuaaaauaaaaaaaauguucauaagagcuaagaaaacauggugagagauuauagaaucuguauguaacacagcaauaaggaaagacauauuugaagaaggagggaaggacaguuuuacauuacucaugucaccccuucccucaagccaaccuaaguguccaucaauguacacaugaauaaaaaagagauauacuauucauucuuaaaaaggaagaaaauuagcugggcacaggggcucaugccuguaaucccagcacuuucagcagcugaggcaggaggauugcuugaggccaggaguuugagacaagccugggcaacacagugaggcccaggcucuacaaaaauuuuaaaaaauaauuuuagaaaaggaagaaaauccugucauuugcuaccacacggaugaaccuggugcacauuaugcuuagugaaauaaaccaggcagagaaagacagauacugcaugaucuugcuuauauguggaaucuaaaaaagucaaacauagcagagaguagauuggugguuaacagggauuaggaguacaggugggaaauggggagauguugguuaaagaguaccaaguuucaguuagaacgaguuaguaaguucugaagauauacuguauggcacagugauuagaguuaauaauaauguagaauauacuugaaaauugcuaagacacaucuuaaauguucucacccccuaaagugguuaaguaugugaggugauggauauguuaacuagcuugauguaaucauuucacaaaguauauguauaaccaaaaucucauguuguacgucguaaauauauacaguuuuuauuugucaaucaugccuuaaugaagcuggggggacacaaaaauaaauuuuuaaaaaggcagacugguuacaaaauaauuuuaaaauuguuaacaguuuuuauuaugaagaaaagauaaguuuuaagaagauauuguggcuuuacccuggcauaccaccuuauauacuaauuuaagaaucaugaugugagauucuaauucauucuauuuucuuccaacucuaacauaacccccacuccuggugcagguacuuuaauauguuaugagccgggcacaguagcucacgccuguaaucccagcacucugggaggccgaggcgggcagaucacagggucaggagaucaagaccauccuggacaacauggugaaaccccaucucuacuaaaaauacaaaaaaaaaaaauagcuuggcgugguggcacgcaccuauagucccagcuacucaggaggcugaggcaggagaaucgcuugaaccugggaggcggaggcugcagugagccgagauugcgccacuguacuccagccuugugacagagcaagacuccauaucaaaaaaaaaaaaaaaaaaaaguuauguucaguaaugaauccugcuuuaccauauggagaauacaaagcaaaucaagaagaaauaguaaccagauaaauucagauggauuaagaagaccauuuugugaguuagaauuuugugguucacuuuuaaaggcauuuaauaaucagaauaacccuuucaauacuauuagcaauguuggauucaggugcuaaaauacagucuuauuaggaauaaaaacuuuuucauccagucuacugcauucaguaacugaaagggcaaguaaauguauaacuaaaaaaaaaucacuacuuuugaauguguaucagauaugauaggaauucuuagguguuuuacaugcaucuuaaauucuuguaaaaccucuauaagugagcacuccaauuccaguacuuccaauacuuucaguucuuacagaaaagaaaaaaugaagcugaucaugaauauuaauuauuauucauaaguaaugaccagguguuucuauuuauuauuucuaaccugcaaaacugaagagcagccuccaaagaaauuaaacaaccaaugagaaaaagaacagauguuuaaucuuagaugaugauaguuacagagauuccagaaucaauagaucaaaucagugcccaaauuauaacaguauggauagcccaacagggagguuucguagucuuucaucucucuucaagaagcuguuucagcaugacaaaauaaaguaauaugacauauuuauagagcucuguggaaaaagcuuuaauuuauauucaaauguuauauucauuuuuuuaaaauaugagguaccuagaguagucaaauuaugucuuucauagagacccagaaaguagaaugaugguuaucaugggcuuaggagauggaagaaugggauuauuuuuuacaggguacagaguuuccauuugggaagaugaaaaaguucugaagcuagaggguggugaugguugcacaacaaugugaauguacuuaauggcacugaauuuuacauuuaaaaaugguugaaaugugaaguuuauauauuauauauuuuaccacaauaaaaaauguuaacuuaaaaaccggucucggaaaggggagucagcacguguagaggcucagaaguacaagaaaacauaauguaucuguucauaauggggagauguuaguuaaagaguacgaaguuucaguuagaauuagugaauaaguucugaacauauacuguauggcauggugauacaggaaaggaguuuccuauagaugaaagaaacugggguacugagaaauaggcuggaaagaugggcacuacauaccacgugaaggauuaugagcugcauccuaaggacaguacaaagccuuuaucauacuuuagaaauaagaagaaagcacacaauguguuuuaaaaggaaucaccaucacuguggagugaagaaaggucuugagggaaaccaaacaggagguaagaagaucagcuaagaggcuauuccaccaauccaguuaguagaugacagaagccuacacaagaguacaauggugagaauagaaggaaggagauuaauaugagagcuaucucagaaguagacucuccagaacucuuuaauuaacuacacaggggaggcaaaagagagaacuguguuaauaguuucugaauugagcaacugagcgaaggaucuuaccguucacugagguagagaagaaagacuucguaaguacuuauccuguggaucuacagcaaauuucuuacugacugcauagaauucaauugaauuuaucuaucuauaauucaacacaaaauguuaacugcuuuaccaaauucuuuaaauuuuucuaauuacucaaacaaaagaagagauggaagcauuuuuuaaagcauaaggcuguaaauaacaacaacaacaacaacaaccccauuuuaacagccucagcuuguuaaacggagagggaucauuacugaaaaucuauacuaacaggaaaagguaguugggacccaaacuuuauagcucaaaauuuuagccauuaaucuauuaagcauucuuaaccccccaaaccaaggcuucugaauuuauuuuucggacaaagcuauuuuuauaaauauauuuuuauacuugaugaaauuaacaucugaaauauauuaauaagaaggggaagagaaaaggauaaauagguaaaaacaacaaguauuauauauucuguaucgcugaagagaaaauuacuuauauucuguaucacugaagauaaaauuauuauguguuucuacccuaauaccauaccuuacucuaaguacagugaaugagccauccuucauuccaagggcaagauggauuccaucugcauugacagcugcacaacgaauugguucuuccauauuacaccuugcuauuaaugcaugaucuacuaggcuccauauccuguaaaauuuaauuuaaaaaauaaaaaagguuagcuaaugcauacuuuaguaaaaauauuuugguuaaaauaaucucaucuuaauuaagauaaaucuagauaucuuaacuaucuguuguguggcaagaaauucuuaucuaugaaaaugggaauuguucaugcuuaaaugacagaaguugauagaaucuuuugcuuugaauuuuuuuggcgacaucacgucacucugucacucagguuggagugcaguggcgugaucauagcuuacuauaaccuugacccugugggcucaagcaauccucuagccucagccucaugagaagcugggacuacaggaaugugccacccaaccuggcuauguuuuguuguuguuguuguuguuguuguuuugguauccuuuuagcacaguuauagugucacugcauaauaaacacaauguuuugccaucuaauugaauaacaguaaaguccaugcuccacuuugccuuaaaaauguaacacucaaaguccaauuuuaucuuuuuccucuuaugucaacaugaugaguaugcacuggugauaaauaauaaugucaccauaugguaaugcacauagcggucaaaauucugucaaguuguaaaugugucacugaaauuuguaaugagcugaggagcagugcaaagggaugugaguauaccaucucuuucccaacuucucaacucugcaucuguagugugauacacugcauuuuuuuuuuuuuuuuugagacggaguuucguuccuguuguccaggccggagugcaauggugugaucucggcucacugcaaccuccgccucccggguucaagcaauucuccugccucagccucccaaguaguugggauuacaggcaugcaccaccacgccuguauuuuguauuuuuaguagagaugggguuucuccauguuggucaggcuggucucaaacucccaaccucuggugauccacccaccuuggccucccaaagugcugggauuacaggugugagccaccgcacccagccaauacaaugcauuuuuaaacaaugcaguacauugauucuuucacuuuuagauagguuauuucuacccugaccaaagggagagaguguguguguagacacacauauguauauauccuuauguacauacagucuaguguuuaaaacuauccaaauucagaaucuguuccagaccacaaugcuagaaaucaacaacaaaaaagauaacuagaagauacccauuguuugaaaauuaagaauuauacuuccauauaaucuaaaagacaaagacaaagaugaacucuuaaugauuuguuacuauuuugaaguaaguuauaaaacugcuuaaaaucaaaacuugugaaauauagcugaaacaguacuuaggaggaacuuuugggagcuuuaaaugcauauacaguuggcccucuguauccauggguucugcagcuacagauucaaccaaccauggaaggaaaauguaguuaggccuaugauaguugcaucuguacugaacauguacagacuuuuuuuuuuugucauuauucccuaaacaauauaguauaacaacuauuuacacggcacuuacacuguauuagguauuauaaguaaucuagagauuuaaaguacaguugacccuugaauaaugcaccaguuagaagcaccaauucccaugccaucaaaaagccacgucuaauguuuaacucuccaaaaacuuaacuacuaguagccuacuguugacuggaagucuuaucaauaacacaaacaguuguuuaacauacacuuugugcauuauauguacuaauacuguauaccuacaauaaaguaagcuagagaaaacaauuaagaaaaucauaaggaagagaaaauauaauuguuauucauuaaguagaaguggaucaucauaaaagucuacauccucaucaucuucacauuguguaggcugaggaggaggaagagaagaggcuugucuuacgaucucagggguggcagagguggaagaaaauccaccuauaaguggacccaugcaguucaaaccuguguuguucaaggaauaacuguauuuuggaggauguucaaauuauauaucauuuuauauaaugaacuugaacauccacagauuaugguaucugcagggggucuuggaaguaaucucccccaaaaauagcaaggaauaacuacauuauaaauaaacaaaggcuacaauuuaauaaauaggcaucuacccccaagacauuagaaaaagaucagcaaaacuaagauuuucuaaaugcuuuuauaguauuuuuaaaauuguuacuaguuuauaggaaaaaugauuuuuguauauuguuuucauauccagaaaauuugcuaaauucucuuuucaauuccaguaauucaucuuuggauuuuucuauauauauaaacacaucauauauauauauaaccaacugagaauggcaguuauuuuuuuccuuuccaaucuguguguguguacguguacauauauauacacauacauauauaugcuauacacauauacauuuggccuuacuauauugaccaagacuucuagucuauagcugaacagaauggugaaaauagcauaacugucuuuuuucugauuucaaaggaaaaucuucaauacuucaacauuaaauaugauauuugcuggugacauucuaugcucuuaccacaagggacagcaaaccauguccugugggccaaaccaggccugcugccuauuuuuguacagucugaaagcuaggaauaauuuuuacauuuuuaaaugguugaaaaaaauguuuuaauaaaauuuugaaacacaagaaaauuauuugaaauucuacuuucuguaucuguaaauaaaguuuuauggaaguauaggcauauacuuauuugguuuuuuguuuuuuguuuuuuugagacagagucucacuuugucacccaggcuguagugcuggcgcaaucuuaguucacugcaaccuccgccucccagguucaagugauucucgugccucacccuccugaguagcugggauuacaagcaugugccaccauuccccggcuuauuuuuguauuuuuaguagagacaggguuuugccauguuggccaggcuggucuugaacucuuggccucaugugauccaccugccucagucucccaaaguacugggauuacaggcauaagccaccacacucggucuuguuuuuuguuuuuuuuuuuuguuuuuuuaauguauugucuauggcuuacauacugucuuuguaucacacuacagaggcagaguugagauacugggaaagagaugauacacucucaucacuuuggacugcuucuuaguacauuacaauuuucagugacacaguuacaacuugacagaauuuugagggcuaucuguauuaccauauagugacauuuuguuauuauuuuuguuuaccaauguauauauuaauacuggacuuagaauguuacauuuuuaaggcacaauggagcauggacuauacuguuauugaauuagauggcaaagcauuagguuuauuaugcaaugacacuguagcugugcuaaaaggauacaaauauacauuaccagacuaagcacucaucacaauuuuuccaacucacaggaaagcucagaaaaauuagaaaauuuaaaacagaauaucucaucacagaaguuauucacaaauuuaaaaauacaaugagguugcaagagaaguaaguuucugagugguugauuuguuagccaagcaaggaaagcuacuuauugguaaugaauuacuuaaaucauuuugaauugcagcagcuuaagaaauauguccagagaaaacagacuuguuuaagacuguuagccuuucugugagaacaguugcuccaaaaguugagaauauugggaacacuaccaauaauuaauuuaaaaacacgacaaauaauuuugagugguuuuccuugauucuucauggguuaacagauguuacagauacuacucaauuguuuauuuggggagucaaugcaaagugugaagugacaagaauuugcuuuuaugaauagucugcaugaaacaacuagagacaagaauauauucaaaaucauugagaaaacacuaauucaaugcaaccuaaauuggaaucugcuaagaugaauuauaacuaacugauggugggaaaaaaguauguauagaaaaaauggcuuaaagaaauuuacacagauuaugaaaacguaagggguuuaaagccugugcuuauucauuguauuauucuuuagcacguacuuagugaagaaaaaaauaagacucucucguuuuuuuuaaccaauagcauuaauggugaacuucauuugcuccuguggauuuaacuaaccacuuucaguucugugaauuuauuuuuuguaguuauaacagcugcuuuaaugucuuuuuauauuauuauuaugcuuugaaguucuaggguacauguguacaaugugcagguuugucacauauguauacaugcgccauguuggugugcugcacucauuaacucgucauuuacauuagguauaucuccuaauguuaucccuccccccuccccccaccccaugacaggccccggugugugaugucccccuuccuguguccaaguguucucauuuuucaauucccaccuaugagugagaacaugcaguguuugguuuuuguccuugcgauaguuugcugagaaugaugguuuccagucucauccaugucccuacaaaggacaugaacucauccuuuuuuauggcugcauaguauuccaugguguauaugugccacauuugcuuaauccagucuaucacugauggacauuuggguugguuccaagucuuugcuauugugaauagugccacaauaaacauacgugugcaugugucuuuauagcagcaugauuuauaacccuuuggguauauauccaguaaugggauggcugaguggaaugguauuucuaguucuagauccuugaggaauugccacaccgucuuccacaaugguugaaccaguuuacaguuccaccaacaguguaaaaguguuccuauuucuccacauccucuccagcaccuguuguuuccugacuuuuuaaugaucaccauucuaacuggugugagaugguaccucauugugguuuugauuugcauuucucugauggccagugaugaugagcauuuuuucaugugucuguuggcugcauaaaugucuucuuuugagaagugucuguucauauccuuuucccacuucuugaugggguuguuuuuuucuaguaaauuuguuugaguucuuuguaaauucuggauaucagcccuuugucagaugaguagagugcaaaaauuuucucccauucuguagguugccuguucacucugaugguaguuucuuuugcugugcagaagcucuuuaguuuaauuagaucccauuugucaauuuuggcuuuuguugccauugcuuuugguguuuuagacgugaaguccuugcccaugccuauguccugaaugguauugccuagguuuccuucuaggguuuuuaugguuuuaggucuaacauguaagucuuuaauccaucuugaauuaauuuuuguauaagguguaaggaagggauccaguuucagcuuucuacauauggcuagccaguuuucccagcaccauuuauuaaauagggaaucguuuccccauuucuuguuuuugucagguuugucaaagaucagacgguuguagaugugugguauuauuucugagggcucuguucuguuccauuggucuauaucucuguuuugguaccaguaccaugcuguuuugguuacuauagccuuguaguauaguuugaagucagguagcgugaugccuucaguguuguucuuuuggcuuaggauugucuuggcaaugugggcccuuuuuugauuccauaugaacuuuaguuuuuuccacuucugugaagaaagucauugguagcuugauggggauggcauugaaucuauaaauuaccuugggcaguauggccauuuucaguucugugaauuuuugccagauacagaagcagaaaauccugacuugcacuaacacagcaguuaaauggcuuagcagugguuaaguuuuguugugauuuucugaucucagaaccaagauugaaauuuuucugaauuaagaagaauugaucucugucuuucuuuugagacggagucuggcuguuucccaggcuggagugcaguggcgcgaucucagcuuauugcaacuucugccucccagguucuagcgauauuauuaaacacugaauggauuuggaaauuagcuucuacugaagacucaauacuguuaccuaaugaauucaaccuaaaauuauaaggcaaaagcagcacaauguaaugugaaacuuacauugugguaaagucauuugaacaauuaaugcuauuugaauaacaauaucaagcugcuuuauacacuucugugcuaucaaaacuuaaaacaagaagugaggucuccacugccacacaaaucugcagcagauauuuuuuggagcuuaauuuauagcuuuagcaccauacguuggacuauccuccuuuggcaaaugcugggucuugucugucccuugugcuccaagacaaagccauaaacaaaggucaaguuuacccaaaggaaaaaugccuucagggcaaaaagcggcuuuggcacaaugccccuaaaugcccauuuucuuucacaaauuggcuggauagcuccucacuaucuugucaguucuuugaagcuuuuaaggugauugacauuuuaacuaauaucuuuaguuguuuucauuggaaguuguuuuauuccaaauaaauugcccaccaauaacaggaacaguagucugaacaauuacuuuuuaaagaaacaauuguccuauuggcagcagcuagguggcacuugguaauagcaguucuacaaugaaaggauuaugaauagcuccuagcagagcacagagugagguaagguguagcccccacaguaaguuuacagacauaugaccuaugccaucucccaucccccaaaaauagacuggcacaaugacaguaaauggcaugacugauuagcauaccauaaaaaacaucaguaauuaucuggaaacaauuagguugaguccccaucuuacuucuuacacuaaaggaagcuuuacauagauugggaguuaaacauaaaaauauaaccacuaauguacuggaagaauauauugaaaauuuuuaaaaaauaauuuuggggaagauuucucuaugauacaauccuagaagucaugaaagaaaauacugauaaauucagcuauaugaaaaauaacaacaacaacaacaagaauuuuugcuuaccuaaaacaaccuacacgaaguaaaaaaaaaagcaaguaacaaacuauugaaauuacuugcaauuuacauuauaggcaaagaguuaacauccauaauauauaaagagcugcuaaaaguaaaggagaaaaagaucaacaacccuacagaaaaaauggcaagaaauguggaaaguuuacagaaaggauucuagggaaccaccuaacuuuuaaaauugguaaauauagggaaagaauuaagcaccuuucugccuuuauuauaaccaggauaaacaaauaauugaugagaagaaauucucuuuauagaaauauuacagcuaacaaaugaauaaugagugguaaauguaaguauuagaaugccaccauuugaaauucuuauuaaaaugauagauuuaggccaugcauucucaacgggggcaauauuucuugaaagggguuaaaaaugaauucuuagggguaaaauaucuuaaauauuacaaugguuugcauucucuuaaggggccacaauacaaaaagagauacauaguugucuguggucuuaaaauuucaaagacagggugugaucaagaaaaaaaauguaagaaagugacaaugaaaaaagguugggaaauacuaaucuagacgauaaucaucaauggcugcuacuagaaaaaacggagacuacacauuacauaccaucaagcaggaguacaucaccaccuaggaaauauccugaaaauucauaacuguaucucaucaaaccucuaaaucuaacuaccaauuuacaggauacagggaacacagacuauguuaaaauacacuauggguaugcaauuagccaaauccagaaugugggaaacgcugaauaaacuguaagaagaacaaaaagggaaggaagaaagcuguagaauaaaagagacugaaaagacauaucagcaaacgcaauauaugaagcucauuuggguccugauuuuaagaaaucauaaaaauauuuuaugagacaaucaggaauuucuauacuagcuagauacagaacacugugugauaacaguauuguggugauguuugagauaucuuuuaaagauacaaacagaaauauuuacagaugaaaucagggaaaaaaaagacaaacugggguaaacaaaucucaauuccuaaauuugaucagugguucucaaacuuuugaguauaucguagucacuuggaaggcuucugaaaucacaaaucgcucaauuucugguauuagguccuguaaaaggccugagaauuugcauuucuuacacauucuuagguaaugcugauguugcucgucuaggaaccacacuuugagaaccacuaucacagacaagguuucuaauuucuuuaauauauaaacagguaucauuagaucuuauuuaaaaucaaguagagaaaaagaccuaugaacuaacagaaaauaggcaaacagcuugaacaggucaaagaaaaaaauguccucuaaacauauaaaaacauaacaacccucaauauaagagaaauacauauuuucaaauauaacaagguaucauuuuucaccuuuugggauuauaauuaguucuguuaagggugugagaaaacaggcacugguaauauauucacaauagguguauaaauuguugcugccucuauguaaggccuuaucuaucaaaauuuaaaaugcacacauccuuugacuacugcuaaacauuuaucagagauauucauacauguacaaaaugacaaauguauaaugauauucacugcaagcccuguauuucuaaaauacacaaaacuggaggaaacuaaucuuccaucaguaauggauuaguugaauaaauuacaguauauccaugcagugaaauauuauauuccuguuaaaaaggaggagguaguuuuguacauucugauauggaacaaacuccauaucauauauuuguaagagaaaaaauauuacuaauaauucuauuaauuuucaguauuacuuauguucauuuguuauaccaugagcuaauaaaguuuuaaucggaguauuuuuucuuucuuuuuuuuuuuuuuuugagauggagucucacucuguugccaggcuggaaugcagugccaugaucuuggcgcacugcaaccuucgccuccuggguucaagcgauucuccugccucagccucccaaguagcugggauuacaggugcccgccaccaugcccagcuaauuuuuguauuuuuaguagagacgggguuucacuauguuggccaggauggucucaaucccuugaccuugugaucugcccgccuuggccucccaaagugcugggauuacgggcgugagccacagugccuggccauguuuucuuuauguuuaucuaaggauacauuccagccuauggaauuaguuuauaauuugcuuaccugaccgaacgaucaucacuuccagucacagccaaagguuuaguaggauggacagcaagugcccaaaguucaccuucacaaugcccuugcauaauuagaaaagguuuauuucuuucuugcaccacaauuucaaaaauuucacuguccuguguuccaacuagaauguggucaccucgccaacacacacuccuuacagacaaaccuaguaaaaaguaaauuguauuuaauauauaaugcuguaauaaugauagcagcaggaggcagacaaaucccuaugcagauaggggcaagucccggugaaagccaaccuucaaaccuaagacaguuuaaagccugaaagccaagcuacaagucucagauaaauccauggaccaacugagaacgucucuucccauuuggugcacuuuccucugauugauccccaccuuucacuuacuuuacacauauuuauccuucccuaauuuuuuuuuauaguguugugcccaucuuugaggggugcuuuuuuuaagccuuuuuuuacucacaaacccaucagcaugcaaucccccauucugagcccauaaaggcuccagacucagccauauuuggggacugcccaccuuugggugggggguugggggcaggggagacuaccugacuucaccccaucucggguacccucuccauugagagcuguuuugucacucaguaaaacucuuugccuugcucaccugccagcugccaguauaacuucuuucuucuuggaugugggacaagaacuuggaacucaccaaacagugaguacagacagagcuguaaccaugcagcacuccccuccuacucaccaagcaacaggagagggagccgcugggcaccacaugcccccauuuauugggcaggacugaaagagcuauuaacaugcuguaacacccccuuuggggcuucagggccgcuagaguccccaaguuuuuuaggugccaccacauucccuucaaccagacgccaacgcccaaggcagaagcaggucacagcacacccggcccagccacaggcugagcauggauccugcagcaagugugggauccagccagaguauaagccaagcgcagccugccaggccaagugggcaggguaccuccuggcgagccuggagcccagugcagcccgggacaggggcauugcgcccgccauggaggucuccagcuggcaagguagcacccaaaauauccugugucaauaauuccaaucuuccuaaauugaaguuaauuuuguaccuuuuauaucuuagaugugagacagaagaaauauguaaguccuugaucuauacucacauuuucuucaauuguccauguuguuuucuacaugaaauauuugucuuuuuauguaccuaguuccuacccauccuucaagacauguacucuucuuccuucucccuuguagacaacucuagccaugucuacuugcucagccagucuuauaacacuucagucugcauuguucaauaaguacucaauuaguaaauuaccuuuauagaauuguauucuuuuccuuuuaauaaucuuuuuacuugucuauauuucuucaauauacuuauaauaucauuaaaaagagagaauuuuacuuuuucugccuacuccugaaugucuuuuguaaucuuaggaaagcuaccguguuuuucaguuuucucauguguguuacauggccaauauaaagacaccguguaccucacaauguucuugugaggaucagauaagaaaaagucucaaauuauuuuguaagcuuuaaagcacaauaauguuuagcaaaacuaaugaaaauaaaauaccaauuaacauuuacaugcuuauuaugugcuauccuuauaaacauuugagaaauaucaauucauauauaggauccuauauccuaaauaauauauuuauucuuauucuccuuauuuacagugaggguaaauuaccagcccaaggucacacaacuuguaggugacuggaauaugguuuaaacacaaaccuguggguagcuuuuauaguaaaagguccuguuuuauuacaucaauuuuuuuuaauccccaagagaaaaaaaaaaaaucccccaauugcugacaaauuugggugaaggaaaaauacaccuauccacauuuaaauuauccugaacaaaaguuucccaacccucaauauuuacccccaacuguuuauuuagaauaguuuguuaaauaguuauauuuagcauucuaauaguaaaauacuuucaaaauccaaagauaccuaagugaguaccucucacaucucucuauaggucccauuauaauagauauuagacuuaugaaagaaucuuucuccuaacaaugaaccuaaacucuuuacaggcaaaauuucuccuuaauagaagaauuuuaaucaaaugcauacagggugaagaggcaaauauaagucuuauuuauauuuacaaaacuuacauuuauacucacugaaagaaagagauaaucuuugggaaguuuagaguuugccuaguaauaagacauuuguuuuguuauuaccuuuguaucccuggucuguuucccugagaucaaucacaguaauugguuuaaaaguuaaaucccaaagacgaauacaaccaucucugccaccaguagcaaagccuucuucacaagcauucaugcuaaaaauuccugccuagaagaggaaauaaaauaauuuaacgacaaauauuuuuuaagaacaucuacuauaugaagguagaaacccuuuuaaaccaauuuaacaauauuuugguaggauauaagaauaaacaaauacaucagaaaacacaaaagaaaaucuagaaguaaguccauaagaacuuaauacaguugccccuuguggauuugaacuucacuggcucacuuauauggauuuuuucaauaaauacagucagcuguguauccacaguuccacauuagcaaugaaacccagaucaaaauacaaucuuugugggaugcaaaacccauagauagggagggcuuuacauaugcagguuucccagggcaagacuugaguauguguagauuuugguaucugugguucuggagccaaucccccccaaaauaucaaggcaugacuauauauaaccaaggugguauuuaauuauauggauagaacauaaaagaaaauaaauuuaauuccuauaccacauguaaaaaugaauuauacaugaacuuaaaaaauaacuauuuauaacuaaauauaaaacaagaauauuagaaaaauucagaauaacauuuagguaacuuugggcugugagagacuuuucuaggcauggcagaucacccacaaguuuuaaauuuguucauaugagaaaagauguaauaagcaaagacaaacagauuggagaaauauuugcaacauguaugacugucaaaagauuaauaacccuaauauucaaaugaauaaaggaaagaaaaccaauucaacaaccacaaaaaauuuaaaaaguaaaaaagaaaaggguaggaaaacccaauuaauagaaauguaaugcacugaggacuuuucuacacaaagaucuugcuguuaacaacauggcagcuuugugcuaucuagcucccuuuacuuuguaagggggacccaaacugcuaaaaagcucaaaccaaaaaacgcuaagaauuuaaacagcagauuucuuuuuaaguuuaguaaguuauuuacacgaaaauuuaauugccucugguaaauuagccucaagagcacuagcuuuauucuggugugguuaaucuagaauacuuuuagauugaagucaacaagcuuuuuuucaacacuacucuucagaaagacaccauacuaaagcaauagcuuuaacaagauacuaauuauacuaauguaauaaauaucaaugagucuaauugauuucuucauugaaaucuugaaaacaaauagauaauucaguuagaaaagcauuuucaagcaaccaaacugacuagaaacaauauacuauauuacgcagucuaucauucuaagacaagguuaaguaauacacaugaaaguguuuaaaauacuuaaauguacuuacagcaugggcuccuuguauuguucguauaagauugauuccuuuccaaacauauauauccccauugagugcaccagaauauguuaauucaucccuugcacaggcuaggcacaguauugucugaaggucacccgucuuaccaaagacaccucguuuuggggucagagcauuuccacauaaacuccagaacuaaaagguauauaguauaaucaaauuaccaaagaauucuuauaaaauaaaguaaaacauucccaauacuuugaugcuauauuagagcagugagcuaaaaauuaacuaagaaauugccuuaugauaaaauagcauucaauguucagauucucauccuagugcugucaaaagcuacguuauagcauagcuauauagucacugguuucaauucuuaucuguaagaauaagggguuugaaucagauuauuuuuaaaauaugcuaugcuuuccuuagguuucugaaaagaaaucuacauaaaacuuagauuaagccaggcacaguggcucaugccuguaaucccagcauuuugggagagcaagguaggcagaucaccugaggucaggaguucaagaccagccuggccaauauggcgaagucccaucucugcuaaaaauacaaaaauuagccagguaugguggcgcaugccuguaaucccaguuacucgggaggcugaggcacaagaaucgcuugauaucaagaggcagagguugcagugagccaagaguguaccacugcacuccagccugggcgcagagugagacuccgucucaagaaaaaaaaaaauuuuagguuaaaaaguugggaaucgguuagcaaugaaaaugaagguaagucaucauagacuaagaagaagaaaaaggaccaaaucuaacauacucucucugauagaaacauuaaggauaggaaaaaaagaguaugcuacagcucacgguaacugcagcucacuguaacuauaauauuugauauuuucaaagcugagcaauugcuuugcuuguaaagcuuaaaaaaauaagauagauguccauguggaaugauuuguucauucuugggagaaaauaagaaguuaaccaugaaucuucauuaccagggcuuuuguucuauuagguggaauuagguaaauuuuuauaguucacggagagaaauuuaaagaaaaaggaguuggggggaaguggacacaguggcaaacgccuguagucucagcaacuugggaggcugaggugggaggaugguuugaggccaggaguuugaggcuacagugagcuauaaaucacaccugugaauagcuacugcacuccagcaugggccacaugguaggaucccaucucuaaaaaauaaaccaaaaaaaugggacagggcagagauacauacauuaaauaguucugcauaaagaaauuaggcccaaagaaaaaauucaacuuuguaauaaguaauuaacauuuaaaauaauuuauuaucauauauucuuauuuuaaaauuugaagccucaaagaacuaaaaauuaugaucauuaucuauucaaagaucuaaugaguacuuuaauuaaacuuuguaauuuuuaaacuuaaaaucuccauaauuuguguacauaaguggcuuguuuucuuucuuucagcauguccuaauuugaauccauuauuuucuucuagaucagugauucccaauguuagcuucacauuagaaucaccugggaaaucauaaaaugggaugccuggacucccaauugagaugaacugagacagaaucucugaagcaugaagcccagguacccaaauuauuuugaugcucagcaaggguuaagaacuauuguucuagaauccaaaucaauauugaccaauagaaauuucagugaugaugaaaauauuacacacacacacacgcuuuccaauacaguaaccacuacuagauacauaagcauaugaaauguacugcuagugugacugaggaaaugaauuuuaaguuucauuuaacuaauuuguguuuaaauagcuauguaugguuggacagugcaguucuagaucaucucugggaauuaauuuccucacauguauugccugcaaagagaacuauguuacuauucauuucuucuagcaaagggaaagaaauguaacucauuauaaaaauauaguuuauuuaguuugagauaagcuuuuuauaaaaaccugaaaauggagccuuuagcuuuacuuacaauauaaaauaguaagaucuccuuauucauaauuaauuugccaaucacuuauuaagcacuuaauauauaucaaguaccauaucaaacacacuguccaucaaagaugaacaagacaaaaauaccuucacagugcuuauaucaugugccuuaaagcccagcauacagccuuuuugguauuaaauauuugucaaaaaauaaauauuuacuacuauccaucaaucaaaucaauaccagaauaacaaaucaagaauugcagcagcagugaaagaugcacuggagaaaacguggauggaguuaggcauauugaaauaaagaaugugaacacagaaccuuaauuaauucacuaggaauuaacuguuaccaggaacuguuacaucagacaguggaaguaaagcaaguuaauuccaauuuguuccaaugauuuaaaaguaacuauaaacauaauaaugaauaucaccacugacuuuacaggcuucaaaaucugagcuguaauuauaaaacaaaacccagagcuuucauaagcaaaguaaauaguggcuaucaaggcugagagagggacaaggagagauuuguuaaaggauacaaaauuguaacuagagaggaggaauaaguucuacuacucuauaccacuguagaaugaguauagguaauaugaauacacaguuucaaauagcuagaaggaggauauugaaugguccuaaaacaaagaaauagcaaauguuugggaugauagcuaauuacccuaaucugaucaccauacauuuuuauguaucaaaacaucacuauguacccaugaauauguacuaucauuauuugucaaaaaaaaaauuuaaaggcugaggucaaaucagggagcaaauauagaaaaaggaaaagcaacacuuucagaaagcagaccauguguuaggcacuaugacaagcacuugaauauacacugccgccuuauuuaaucaucaauucuuugaggaugguaacagcagucacaguuuuaaaaugugaaaauaaaagcucaaagagguuaaauaacucauagcagguuaaacagcuaauaaauggcaaagccaggucuacucauguugcuucucccacaccauucuauguaaaugaaaaacucuucauuucuuuccuauucucaacauuuuacuuuguaagugaaacaugaagaaacaggauggacacaguaaauccugccucacuagacuacagauuucuuuauggaauguggcuuauuaauuuccuauucauaccuauauuccuuacaauaguucaaagcaaauaauauauauauuuguuugacugaacauaagaacaauaaaaacauugccauuuuaaaaauaaguacuaucaaaauucugaaaguaggcuaaauuguuaacagugcaauauauacuuagcagcagagaacuaaacgugacuauuauaaaacaagacccuucuaguaccuugauauguuuuacaccacagcugacaaguuuauuuggcugguacaaaucccaagaaauaucaaauaucuguaaacaaaucagauucaugauuaaaauacuuauuuccagaaucauuuaaaaauccuguccaaaagaccaaauggcccaaacuccuaaucauaaaauaauauuccucaauaaauaauaaucaacaucccacacuucaaaaucuuaugagaaauaaaguaaauuugaaaaugauaagaaauaaaaagcauuucuucauuucuaugaacuucaaacacuacuggaguaaaauuuaacaccucuguuuauuuuuaauuuuuaaaaaaauuugguccauaaauaacaagaaugguugaacagaauuaggacacgaagggaggugcuugcauaauuucuacagaaaagagauucagaauggaacgugacacuuacacagccuagaaauaagaaacaccuuuauagcuuucuaucacucagaacuguuuacauaaagaauccaaacacugauuuuacaguaauuuuuuucacuguuuaaaggucaaaguuaacucaaauuuuggggagucuccaggcuucauuauuuucuaaaauuccauaaauucuaaauacaugcaaaacauuuuguuacaaaagcaaacaagcaaaaacccaggugaaauaaaauacgaaugagaaauguaauuaaacaaaugaugaaagaaaaacuaacauuuaaaaaauaauucauuuauucugcuuucugguagucgucauguuucuuugacaccuuaucaaccuaccucuaaaagguuuacauuuuugguauacuaaaauguacacuucacauuuugguauacuccaaaaauuuacaaagugaugcucuuuagugauaaugaagaaagaauacauauuacaguuaauauuuaacaacucaccauaauacagauuauaugaaaaacauaucaaugcaacuuugaaauauucaaccacaauaauacuuucaaaaacuccauugacagugucauauuuuguaacgggucuauuuauauaaauuccaaauagucaugugcaaaaugcuuugaucuaagcagguaagaacaugccagcugucuaauaaaauauauccaacauuuuaauaauggucuaaauuguguguuuguguguguguguguguguguguguguguguaauaggccucucugugcaccuacuaaaaaccaaauguauucuccaaaaugcgaauauacacaaaauuuucuacccaacuuuuagaaugauaaauucccaccaaauacagucauuggccaugccucugugcugguucagguuaggauuuuacuacauauacauacacacaaauuagacacuuuuaggaguuuacaacuuuuuugaucuacauccauaaaaauaguauaauauuuaauuaaaagcuggcuaugauguauuguuuauauacaauuuggaaugaggaauauauauucuaacaagucaucaguuaaaaauguuaggucucuaaaaaauguaauaguaauacguaauuuuaaauccacacaagcaacauuauuuuucaccuuaaccauaauacauauguaacaaauuagugguaaaccaaacuaaacagacccuaggcucaaaccauucaauuuuuaaauugagauuugaauaaugggugucugcauaugucaaacccaucaaacuucacaccuuaaauaugugcaucccuauguauaucaauuauauuucaauaaaacuguuuuaaaaaauguaaagaaaauacauuguuuuuacugaagcaaacaccagguuaaaagucuuauaccuaauguagaugauggguugaugggugcagcaaaccuccauggcacguguauaccuauguaacaaaccugcacguucugcacauguaccccagaacuuaaaaguauaauaaaaaaaagaaaaaaagucuuaugccaaugcuauacauaucaaaucauguuuccaaguccuacaauacauauguacucuaacacuuuaagacuuuuuacaucuguacaauuauuuaccaauuguaaaauuuuaauuacauaugaccuaucuggcaauaacaaaauacagaagaauaaaaucuccugaacucucuucuggucuuucccuuccaguacucauuagaaaucucaaaagagaauacuuacucuaucuguaugaccaggagccauagacaacauuuuuccccuuuuccagucccaaacacaaacugcauucuuugaaucaaguccaacugaaaccaagcgcugauuuauguccaagaaguccaggaaggaauaaaaaggcaaacaaaucaaagagaaacugaauuacaaauagcaaagaaauuauacucauggguuuuuauaaacauaaaacauauaugccuauauuuuauagaccucauaaaggcugaauguauuucaccuuguuaguguuuccacauauguauagaucuucacauuaugaaacagaagagagacuuccauuucuaacaguaggauugacaaaauauccuaaauauaccuccuaccaaaaacuaaaaauacuagauaaaauguaaaaucauguuuuuaaauggacugaugagcugucgaaaaauuaagaaauuuuccagugggaaaccuggaggaugagaaaacaccuacaccuacuggacucuaaaggcaucgggugaauacuuguaccccugauuucugugcugugggcugaggaagauaggagacaaagucuagggccuaccuaagguggggauuugaauugcagaccgccucugauuaaagcaguaaaccucucggaaacaacaaauaaccccuuccuaaagaagcggaggcaacucaugaagagggagaaacaccucccugaacauuuguaaccacaagcauccuucacaugguugcuggccuaaauucucauuaaacaugaauccuucaacuaggaaauuuaauucaaaguagucuucaggguuggcugugucuucaagcaacuucaacaauguggcccaagcaaauauaaauccuaaaugaaguaccgcaacuuugaucuaucccucaaagaauuccuacagguagcaauucaaucaaaauaagcuaaacaaacaaacaaaaaaaaaagggucaggugcgguggcucacacuguaaucccagcacuuuggaaggccaaggcagguggauugcuugaggccaggagauugagaccagccugggcaacacguugaaaccccgucucuacuaaaauuacaaaaauuagccaggcguggugacucacgccuguaauuccaucuacucgggaggcugaggcaggggaaucacuugaacccaggagguagagguugcagagagcugaggucguuccacugcacucuagccugggagacagagagagacucugucucaaaaaauaguaauaauaagcugaaaaaauaaacaaaccaccccacccacacacacaaacacaacaaaauaagaaaccaugagugagaaugggcaagucacaacaaacagcaaagucggccuugcaaaaaacaucagauauggcauuauuaguuaaauaacauaagcuuaacgugagaaauaagcuuaaugugcgaaauaaaauuaaggauucaaaauaucuguauaugagcaaagaauacgagacuauaaaaaguauccaaggagaccugaagaagcaaacggaacuuccagaaacaaaaaauaaaauaaguuaaaaauucaauggaagaguuaaauacaagauuagcaggagaugaaaagacaaaguugaaaacagaaguggacagugagaccgaaaguaugagagagguuuaaaaacacaaaagauggacuucuagccaugaaggaguaucaaggucugaacuuacccuccccgacccaccccugccauaaacagcuagaaacuguacagaauacaugaaacaaauguuuucagacauuugcaacuggaaguaaagcacugugaacccugaaagaggggaaaacaaauaaauuaaguccuguaaucacccgagcuuccaucuaggaggcaauuucuagaccauggcacagaaagguggaauccaaauagagccugguagacuuacuaauuuggacaaacagagccuggaguucagagaggacaagaugccuagaauuugcagagcaggaaaagagcuccaguaaaacuaucuauaguaagauuugagaauauuaaucucugcaugcauaggaugaacucuaugaggucaugcaaagaagaaauucuagaaaaagaacaauuacuagagagcuaaaagcaaaaaauucucagagaucacaaaggguccagaaucacucaaauucucaauaaccagaaugaagauaccucuuugaacucgcugggcagucauuaggaauccugaggucaggaggagagugucauaccuuaauagugaaauuauaccaguaauucuagagcaaaagcuacucuagugcugccucaucaaaguuugaaagcaagcuuuucacaaagaugaaacugauucaugaggaacuugacuauuugccagaacaguguccauauacuuuaaaaggauauaauaaaauuacagguaugugaagaaacaggaaaaugugacuaauaaccuggggaaaaucacucaauagaaacagacucaggaaacccagagauaauuaaaauuaggagacauuugcuguuaaaauuaacauuuucaagacaagaauuaucucaaacauaccaagaauaaaaaaagauauaaaagaacaacacagaaaacuguuacauuaucuaaaaugaaaauuuacuccaaaggauuaacagcagcucagacaaugaugaaaagauaaauaaacuugaagacacagcaauagaacccauccaaaauaaaguacagaaagaaaaagaaaaaaagaauugacagagcuucaaugaccugcaggaaaauaucaaguggucuaacauacagguaaucauggcucuagaaggagagaaaagacagaggaaaagaaaaaaaaaaacugaagaaauaauaguaaaaaguuuccuaaauugaugaaaccauaaauccacaaauuuaagacguucaacaaaucccaagcaggauaaucauucacacagaaaaaacacacaagacacauggcaaacaaauugcugaagccaucgcuaaagggcaaauucuaaacagcagccagacaaaaaaggacaacugcuguauggaggaacaaagauuuaaaaauuauccuagacugcucauccaaagugauguaaguuagaagacaauggacaaacaguuuaaagugcugaggcagaaaaaagucagcacagaauuguauacuaagcaaaaauauccuuugaaaauugagucaaaacaaagucuuuuucaagcaaacaaaagcugagaaaaugaaucaucaguaaaccugcacuacaagauaugaucaugaaaguuuucucaugcagaaguaaaaugauaccaaauagaaacaacuuacacauaugagaguguccaagugguuaaauauguaagauuuuucucauuaaaaaaguuuuaacaacuauuuacggcaaaauaacaguuauuaugggguuuucaaaauauguagaaguauuaauaaauaaaugacgauagcaccauaaacagaagaaaggaaacagcagaauauacuuuuucauauucuuuccaaauauacaugaaauaucaugaagaucacaaaaauuuggauuacaaagugucaauaaauuuuaaaaaauuaaaauacagaguauguucucugacaaaaacagaauuagaguaacagaauguuauccagaaaaucucccaaauauuuggaaauuaacaacauacuucuaaguaacugaaaggucacagaagaaauaacaagaaaaaugugaggaaaaacccacaacacauacugugaaaaguacugguuuagagcaggggucagcaaaguacaacucucaagccaaauccugucuguaccuauguuuuuguaaauaaaguuuuacuggaauauagccacacucauuccuucgugcauugucuaugacugcuuucacacugcacugcaaugcagagcugaguaguuauagcaaagaccaaauggcccacaaaguuuaaaauauuuacuauuucacuuacuauagacagcuuaucaaauggugguuuggagcacagauucugguagcagauugccuagguuugaacaucaucucuuacuagcagggugacuuuggacaauuauuuagccucccuguaccuuacuuucuucaccuauuaaauggggauauaaaauuacuucacaggggucacuaugagaaucaacauauacacuauuuaaaggaguuagagugccugauauaugguuaauguuauuuaauguuugcuucauaucauuauuauuauugcuauuaguuuacuauaaccauaguuaaauggggacaaauaaaaauaccucacagggguuacugugaaaauugacauauguacuacuuaaaggaguuagagugccugguauaugacugauguuacauaaauguuugcaucauauuauuauuauuacuauuaguuuaccauaaccuuaauuagcuuuaagaaccuacgcccucuaacuguccaaaugagaaaugccaucuaguacccaguuacaauuucugaaaagaaaguuuuacuauuuaaacuccaaaauugguagaaugaauaauuuauauaaaaagauacagaauacaguuuguuaugacucuccaucaaaucaagcuagcagaaagcccagagaacaagaggagauuauuuguaccuccugagaguauuuacuauuugggaaccaaagggcaucagcaaaaaucuagcuagaacaaauguaucuaccucuugcuaucagaauacuguguagagguuaaaauuucacaagacaaguauauuaagugaggaauagccagaggggcacugcuguucuuucuacuaaugucuccucugucugguauagcucaucaaauacacacagcaaaacacaauuggccaaaaacuuuaaaauuccauguauccaaauagagccucaauacaucuaguucugcaacuacaggcaauaacaaacuagacuugagaguacuuucucuguaggcuugauaaacauaucaugacccaaaccaacaucccuaugcauagauuacgcaacaacagacaggacaagguagaaaugacacagcaaauacuaccuccucuucuagcuuuuuaucauuuuuuacuuuaucauuucuuuuaacccagacuugguaggugagaaagagaauaaaguuuucaagcaaaaguaaugcuuaauccauuaauuggaagagagagucagagacaguuuguagaaaaguaauaguacauuucagaacaaaggaccucaagauuagagagaucauggugcuuucaagagagugccaguaauucaauccaggggagggaaggagugcuaacuggaaagcggcaagagacaaggcuggagagguagggcagaagucaagaggaagaguuuuuuuuuguuuguugguuuuuuuuugauaguguucgaauaaagagagaauucaguuuuaaauguagaaaauggaauaucuacagaacauucaagugugauauuuagaguugagaagccagagccacuguuagcugauauggaaguuaaagucaugggccuauauacucacccagagaauguaaguaaagugaaaagaaaaggcuacagacuccugaagaacacugauauuuaagaagcagacaaggaaagacuccuuuaaagauaaaaauaaucagagagggagaaagaaaaccagauaaagaagccucuauccaucuucccaaauuccuaccugauccuauucccagacaaaaucuuauuuguguccauuaacugaauuggaaguauccauaaaaaauuuuagcacaucaaauauuuaaauaaggagauaauaauagcaucuauuccaaaggguuguugggaggauuaaaugagauaaugcaggcuuagcauaauaccuggcacuugguauaugcucaacaccuuuagcuauuauguuuuuaugaacuuaaaauuuuaaguaauauguucucaugaagaucucugauaaugaaauacauguacccaagacuuuuccuauaaguugcucaaaguaagugaaauuaaacacuuucaacuaguaaaagcuaugggcaugauuucuccuuggauauauagaagaaauuccucagcaaugcaauauauuacauuuagaaagggcaaauuuaaagcuaagaagaaaauaucuauauuuaauguuauagaugcuuauaauuaaaauggcuugaauuucauaacaccuuaaauaagugguuuuuaaaaauaacuuuguagguuuguuuuauaacauuuuaugcuaugaaauagguauuauuuccuuuaaagaagaaaaugaaauucugacagaacauuaagacuugaaaaauaauagcaaaaaugggauaugaauuaaguuugugcaauugccaaacacugcuauauggugauauaaaccuagaagcacauuuuuuuuccaaauaagagauuccaauuaagucuuuauagauccauuaccagaaagucaucucuuacuaauaugaacaggaggcagggaaauacuggguagaagaagguggggucccuggcaaggguuccacccucaagccuggaccccuggcccucaaugagaacaugcacuccuguuuucccacccgaauguugccuuugccaaaaucacucuggcccacaaccccaacccuguacccauaaaauccccaaacuccacuggcggaggagcaaaacagcacuguagagaaggagagaagagaagugucugcauaucaagaggaguuuggcccaggauggucaggagaagauuaucuucccacuccauccccucuccaguucgccauaccacuuagagccacuuccauugcucaauaaaauccuccauauacaccacccuucaaucuguucguguaaccugguucuuccuggacgcuggacaauccaggaugcacugggugcaggaacccaaaaaggcugucacacugacucuucacugaguuguucaacacuuaagcugcuggugucaaagaauauuguuuguaacacacacccucuggggcuccagagguuguggguaaccuuagaugcugccacaggcaagccagcacccaaaggcacucaccccagcucuccugcaaccucucaccugcaugccccacucccacaagggguuugagcugggcagccaacuaaacgagcuacacccuuguuacaaguccugcaaaggggucaagggaacucucucaucucacuaccagaaaaucacauuaaccuaugcuacucaaagaagcuauuccucagaguaauauauaaaaacaucuacuggcuaucauguucaaggggauagaacacacuguaauuuguuucuguaaaauugaggucuauaaaacuaauuuuaugaauuaaaaagcagauaacuaaaauuguucuaaaauuuaaaaugauuuuaaagucuaauuauaacauaaaacuuuuaaagauuauaaaugaacaaccugcaagauccaacuuuuuacugguaacuuuaaaguauuuuuagguauaacaauuuccauaaaagcaccacaaaaaaagcucuuggcuuguuuaacuuuuuaaaaucauugacuagaaguagaugauaauuuagaaacugauuagucaguugaaugauaauuauauccuuuguugugaacuuugauuuuguauaaaaaauaacucauaggaauuguuccauuauauucaauaaaaauauaauuuuaauagacaaccuuuaagguaacugaaaauugaaauacaggcugggugcaguggcucaagccuguaauuccagcacuuugggaggucaacaacacuggaggauagcuuaaggccagaaguuugagaccagccugggcaccacagugagaucccaucucuaccaaaaaaaaaaauuagccaggcaugaugguaugugccuguaguccuaguuguucaggaaggugaggcaggaacauugcuugagcccaagaguaugaguuaugaucaugucacugcacuccagccugggcagcagagcgugacccugucucuaaaaauaaaaaaauaaaauuaaaauaaaacauauacagcuuucugagaaacuuaauuuuccuaagauaucauccaucuguccugucaaaauacccuaucuggaaaagaguuacauagaaaaaucuguauaauaaccauguaauauuccacugaaucaaaaucacuuuggcuuucaagguaauaauuaauucaauugagaaaguucuugacaugaugaaauaaaaaccccauuguuauauaucaaccucccaccccaccuacccaccuccaccuuuggacaaauaauuuucaucaaguguccaauuuaauauuuauagauuuauaaucauuuucuauaauauaccuuaacauacaauuuagaaaaaaaugaaaaacugucacauaccuguccaucuaagucaaacgccaagcaagcuauaccauguguaugaacauccuuuaaaacugauauggucugcacaguguaugaaucccaaauacaaauauaaggcucuuucccaacuuguccuguugcuaccaacacucguucaggaugcaaugcaaggcuguaaaauaaggaaauaaauaaguaguauuauuaaaaauugcuuauacagauuuuauaguauuugguagauguaaaacacauauaccagugugaacauuagacuuuauccacuuuagacaauuuggauuuuuuaaaaauuauuuuuguugagacagagucucguucugucagcuaggcuggagugcaguggugugaucucagcucacugcaaccuccaucccgccaaguucaagcaauucuugugucucagccuccugaguagcugggauuacaggcacccgccaccacgcccagcuaauuuuuguauuuuuaguagagaugggguuucgccacauuggccagguuagucuugaacuccugaccucaagugauccgccugccucagcuuccaaaagugcugggauuauggugugagccaccacgcccagcagguaauuuggauuuaaaauaaauagcuucuauaaaaauccaugcuaacaguuacuacuucauagaauaugugauaaacaguuaaugauaagcuaauuauacccuucauaaucccugcaauauauuguguguaaacuucucaagaaaagaacucucacaagagagcaauuggaucacagcaacaaauugguagccuuuuccucauuuaguauucaccuguuuccaagccuucuuucccauuuuacuauuccuuucacuggauaaaguuagacaaaaucuuaaugucuaaauacagcauuuaguagcacuccuacuauaacacuaauucuuaaauuauaaauuccauuuuaagaaacagaaaggucacccauaauucgcaaaaaaaaaucuaugagucucuaaaaacaagacaaagaccuagcaguugguaauaguuuauguacaucagcagaaggcggggaaaauauaaauuucuauuugauaauuuuuucuauaugucaauuuacaauaucauauuugcccuugagaugaacaagaaaaucacaccuggcaucacgguggagaaucacuaaaaggggaaaauuaggaggauauuaaaacagaaucaaggcuggguguagcggcucaugccuauaauaucagugcuuugagaggccaaggcuggaggaucaccugaggucaggaguucaagaucacccugggaaacacagcaaaccauugucucuacaaaaaaaaaauuuuuuuuaaugagccagacauagcagcauacaccucuauucccagcuacuugaggggcugaggugagaagaucgcuugaacccaggaguucaaggaacccaggaguucaaggcugcaaugagcuaugacugcaccacugcauuccagccugggcuucugggccagauccugucucuaaaguaaauaaagaagauaaaauuaacagauuggaugcaggggacaaggggaagagaggggucuaagaugacucggguuucuggcuuggguauuugaaugguuuggggugguauucaucaagucagggaauacuaaagggguaaucaaugggagagaagaugagugggaauaccaggcugguucaacauaugaaaucaacaaauauggcauauuaacagaagaaaggucaaaaaaacucccauauauguuuaucucaauagacacagaaaaauuauuugacaaaacccaaucccuucaugauaaaaacacauaaacuagaaacugaaggaaacuuccucaaacugacaaaggacaucuacauaaacccaaagcuaauaacauauuuaaugaugaaagccugaaagcaaucccacuaaguaaagggaaaaaacaaggaugucaguucuugucacucauuuaacuuauuagauauucuagccaagaaaaauaggccaggaaaaggaacaaaaaguaaaaguaaagaucucuauuggcagaugauaugaucauauauacagaaaauccuaaggaauccacaaagaaacaaccaaaaaaugaagagcuaauaugaauucagcaagguugcaggauauacgaucaacauaaaaaaucuauuguauuucuauacacuagcaacgaacaauaaaaaaauuaaagaaaauaaucccacuuacaguagcaucaagaggaauaaaacauuuaggaauaaauuaaacaaaguacaagauuuguacacugaaaacuacaaaaacccacugaaggacauuuuaaaagaucuaaauaaauggaaagacaucucauuucugggcuuagaggaauguaauauuuguaagauggcaauacuucucaaauugaucuacagagucaacauaauccuugucaaaauacuaguugucuuucuugaagaaacugacaagcugauucuaaaauccagaaagacucaaaauaaccaaaacuauccugaaaaacaagaacaaaguuggaaaaaucacacuuuccaauuucuaaacuuacaaacuuacuacaaaacuacaguaaucaagacagugugguacuggcauaaggauaugcagaucaaucaaacagaaucgugaguccagaaguaaacccauacauuuguggucaacugauuucaacaaggguggugccaagacaauucaaugggggauaaaauggucauuucaacaaauaguacugggacaccugaauauauauccacauacaaaaaaauaaauuuggacacauaccucaaaccauauacaaaugucaacucaaaauggaucagaagcuaaaauaauuguuaaaacucuuggaagaaaauauaggcauaaaucuuaccaaucuugaaugaagcagugguuucucagauauaacacaaagcauuagugacaaaaaaaaaagcagauaaaauggacuuaaucaaaauuaaaaacuuuuaugcuucuaaggacaaucaucaagaacauaguaaugcaacccagagaaugggagaaaauauuugcagagcauauaucugauaagggacuucuauuaagaauauauaaagaauuccuacaaaucaacaauaaaacuauaaauaauccaauuuuucaaacaaauaaaggauuuuaacagacauacccccaaggaagauauacaaaaggcacauaaaaagaugcucaacaucaauagucagcagggaaauacaaaucaaaaaucacaauaauauaccauuucuuuuuuucuuucucuuucuuucccucuuuccuuccuuccuuuucuugcuuucuuccuuucucucucuuucucuccuuucuuucuauuuauuuauuucagacagggucucacucugucacccaggcuggaguacagugacacaaucaccacucacugcagccucgaccucccauacuuaagacucauccuccugcuuuggccucucaaguagcugagacuacaggugggugccaccacaccugucuaauuuuuuuuuuuuuuuuuuguagagauggggucucccuauguugcccagacuggucucaaacuuuugggcuuaagagauccucccaccucaggcucucaaaauucuaguauuacaggcaugagccacugcucccaguccacuucuauaaauauacauauauauacauauauauguguauuuauuuuuuuuugacacagaguuucacucucauugcccaggcugaaaugcaaugaugcaaucuuggcuuacugcaacuuccgccucccagguucaagcaauucuccugccucagucucccaaguagcugggauuacaggcaugcaccaccacgcccagcuaauuuuuuuguauuuuuaguaaagacgagguuucaccauguugaccaggauggucucaaacuccugaccucaggagauccaccugccuuggccucccaaaaugcugggauuacaggcaugagccaccgcgccuggcccacuucuauauuuuaaaagacagaaaauaugaaguauuggcaaggauguggaaaaagcguaacccuuaaacauugauuaugggauuguaaaaugauguagccucuuuggaaaaccgcuugguagcuauucaaaaggcuaaacaaaguuaccguaugauccagcaauucuauuccuagauguauucccaaaaggaaugaaaacauauguccacacaaaacuuguacacaaauguucacagcagcaucauucacaaauggccaaaaaguagaaacaauccaaauguuugacugaaucacgaauaaaaugugguauccacacaacaaaaaugacaaaaggaauaaagcauuaauacaugcuacaacauggaugaaccuugaaaacauuacgcuaagugaaggaaaacagauauauaagggccacauaucauauuaauacauuaugaaauguccagaauaugcaaauccauaaagaaaguagauuagugauugccaggugcuggaaggagaggagaauggauaaggacugcuaaugagcuugggaauuuuuuaggggugauaaauauucugaaauuagauagaagugaugguugaaaaacuuugacuauacuaaaaaucacugaauugugcacuuaaaguguacauuuuauguuaugugaaucauaucucaguuuuuaaaaagugaaaaaaaauacugacauuacugucuguacacauauuuuuaguauaaggauuuaugcaaagaaaaccuuugaaguuagacagacauggguucaaaauucuggcucugcucuucacaggcuucuuagcaaauucuuuaucuucaucuuguuuucucaccuucaaaaagggcauauauuuacuacaaguaauaugagggaaauuuccccaagcuugaaaacuggggaggaaggcugugugguggcuugugucuguaaacccagugcuuugggaggcugaggcaggaggaucacuucaggcuaggaguucaagaccagccugggcaacacagcaagaccccaccucuacaaaaaauaaaacaacuagccaggugugaugguacaugcccguagucccaguuauucagaaggcugaggcaugaagaucaccugaggccaggaguucaaggcugcagugagcugugaucaugccacuauacuccagucugagugacagggcaagucaccaucucuuaaaaaaaaaaaaaaaaaaacuggggagaaaaacuaugcagguccucauaguuuaacuacaaaaucuucauacaauagaacagagguauucaaagucaaguuagagaaaaaggauaggguggguccguguuuagauuuauaagaaacugucaguuuuccacaguaguuguaccauguuacacucucaccagcaauguaagaaaguuccaguugcuccacauuccuacuaauauuugguagugucaguguucuuaauuugaauuucccugaugacuacucacauggacuaauuggucuuauaaugaucuguucaagucuucuagccauuuucauuagguugccuuuauauuuuugaguuuucaaaguauuucauauauucucaauacaagucccuuuguccuacaugggacuugcaaauauuuucucccagacuguagcuuuucuuugcauucucuguuucucucacagagcaaacauuuuuuaauuuuuaugaagucuaucuaguucauugacuuuuguuuuauggaccaugcuuuugcuuaaccaaagguaauaaagauuuccucugauauuuucuaaaacuuuuauaguuugucuuacauuuaaagcuacaaucuauuuugaguuaauuuuuguauaaaguguaauguagguuauaguuguuuguuuguuuguuuuuugcugucuuuauguaagauuccuaacuuuccagcaccauguauugaaaagacuaucuuuucuccauugacuuccccaagcacuuuugucaaaaaucaauugaccauaucuauauuacuuuuccacaaauugcacccuguauuuuacaccauuaaccuauguaucuauccuuucaccaauaccacacugccuucaugaguauagcuuuauuauaagccuuaaaauugaauacugugaguccucuaccuuuguucuuuuuccaaauugcuuuggcuauucuaauuacuucaucuuuccuauaaaguuuagaaucagcuguauauccuauauaucuuguugggauuaugauuagaauuguauuauaucuauaaaaaacuuugaagagaagugacaucuuaauuauauugagucuuccaauccauaaacauaguacgcccgcccuccauuuuucagguauucuuuguuuucugucucauuuuauaguuuuuaguauauaacauagaccuugcauagauuuuguaaaauuuauauagauauuuuugagcuuuuguagacaguauugcuguaaaauuucaguuuccaauuguucauugcuaguagguagaaauauaacuaauuuacguauguugaccugguauccugugacccugauaaauucacugaguuuuaggaguaguguuuuuugugugaguuuuuaaaaaauaaauuauuuggaauuuucuauguaggcaaucauguugucuaagaauagagacaauuuauuucuuccuuuucuuucuauaagccuuuuuauuucuugucugauugcacuggcuugaacuucuagcaggauguuguuuuuuuaaaauuauuauuauucuuuaaguucugagauacaugugcagaacgugcagguuuguugcauagguauacaugugucauggugguuugcugcacucaucaaccugucaucuacauuagguauuucuccuaaugcuaucccuccccuugcaccccagccccaacaggcccugguaugugacauucuucucccugugcccauauguucucauuguucaacucccacuuacaagugagaacaugugguguuugguuuucuguuccuauguuaguuugcugagaaugaugguuuccagcuucaucgucccugcaaaggacaugaacucauccuuuuuauggcugcauagcauuccaugguguguaugugccacauuuucuuuauccagucuaucauugaugggcauuuggguugguuccaagucuuugcuauugugaacagugcuguaauaaacauacaugugcaugugucuuuauaguagaaugauuuauaauccuuuggguauauacccaguaaugggauucuugggucaaacgguauuucugguccuagauccuugaggaaucaccacacugucuuccacaaugguugaacgaauuuacacucccaccaauguaaaagugucccuauuucuccacauccucuccagcaucuguuguuuccuggcuuuuuaaugaucaccauucuaacucguaugagaugauaucauacugugguuuugacuuguguugcucuaaugaccagagaugagcuuuuuuucauaugcuuguugucugcauaaaugucuucuuuugagaagugucaguucauauccuuagcccacuuuuugauaggguuguuuuuuucuuguaaauuuguuccuuguagauucuggauauuagcccuuugucagauggacagauugcaaaaauuuucucccauucuguagguugccuguucgcucugaugauaguuuauaaauguauaugcacccaauacaggagcacccagauucauaaagcaaguucuaagaaacuuacaaagacacgggccaugcguaguggcucacaccuguaaucccagcacuuugggaggccgaggcagguggaucaccugaggucgggaguucgagacuagccugaccaacacagagaaacccagucucuaauaaaaauaaaaaauuagcggguugugguggcacaugccuguaaucccagcuacucgggaggcugaggcaggagaaucacuugaacccgggaggcagagguugcagugagcugagaucaugccauugcacuccagccuaagcaacaagagugaaacuccaucucgggggaaaaaaaaagaaacuuacaaagagauuuagacucccacacaguaauagugggagacuuuaauaccccgcugucaauauuagaucaaugagacacaaaauuaacaaggauauucaggacuugaacucagcucuggaccaagcagaccuaacagacauugacagaacucuccaccccaaaucaacagaauauacacucuucuuagcaccauauagcacuuauucuauaauugaccacauaauuggaaguaaaacacuccucagcaaauguaaaagaauggaaaucauaacaaacagucucucagaccacagugcaaucaaguuagaacucaggauuaagaaauucacucaaaaaccauacaacuacacggaaacugaacaaccugcuccugagugacuacuggguaaauaacaaaauuaaggcagaaauacguucuuugaaaccaaugagaacaaagacacaacacaccagacucucugggacacagcuaaagaaguguuuagagagaaauuuauagcacuaaaugcccacaggugaaagugggaaagaucuaaaaucgacacccuaacaucacaauuaaaacacuuagagaaacaaaagcaaacaaauucaaaagcuagcagaagacaagaaauaacuaagaucacagcagaacugaaggagacagagaagaaaacccuuucaaaaaaucaaugaaucaggaccuguuuuuuugaaaagauaacaaaauagauagacagcuagcaagacuaauaaagaagaaaagagagaagaaucaaauagacacaauaaaaaaugauaaagaggauaucaccacugaucccacagaaauacaaacuaccaucagagaauacuauaaacaacuuuaugcaaauaaacuagaaaaucuagaagaacuggauaaauuucuagacacacacacccccccaagacuaaaccaggaagaagucgaaucccugaauagaccaauaacaaguucugaaauugaggcaguaauuaauagccuaccaaccaaaaaaaagcccaggaccagacagauucacagccgaauucuaucaaagauacaaagaggagcugguaccauuccuuccagaacacuuccaaacaauagaaaaagagggaauucucccuaacccauuuuaugaggccggcaucauccugauaccaaaacauggcagagacaaaacaaaaaaaggaaauuucaggccaguaucccugaugaacaucgaugcaaaaauacucaauaaaauagcaggauguuuaauuagaagugacaagaauagacacucuggucuuuuuccugcuuuuacaaggaaaacauucagucucucaccaucaggaauaaacuuagcuguagguuuuuacagaugcuuuuauagccggguuaaagaaguggacuucuaguccuaguuugcuaagcauuuuaaaaauaugaauaaguauuaaauucugucaaaugcuuuuccuguaacuacugagauagucaccuggcuuuucuucuuuagcaauuauauagcgaauuacacugauuaauuuuuaaauguugaaccagccuuguauuccuggaaugaauccuaccuggaaugaaaccugguuaugauauauuauccuacugacggauuuuauuugcuuauuagcuuauuuuguugagaauuuuuacaucuauauuaaugagggacaguugucuguaguuuccuuuucuucaaauguuugucuggauuuuguauuagagugaugccagccucauaaacacaguugagaaguaguacuuccucuucuauuuucuauaagcaauuguguggaauuggaaucauuuauucuuguaaguuugguaguuuauaucuuuugagggaauaguucauuucaucucaguugucaaauguauaaguuguuuauaguaaucccuuauucuccuuuuaacgucuuuaggucaauagugauauccugaugaauacugguaauuuuugucuucucuuuuuuauucuuggucagccuagcuagaaguuuaucaaucugauccuuuucaaagaaccaacuuuagguuuuucucuauuguuucacuguuugcacuaauugucuucauuauuuccuacuuuguuuguuuuuguguuugcucuuccauuucuauuuucuuaagucagacuccuagauuacugaccugagauuauuuuucuuuuaaaaaauaugcauuuuaaugcuccaaauuucccuugaaacacugcuuuggcugaauuuuacaaauuuugauauguuguauuuucacuuucuucuucuuuucauuuucauaauauauucuacuuucccuucuguucuguguuacugauuuuuauuuugauuccauuauggucagagaacauacucuauaugauuucaauucuuuuaaauuuguuaagguuuguuuuauaauauauagccuauuuugguaaacguuuuggcacuugaaaaggaugugcauucugccaugacuagcucaugcuguuuucuaugccaugaauaauaaaguccuuugucucuaaccuaggaauuucacgucuuugccagcauccaaagaaaaaaguaacauauuaguuuguaacaaggguauuauauuaguuuucuaugcugaugucacaaauuaccauaaauuuagcaccuuaaagcaauacaagcuuauuaucucccaguucugcagggcagaaaucugguuaguguggcucagcugaguccugugcauacagucucacaaggccaaaagucaagguguuaacacaacuaaauuacuuucuagagucucuggggaugagucagcuuccaaguucauucagaacguuagcugaauucaauuccuugugguaaagggacugaggcuuucacuccccugcuggcugucaagggggaacugcucaccuccucaaggccaacugcaugccucaugauguuaccaccuccaucuuccaaucagcaacggcacauugaguucuucucaagcuuugaaucuuucugacuucugcugcauguuuucucauuccagcuaaagaaaauuauuugcuuuuaagggcucacauaauuagacugggcccaucuagauaauucaagauacucucaauaucuuaagguacaucccuaucuuaauuauaucugcaaagucaugugugcuuuguuuaacauaaaaaauucacagguuccaggaauuagaguauggauaucuuuggggccagucuggcuaccaugcagacucagaaauugaguccccuggagaauuauuuauauuuuuauauuuucaguucuaaguauuccauuuuucuacaacuucuauuucuuugcugagaacuuccaacauucuauuuguuuuaagaacaguuacuucauggcauacuguugugggaagucagggaccccgaacggagggaccggcugaagccauggcagaagaacauaaauugugaagauuucauggacauuuauuagcuccccaaauuaauacuuuuauaauuucuuaugccugucuuuacugcaaucucugaacauaaauugugaagauuuaauggacauuuaucacuuccccaaucaauacucuugcgauuuccuaugccugucuuuacuuuaaucucuuaaucucgucaucuucguaagcugaggauguaugucgccucaggacccugugauuauugcguuaacugcacaaauuguuuaaacaauaugaaaucugggcaccuugaaaaaagaacaggauaacagcgauguucagggaacaagggagauaaccauuaggucuggcugccugagagcugggcggaacagagccauauuucucuucuuucaaaagcaaauaggagaaauauugcugaauucuuuuucucagcaaggaacaucccugagaaagagaauguguucccaaggggaggucucuaaaauggccgcuuugggaaugucugucuuuuacaguuguggauaagggaugaaauaagccccggucucccauagcgcucccaggcuuauugggacgaggaaauuccugccuaauaaauuuuggucagaccggucgucugcucucaaacccggucuccugauguuaccaaugacaaugcaugcccaaaacuucauuagcaauuuuaauuucgccccaguccugugaucucgcccugccuccauuugccuucugauauuuuauuaccuugugaaguaugugaucucugugacccacacccuauucguacacucccuccccuuuugaaaaucacuaauaaaaacuuaccaguuuugcagcuugaggggcaucacggaaccugccaacaugugaugucucccccagacacccagcuuuaaaauuucucucuuuuguacucuuucccuuuauuucucagacuggccgacacuuagggaaaauagaaaaggacccacguugaguaucgggggcugguuucccccgauagcacacaguuauaacaaauguuuuacauucuuucauaaauucaacauguaggucauccuggggcugacaacuguugucuuuucuuguauaaauuguugagauuuuaguaauuuuuauaugcuaauuuucaguuauauccugagcacuucgaauauuaaguuauaaacucugaauccucuuaaaauuuuccagagaaugcugauauuuuuauuuauuucagcagacaagcaauccaauuagguucaagguacauaucccugcccuccuucuggggucccaauguuaguucaguuuuaaagucuuugcagugcuaccacauguacacacaccaaaggggcaaaucugaaacuuggaugauuguaggucaguucucaaagcgccugauaugcaggcaguuccugcacaugcagcacagaagugagucaacuauacccuuaugaagaugcccuucuugagcuccguacccccuacaauuuuccccauaauuuccagcucccagaggucccuuuucauuauacuggagcuaagagucuaggauguuagccucugcauacuaucauauacuucccacaacugggccugccucuggacaaaaagcauuuuuccuauuuuuaaauuauuugucauaauauuguuacacuguaagaguucuuaauauauucuugguacaauucuuuucucaacuguauuuuuuugcauaugugugucugcuuguggccuaccuuuuaauuuucuuaaugguauauuuaaaagagcaaaagauuuuaauuuuuuuaagaaguguuuuauuuuggacuaauuugagacuuauaaaaauguuacgaaauaguacaguuuucuuguaucccucaucacacuucauuacaauauaaacauuuuacauaaccauauaguaaucgggaagaagaaggaaauuaacauuaguacaauaucauuaccuaaacuaaaaaccuuauucaaaaauucaccauuuuuuccacuaaugucucuuuucuguuccaagauccuauccaggaucccaugcugcauuuuaacuguuauuccuccuuagcaacuuccagucucuauaaaacuuucuuagacuuuccuuuccuuucauaaccugggaacuuuugaagaauacuaaccaguuauuuuagaaaaugucuccaaauuuggauuugucaugguuucucaugauuaaagugggguuaugcauuuuggguaaaaauaccacaaaaauuacauuuguccuucuuuccacaucguaucagaagguuuagggugucaauauuacugaugauguuuaccucgaucccuugguuaaacaguacaugccacuguaaagauacuacaaaguuuuucuuuguagucacuaaguaugcuaggggagauacugugagacuaugcaaauccuauuucucuccucaaacuuucacccacuaauuuuagcaacuauuggcggauucugucaguaacauuuacuacuaaaauauuuccguaaugugauugucuuuuuuuuuuugagacagaguuucgcucugucacccaggcuggagugcaauggcgcaaucuuggcucgcugcaacuuccacuuccaggguucaagugauucuccugccucagccuccugaguagcuggaauuacaggugcccgccuccacaccuggcuaauuuuuuguauuuuuaguacagacgggguuccaccauguuggucaggcuggucucgaacuccugaccucaggugacccacccgccugggccucccaaagugcugggauuacaggcgugagacaucgcaccuggccuauaaugugauucucuuuuuucucucuuuucuucaacauuuauuaauuagaauucuacuacaaggaaguuaucuuuucuauuuauuuauuuaacccaucuauuuauaucagcuugaacucaugaauauuuuauuucaaaaguuagcaaacuuuuucuggaaagggcuagagaguaaauguuuuacgcucugugggccauacaguuucugucacaacuacucaacuggguuauuauaacacuaaaucagccauagauaauauguaaaccaugcauucccauugggagcaauaucaucuccgaaggggcaaaaauuaguucuuaaaugcauagaggucugauugcauaaagcacagaaauacauucaauauaggaacugauauauagcauaucugagcuauuaaaauuuuguagugggugagggcauugauauaguuggaucuguguccccaaccaaaucucauguugaaauguaauccccaaugcuggagguggagccugauaggagauaacuggaucaugggguagcuucucaugaaugguuuacaccuuccucugggugcuguucucaugauagugaguucucaugagaucuccccaccucgcuuccuucuacucuagccaugugaagugccuugccuccccuuugccuucugccaugacuggaagcuuccugagccuccccagaagcagaaacugcuaugcuuccuauacaaccuacagaacugugagccagcuaaaccucuuuucuuuauaaauuauccagucucagguauuucuuuauagcagugugagaauggacuaauacagguguuuagagaaaagacaauaucuaaaagggcuccuuagggggcaguaauagaaaugcacuuguaaaauacugagguaacaaauagucauaucugaauucaauuaaaaccuuauuuacaaaaaauaggugacacgccagauugucucaacuaggaaauauaguuauguauacuaacccaugcauacauucuauagucuguauacauagauacauucuguaucuaaguauuugaaaaucaugaauucguaucaacacuucagauucuaauccgaaaccacagggcucauuuaagacuucucccuuuauuuauaacuucuuacuccaagagugagaaacuaggcucucauaaucuauggucuauuuacuuuaguagacacaaagacaguucagaauugguagcccuguggaggacaauuuuacuaacuagauuacagcauuaugugcaguuuuuuuuuuuuuuuggucuuuauccuuacaguuaagauacuguuaagacacuguuuuucagucauuuagguucauuguucgcaacaaagcucagcagcagaggagaggaaagagcgcuugugaaacggccgcugaaauuuguuucuuuuucucuuuuuacuuacagucauuuugcaguuuugguauucucuguuuaaguaaugcuggggcuaugguuugcacagaaagucuggagaagagauuuugggagguuacuuacuacauaccugccauugucuucacuuaccuggaggucugauaaguuauuuuaaugagguucaauuuauaauuuuacuuuuuauaauucaugcuuuuuguguucuauuuccuaugcuuuuucuagaaauuuuauaguuuuaccucucaccuuuuaaauuuuauauauggugagguauaugcugggguucauuuuuuccucauaauagauauucaguuguuuuucacaucauuuguugacaagagaccauucaguacagagaaaaaaugcugauguagguuaagauaagaacguuucugaaacagggaaaaaagagugggauccaguacacaagcagcaggauuaauauuggauaggagcugaauguauugcuuuuggacaguuggaaucugaagauucucuuccgauugguccaauuuucuuaaugagaaugaaagcaugaguguuguucagguauccuucagguuaacuuaauaucuuacaguuaaguuucauccacauaaugccuaguauauugcugaacauauaguaaaaacucaacauuuauggauuaauuugggagacaaaugacagauguaaucaucugaggguauauucccauucuaaaacauuuaacaagauuauuacccauccauauugugacacuaucaucugaaauauauggaaagaacagauuuuuuuaaaguucuucuuccuauuaauauugcugaguaauggaaauuaauuagauauaagcacugucaucaaaucccacaauuacauauuaaguugcuuuaaguauuuaaucucuaaauuuaucauaacuauaaggaaauaacauguuaaacaaacauaaagugagcuaucaucuuccucauaaaucuccauucuuacaugcaaauauaucaauguuccuuuacauuuaucucacacaucucaaaugagcacuguacacuaguagagaacucuauuaaacacuuagcugguaaaugugcauccuuuucucaaccuccaaacucucacaugagcacaguuccccccuaucaaccucugccuugcagcagauaagccugucuuguacuuaaugauuaacauagaucgaauuaaagaagauacuucauucccaugaaauucacuaaucuaacuguacuggcagacucugacuucucuuuaugucuauacuccuugaacucuccgcuuguguucuaggucccauucuccuuaguuucaaguacuuuacuccuagaacuaugcuuucuggaauuauugcuuccucacuacugagucauuccuauuaccauucaaauauacccauuaaaaaacaauucccuugaccaauuacccaucaucccauuucucugcuccucauucaaagcaaaacuucucaaaagaggugucucaucuuuuucacucccuuuauuguguuaacauacuucaaaguaggcauucaucucuucuccuucacugaaacaguuuuuuccaggucauguaugacauugccaaaccuaaugauaaacuguauguccuuauuccccuccauuuuucaguaguguuugacauaacugaccacccacguuuuugaaagacuuuccucucuaggcuuccugacuucacaguuuaucagcccuuccuucucugucuccauugguaggcacuaucuccugcaccccaccucugaauauuaaaguguaugagggcuuugucuuggcuguuuucccuuccuuucccaggugauuucauccaaucccacagcuuuaaaugcauauagacugugauaacucccaacccuguaucucuaggucagcacaauggauacauuccucaaauuuaacucauccuaaagagaaucugauuuccuccuuaccuuuccaaucugcuccuccuugccuuaguaaaugauaucaccauccauucaauugcucagaccaagaagcuaaauuucauccucacuacuuaucuuuuccucacucaucucaugcauucuauuagccuguccuacuggcucuaucaucaccgucauuucugcuacaaucuuaaucugaaccagcauucaucuuacaucacaacuacuucgguagccuucugucuaccuaccauuauuccucuauugcuucccuuuagagcuuucucaacauagccaggugaucuuuaaaaauaacauaaaucugaucucaucauuuaccucgguaaaaacccaauagcuuccuaccgaauuagaaugaaaccugaaccaucuaagauggcacuuucaagccuuuguaagauauaccuucggccggacgagguagcucaugccuguaacagcacuuugggaggcugaggcaggcagaucacgaggucaggaguucaagaccagacuggccaacguggugaaacccgucucuacuacagacacaaaaaauuagcaaggcgugguggugcgugccuguaaucccagcuacuggggaggcugaggcagaagaaucgcuugaaccugggaggcggagguugcagugagccgagauccugccacugcacuccagccugggcgacagggcaagacuccaucucaaaaaaaaaaaagguauacccucaccuacuucucaaaccuuagcuccuaccauuuuuccuuuuguucacuacacuccagcuacacuggccuuucuaucccuuaaaauggccaagcucauuaugcuaucaaagucuuugucuggaaugaccucccaaaucuuugccgcauucauauuauucaugcuuuggggcaaauauaacuugcucagagaagcucucccuaacuacuccuagucaucccaacauauucuguccauuacucuaauuauuucauguuucccuucaugcuuacuccuucggagguaucugcaugccaguguuacaagguaggcacuauguuuuacuugaucuuuuaacaauccaguuuaccuuuaaauucagccaaacccacugcagcuacuccacgagucugcugaaaucaucaccugaggcacugggucauaguacaccucacuugauaucauacaggaugcacauaauuaugaccuuccagguucccugugagugagcauuuuucuggacugauaaugcaggauaucugucuuucgguguuuucagcucaugaugacacugaacagauccaccaauagaaaacaaaaacuuugcuugguaauaaaucuccaaacagggaauauccagcgugggagggccuuaggcaagaagcccaaaguauuuaaggaggucccaguacuuacccacauugucauauaacgcauaauaguaaaugaguggauuuggcuagguccugagguuuuuuucagguugacuccuaggccagcaccugaacauggauuacuauuaaauccagagcagugguuuucaacccugccugcauauuacaaucauuugggaagcuuaaaaauuaaaaacagaaacaaacaacaaacgauaccuggaccccaaccuaaacaaauuaaaucacaauuucuuuggguaaggcuuggccauuggugguuuuauuuuguuuguuuucuuuuaacuuucuauuaagcagccaggguugagaaucaggaaucuggagcaguguucucaaacuuuagauuauauuaacaucaccuggaggugauaaaaaacuuauuacuggggccgggcauaguggcucaugccugugauccuagcauuuugggaggccaaggcaggcagaucaccagaggucaggaguucaagaccagccuggccaacaugguaaaaccccaccucuacuaaaaauacaaaaauuagcuuggugugguggcaggugccuguagucccagcuacuugagaggcugaggcaagauaaucgcucgaacccggaggcaaagguugcagagagccgaguucaugccacugcacuccagccugggugacgagagcgagacucugucucaaaaaagcaaaaaacagaaaacaaaaaacaaaaaacaaaaccacacaacugauuacugggcucuacacuuagaguuucuaauuugguagaucuggaaugagcccagauaauucguauuuuuuaguaacuuuccaggugaugccguugcuagucugaagaccacacuuuucagaagcaacgauccagggcugccagcuaugugucauuuuuuuaauaaccaaguaaagcagaaacugcuggaacaaaucuguuuuuaagaaauguuaugaauacauaauaguuauacauuggaacgaaucuugaaagaggcuaguuuuguguaccaauaaugacaugacucauuuucucaucuucuuccugcucuuccuuuuccccugggcauacacagucuuuuggggagucuuaugauuacaauauaauuauagcaaaacuucgcuaaggugaagcaguccucaucuuauuggacacagcugauaauuccuuucucccugaaauacucucuucacuugacuuccaugaucuuauacucuugguuuuucucguguuucucuggccacauuuuugucaguucuucaucuccccuacauuaaaauguuggagugccacaggaauccauuuauuagauccuuuaucuaaacucacuccuucaguggucucaucuagguucauggcuuuaaauacugucuauaugcugauaacauucaaaucuauaccagcucagauugcuucccugaauuauagacauguauguucaacagccuaauuuaaaaccccacuugguugucuaucagauaaucucaaauagaacacuucuaaaacagaguugcuuggucaaagucaugaggccccuguuucaggcccuagcuaccagacgacauuuuuauucccugggacagaagggaaacugcugccuugaagggaaggaccuacuccuggcagcauucaccaccugcuaacugaauagcccuugggcccugaauaaccaguagcaauacccggguacuaugucaagggccuuaagugagccucugaggcuugcuggcuucagguaggauacagcacauuaucaacugugguggccauggggcgaaacuccuuuugcuugagaaaagcggagugaaaaguaaauacuuugucuuguaccuuagguaccagcauggccauagggguggguagaucaccaagugggaucuuuggguccccaauuccagaaccugacucuuagauggcauuucuggaccugcccuggggcagaagggagcccauugcccugaaaagugagucccagaccaggcagcauucaccacaagcugacuuaugagcccuugggccuuaagggaacauuggcaguagucugguagugcucuccauggccugugguggcaggcaguggcuguagggagaggcuccucugucuuuagagagaagagugggaaggacugcgccuugugguuugagugccagcacauccacaguacaacagaacaccagguagacuucuaagguuuuugacucuagucccugacucauggaugguaccucuggacccacccaagccugggggaacucacagcgcugaagggaagcacacuggccuggccggcuuuaccaccugaguguagaaccccagggccuugagcaaacauaggcaguaaccagggacugauuacagcaagccuugggcaagacaaagugcugugcugucuucaggucugacccagcaccaucauaguggugguggccacagggugauuaugucauucacccccagcuuuagguggcucagaagagagagagagagagagacuccauuuguuugggagaaaguaagagaaaugaguaagagugugccugccugguaauccagagaauucuccgggaucuugucuaagaccaucaagguggcaccucuaugagucugcaacaauuacagcauuacugggcuuggggugcccccuaaagcagauacagcuuagaucacaacacccaaguucuuucagauaucuuggaaaggcuuucccuaggacagguacaaacaagcucagauagugaagacaacaauaccuaacucuucaaugcccagacaccaaagaauaucuacuagcaucaacaccauccaagaaaacaugaccuaaccaaagaauuaaauaagcuaccagggaccaauccuggaggaacagagagauguggccuuucagaaagagacuucaaaauauagcuguguugaagaaacucaaagaaauugaagauaacacagagaaggaaaucacaauucugucagauaaauuuaacagagacugaaauaauuuacaagaaccaaacagaaauccuggagcugaaaaaauacaauugacauacugaagaaugcauccaaguccuuuaauagcagaauugaucaagcagaagaaagaauuagugagucugaagacagguuauuuuaaucagagaagacaaaagaaaaaauaaaaaacaaugaagugggucgggcaugguggcucacaccuguaaucccagcacuuugggaggucgaagcaggugaacugcuugagcccaguaguucaagaccaacgugcguaacauggcaaaacccugucucuaccaaaaaaaaaaaaauuagcugggcauaguggcacaugacuguagucccagcuacucagaaggcuaaggugagaggcucacuuaagucugggagucagagguugcagugagcugagauuauacugcugcacuccagcaugggugacagagcaagaccccgucucaaaaaugaaaaaacagaaacaacaaccaaaacaaugaaguaccccuauaagaucuagaaaauagucucaaaagggcaaauaaaggaguuacuggccuuaaagaggagcuagauaaagagacaggaguagaaagguuauucaaagugauaacaacagaaaaagauauccccaaaccuagagaaagauaucaguauccaaguacaagaaggauauagaacaccaagcagauuuaacccaaaaaagacuacuucaaggcauuuaauagucgaacucccaaagaucaaggauaaagaaaggguccuaaaagaagcaagagaaaagaaacaacacacaacggagcuccaauacaucuggcagaagacuuuacaguggaaaccuuacaagccuggagacaguggcauaacauauuuaaaguucugaaguaaaaaaaaauuuacccuagaauaguauauccagugaaauuaucccucaacaugaaggagaaacaaagacuuucccaaacaaaagcugagggauuucaacaccagaccuguccuacaagaaaugcuaaaggaagcacuucaaucagaaagaaaaggacauuaaugagcaauaaguaaucccaaguggguuuugaagguacaaaacucacugguaauaguaaguacacagaaaaacacagaauauuauaacacugcaacugugguauguaaacuacucuuauacuaaguagaaagacuaaaugaaccaauaaaaauaauaacuacaacaacuuuuuaagacauacgcaguacaauaagauagaaauaacaaaaaguuaaaaagcaggaggaugggccgggcacaguggcucaugccuguaaucccggcacuuugggagcugaggcaggcagauugcuugagcccaggagcucaagaccagccugggcaacauggcaaaauccaucucuacaaaaacuacaaaaauuagcuggacaugguggcacacaccuguagucccagcuacucaggaggcugagguaggagggucaccugagccugggaagucaaggcugcagugagucaagacugugccacucuacuccugccugggcaaaagagugacauccugucucaaaaaauacagcaaauuuuuaaaaaugaggggaccaaguuagggcauagaguuuuuguuuucucuuuguuuauacaaacaguguuaaguuguuaucagcuuaaaauaauggaugauaguauuugcaagucucaugguaaccucaaaccaaaagacauaaaauggauacacaaaaaauaaaaagcagaaaacuaaaucauaucaccagagaacaucaccuuaacuaaaauaagaccugaacgaaagaaggaaaaaaaagacaaugaaacaacaagaaaacaaauaacaaaacagcaagagaaaguucuuacuuaucaauaacaauaaagauuuguuuaauauuguauggauuccugcaaguuuggggcucucuucagguacacaagaguuaaaaacuucaauuuugaguguacgacuuuucucagaagccacugugguuugcccuguuaaguauauauuauauugacaauucuguuauuuucuguuucuggacauagaacuguggaagguuaagaagugguaaguggcugggugugguggcucacgccaguaauccuagaacuuugggaggccgaggcggguggaucacgaggucaggagauccaggccauccuggcaaacauggugaaacccugucucuacuaaaauacaaaaaauuagcugggcaauguggcgcacgccuguagucccagcuacucaggaggcugaggcagaggaaucacuuaaaccagggaagcggagguugcagugagccaagaaugcgccacugcacuccagccuggcgacacagcaagacuccaucucaaaaacaaaacaaaacaaaacaaagugguaaguuaaauauuucagggaucaauaaugcaguuuaucaaagauauuuggguuuucucccuuuuaagcauauaacaggauuucauuuuugggcuucuuugugguugguuggaacaauguuauuaguuuuugggguuucuuucaaaugaguuaggagccuaugugaugaaacuuccaugcuaaagcauuuagauuguagauuguauaugugagaauuuuuggagcucucuuuucuucuggcgcaagcaaccaucaauguucaagguaaucacugcuccauuagucuguguucaagaguaaccacaaagaacagaacccuuagggaaacuaauuaaugauggguaugaaaaauauaccuucguuauuaagcaauccagguuuuggggauauuuguuaccauaccaaaauuuagucuaucuugacugauuaaagccuucuucuaauaucuuuuuuccugaagccauaaagaaaaagcgaaacuaugaguaucauaucagaaguuuaaauauagcacagaaauauagauuuacucaacagaaagggaacugaaccagauccugccuucugccacugauaaguuaugagaccuauggcuaauuacuuaauguccaauaguaucaacaguuuauauaauaaaggcuaacaagggauaauggcacgucuuucauuuacaucauccccaagaaaaugaguugguucucugucaucuuuagaaggugaccaauuaccuugaacuugaauuuacugcaauucuuacccuaauuaaaaagcucaaauugucccauguagaagucacuucauauugccuccuuggaacuuuguuugucacccuacuagucuuuuauauauccucugcucucugaugucaagauauucuaggcgcaaaccaggaucagcuguuucuccauuaauccuuaguuuuuaucuugaggaaugaauuuuaagaccagagucugggacuugcuaucuauacuggcuuugucacaguuuuguaaacuuucaguggauagaacuagguuaaaaaaugcauauaugauacauugugaguucauauggacauuuccaauucaaauccagaacuacaaaauuuuuacuucuauguuacugugaggaaauaauucucuauggaucucucauguuucugaaaaaaaauuuuuuuuuuugaaauggagucuugcucuguugcccaggauggaguacaguggugcaaucucggcucacucuguaaccuccaccucccagguucaagagauucuccugccucagcaucccaaguagcugggauuacagaagcacaccaccacauccagcuaauuuuuguauuuuuaguacagaugggguuucaccauguuggccaggcuggucuugaacuucugaccucuaagugauccaccugccucagccucccaaagugcugagauuauaggcauaagucaccacacccagcccguguuucugaaaauucugaaugcagagguauugacugucuuuguucuaggcuauuuuuuggaggauauuuguauagcaaacagacuugaaaaauaaagauaauaucucccucugcacaaaggguagauuuguuuacuguucaguauaauaaauguaucucucuccagcacaaaggacacuuuaucagucaggguucugcagagaaacagaauagaauacauacaaauggauuuauuucaaggaauuggcucacaugacugugaggaucgacaggucuaaaauccacagggcagggcagcaguugauguuuauaaaaaaucuuuuuuuuuuucuuuuaagauggagucucacucacugugucauccaggcuggagugcagaggcgcgaucuuggcucacugcaaccuccgccucccagauucaggcaauucuugugccucagacucccaaguaccugggauuacaggcgcgcgccaucaugcccagcuaauuuuguauuuuugguagagacgggguuucaucaucuuggccagaauggucucgaucucuugaccucgugauccaucugccuuguccucccaaagugcugggauuacaagugugagccacugcaccuggcugaguggggccccuuauaaagaauaaucuccuuuccugaaagccaacugauaagauguuaaucauaucuauaaaauaccuucacagcucacuuaauguuugauuaaaucaucugguacuauauaaccuagccaagaugacacagaaaacuaaccaucacaagcagguuuguuugcagucuauuauaaaagauucaguuucccuaaacuccagguuacuuagcugugauguaaacucacaauuuaggcuccucuauaucacccuguggguuuaggcgggcaaagaugacugauacaaauacaaugcucaugcuguuuucugugcauauacaaagugauaaauccuuuugucucugacccagaagcugguguguucugucagcaucuaagaaauugugauaggcuccuaguaacuuuccaguaggguaaaacugcagaacuuucacaguucuucacacuuacaucugauuuuuuuucuuccauccugagaauuuugguucucaaauguaauagauuuauaaaucagaauguccccaaauuacugauuuguuuuaucccaccuugcacacaccacagacucagaauaacaauaccaaugauacuaccacuaauuauaauuacuaaaaauagucacuucuuuuguauauccuuauccccucuuugcauuucuuauugauaugguuuaguuguguccccacccaaaucucaccuugauuuguaguucucauaauccccagacaugggagggaccuggacaagguaacugaaucauggugacgauuacucucaugcuguucucaugauagugaguucccaugagaucugaugauuuuauaaagggcuuuucccccucuucacucugcacuuguccuugcugccaccaugugaagaaggacauguuugcuuccccuucugccauaauuguaaguuuccugaggcuucuccagcccugcagaacugugagucaauuaaaccucuuuccuuuacaaauuacccagucuugauuauguuuuuauuagcagugucagaacgaacuaauucaguaaauugguaaagauacccaaaaauguggaagugacuuuguaacuggguaacaggcagaggcuagaacaguuuggagggcucagaagaagauaggaaaaugugggaaaguuuggaacuuccuaaagacuuggagggcuccgaagacaggaagaugugggaaagucuguaaguuccuagagacuuguugaauggcuuugucuaaaaugaugauagugauauggacaauaagguccacccugagguggucucagauggagaagagaaacuuguugggaacuggaguaaagaucaaucuuacuaugcaaagagacuggcagcauuuugccccugcccuagagaucuguggaacuuugaacuuaagagagaugauuuaggguaucugguggaagaaauuucuaagcgacaaagaauucaagaggaagcagagcaugaaaguuuggaaauuuuucagccugaugaugcaguagaaaagaaaaacccauuuucuggggagaaauucaagccugcuacagaaaucuacauaagaacgaggagccaaaggcuaaucacaaagacaaagaggaaaacgucuccaggccaugucagagacuuuugcggcagccccucccaucacaggcucggaggccucagaggaaaaacugguuuccugugccagguccaagacaccucugcuacauacagccuagagacuuggugcccuguguccccaccacuccagcuguggcuaaaagaggccaagguacagcucaggccauggcuuuggagggugcaagccccaagccuuggcagcuuccacaugguguugguccugcaaaugugcagaagacaagaacugagguuugggaaccucugccuagauuucagagaauguaugaaaaugccuggaucgggcacgguggcucacaucuguaaucccagcacuuugggaggcugagguggguggaucaccugaggucaggaguucaagaucagccgggccaacauggugaaauucugucucuacaaaaaauacagaauuagucaggugugguggcacacaccuguagucccagcuacucaggaggcugaaacagaagaaucgcuugaacccaagagcuggagguugcaguaagccaagauugagccacugcacuccugccugggcaagacagagugagacuccaugucaaaaaaaaagaaaaaaaaagaagaaagaaagaaaagaaaaugccuggacguccagguagagguauguugcaggggcggagcccucauggagaaccucugcuagggaagugcauaaaggaaaugugggguuggagcccccacacacaaaugugggguuggauccccuacacagcuucacuagggcacugccuaguagagcugugaaaagacagccacagucuggaggaugguguaaauguaaaggacuaaaaucuccaaucaaaagaaauagaguaggugaauggaugaacagaucaauggaagauccaauggaacagaucaauggagcuuccacugauccaagaaacacacuucaccuauaaauacacacacggacugaaaauaaaaggauggaaaaagauauuccaugccaauagaaaccaaaaaagagcaggaguagcuauauuuauaccagaaaaaguagauuugaaguaaaaaaacaagugacaaagucaccguauaaugacaaaggggucaauucagcaagaagauauaacaauuuuaaauauauacgcacccaacacuagagcacuuagauauauaaagcaaguauuauuagagcuagagagagagacaggccccaauauaauagcuggagauuucaacaacccauuugcagcacuggacagauauuccagacagaaaaucaacacagaaacaucugacuuaaugugcacuauagaccaaauggaucuaauagauauuugcagaauauuucauccaauggcuacagaaugcacauuuuuuuccucagcacauggauuauucucaaggauagacuguguguugggucauaagacaagucuuaaaauguugaaaaacauugaaauaauaucaagcaucuucucugaccacaauggaauaaaacuagaaauuaauaacaagaggaauacaaauacguggaaauuaaacaauaugcucaugaaugaccaguggguccaugaagaaauuaaaaaggaaacugaaaaauuucuugaaacaaauguaaguggaaacaacauaacaaaaccuaugggauacugcaaaagcaauacucaaagggaaguuuaaaguuguaagugccuacaucaaaaaaaaggaaaaacuucaaauaaacaaucuaaugauacaucuuaaagaacuagaaaagcaagagcaaaccaaauccaaaauuaguagaaagaaauaagaucagggcagaaauaaaugacauugacauuuuaaaaaaccaauacaaaauuucaaggaaacaaaaaguuguuuuuuuuuaaaaaguuaaacaagauugacaaaccuuuagccacauuaagaaaaaaaaaacaagauacaaauaaaauuggaaaugaaaaaggagacauuacaacugauacugcagaaauucaaaggaucauuaguggcuucuaugaccaacucuaugccacuaaauuugaaaaucuaaaagaaaugaacaaauuccuagacauauacaaccuaccaagauugaaccaggaagaaauccaaaacaugaacagaccaauaacaaauaacaagaucaaagccauaauaaaaauuccaaaucaaaacuacaaugagauaccaucucaccccaguuaaaaugacuuauauccaaaagacaggcaguaacaaaugcuggaaaggauguggagaauguaaauuuguacaaccacuauggagaacaguuuggagguuccucaaaaaacuaaaaauagugcuaccauaugauccagcaauccuacugcagggcauauacccaaaagaaaggaaaucaggauaucaaggagauaucuacacuccaauguuuguugcagcacuguucacaauagcuaagauucggaagcaaccuaagagucuaucaacagaugaauggauaaagaaaacgugguauauauacacaauggaguacuagucagccauaaaaaaacgagauccugucauuugcaacaucauggaugggacuggagauuguuaagugaaauaagccaggcaaagaaagacaaacaucgcauguucccacuuauuugugggaucuaaaaaucaaaacaacugaacuaauggacauagaguagaaggaugguuaccagaagcuggaaagggucguggaggacucagggggaaguggggaugguuaauggguacaaaaaaagaguuagaaugaauaagaccauuugauggcacaacagggugacuauagucaguaauaauuuaauuguacauuuuagaauaacuaaaagguugcaacuggauucuuuguaauacaaaggauaaagccuugaggggaaggauacccaauucuugaugugauuauuucacacugcuugccuguaucaaaacaucucauguaccccauaaauagauaaacucacucuguaaccacaaaaauuuaaaauaaauuuaguaaaauaaaacagagcuguugaucuuuccuucuguccaaaauauaaaacuugcucuuccaacacuguuucccaauucaguagccagcaacuccauucuuccaauuguucugaccaaaaauucugugaucaucacugaccuuucuuuucucucacaauuuauaugugauccauuaguaaaucaugcuaccucuaucuucaaaauacauaaaaauuugcucuuuugucacuacuuucacuguuaccaccccaguccaagccaccaauacuuccugacuggauuacugcaacagucuccuaaguggucucccugcuuccauccugccccugccucucuucagucuguucucaacauaggagccagagugacuuuguuaaaccguaagucaaauuaugucacuauuuugauuaaauaguuccaauaacuuccauucucagaugggaaagugaaaauccucucaauagccuauaaaaucugcccccaccaccauagcucaucagaccucauuucuuacuacuuuccuucaaguucacucugcuccagccacacuaacauucuuacuauuccucaaaaauacuggcauucugcuucagggcauuugcauuugauagucccuuuacuuaacauguccuuuccacacagcacauuaccucaccuccuagucucuacuuaagugucaccuuuacagugaggucuuccuggccacccuaucuaaauaccuaucuaaacucuucccaauaguuucuaucgcauuuucucaccuucuuuuccuuagcucuuacaaacuauacauauauacaugcauauauaaaaauuuacacacauauauaaaauuuaccuucuuuauucugugucuccccacccaguagauaaaagcuccauaagggugggcaauuuuaucuguuugguucacugccauaucucuagugauaagaauagucuuuggcaaauaauagguguucaguaaauauuugcugaaagaacaaguaaaccaagaaauagauauguccuaaaugccacuuaagaaagggucuuaagaagguguaaccaacugauaagguuuggcucuguguccccacccaaaucucaucucgaauuguacucccauaauucccauguguugugggagggacccagugggagauaauuugaaucaugggggcaguuucccccacacuguucucaugguaguaagucucacgagaucugaugguuucaucagggguuucggcuuuugcaucuuccucauuuucucgugcugccgccauguaagaacugccuuucacuucccaccaugauucugaggccuccccagccauguggaacugucaauccaauuaaaccucuuuuuccucccagucucagguaucucuuuaucagcagcaugaaaacggacuaaugaaccaacuaugucaaaucaugaugaaaaaucaaauaagaugagaacugauaaccacuggauuuggcaaugcagaggucacugguaaccucaacaagaacugcuauggugaaacagaacaaagccaagaguaaaugggagaaaaggaacugaagauaguauaagcaaauucuucaaauauucucucauaacacaaaaccacugcacacaauguuaccucuucccagaaugcuauaccuucuuucauuucuucugaugacccuucucccuauuguccucaaagacuuagcuuagguauuauauucuauaagaaacacugugaacuuuuuauauccccauguacauaccauaucacagguacauuagugcuauuccuaguauacauaugcucauugagcaucugauugugucuaaacucugaguaucuuaaggcagggauucuugcacaaaacagaagcucaacaaauauuucuuggaugagaaaacuuugaaauaaaaguucuuaauagcuucuaauaauucauuauuccacguuuuccuuaauguauauccaaaacauguuuuauuaauugucugcauauuugcacauaagacauuauaaaauaauaaaggaaaauaauuaaauguaaaucuaauaaucuggcuucucccuaaagaauauauacuuaauacacaucuauuacaacuucaacuauuauucuaguuaauuccuacuuuuccuggaaaacaucucuuaauuuuaucccuuaaauuaugcaauauuuaaaaaaccauaaauauuuugauauugcaacacauaaaaugaaaucuuaccaaauauaauuguuacauggucuauaaauaaauguuaaguccaucuaauucuaguuacuuaagcacagggacauuuuauuaaauauguuuucuaauacuuuuugaagcacuacuucuacauauugcacagugcuuaagaaaacucugguaucagguuugaggagaggguuugugcccauuucucaaacggcuuguguuaagaauucuaggcauggugggggcaauguguuucccaaacagaauaaucugaggcacuuuuuaaaaaauagauuccugggcuccaacccuagaagauucugacuuugugcguuugagcaaaaggcuagaaacuggugaaaagcucuucaaacuauuuugaagauaagccagguuugggaaaucaugagcauguaucuagaagcauuaaguagacuacaaguagguuuccaguaauuccuaccagagcuuaaaaaguugcuacucugaacccauauaaacacaaaaaaaaucuaucuaccgugcaaauguuauucugaaucgcuuuuccaauuacaauuuugacuugcguugaauaaauuaaguuucuauaccauaaauacugagcugucaaaaaccacuuuuacuaaacuacaauaagacuuggucaguauuuuuucuuaagaacacgauuuaccacaaauaaagaaaauagcuucuacacccuucauuuugucuuuuaaaaaagccauacauagaagcaaugaacaguuauuauuuuaaccugcaaccauauagugugguauacuuuucaaaauauuucagaugcaucgucauuugagcucaucaccaacuggugagacccuuucacuauguuaaaaaaaaaaaaaaguacucuaaauucuauaccuacuuaauacauaaacaaugggcucugacucccauaaggaaagcagagucaaauaacaaaaugccccaaguuaauuauauuccaucaauggucuucacugguauagauuauuuguaaacucucaauaauauccuuaagaacaaucuugcaaaaauuugcuuacgggaaguaccuagaauaauaaauuugaaaagauauugcacucuggcugcacacgguggcucacaucuguaaucccaacacuuugggaggcggaagugggaggaucacuugagcccaggaguccagcacaccagccugggcaacauacagagaccccaucuuuaccgaaaaaaaaaaaaaaauagcccagcaucauggcccacaucuguggucucagccacuuggggaggcugaggugggaugaucaccugagcccaagauuucaaagauacagugagcagugauugcaccauugcacuauagccugugugacgcagagcaagggccugucucaguuuaaaaaaaaaaaaaagcuaucgcauucuuguaacaacuggcaaaaguuucaaaauauagaccaagguauagaugugcaucuuaugcuaaaacugguaguagcuuauuuuauaacuuagucuuaaaucuagacuagagauuuuuauagauacagauuuuauagauuuauagauuuuauauugauagaauaacuggagaauuuuaucaauauaacuugagaaaaagaacaaaaaagugaccccaaaagcccuauauuauuucugacauugaaacuaauugccauauaaaccaguuacuaagauaaauauaacuaaaagauaaaugacuagagaaguauacacaaguagauggcaaaaagaagauggagaacuacaagcaacacugagaaaaugaugaaaugucauguggcaccaccacuggcaaucccaggugauaauaaaauggucaaagaaccaguaagcaaaugauagacuagucaugauucagccuuuacugagaaaaugaugaaaugucauguggcaccaccacuggcaaucccaggugauaauaaaauggucaaagaaccaguaagcaaaugauagacuagucaugauucagccuuuacugagaaaaugaugaaaugucauguggcaccaccacuggcaaucccaggugauaauaaaauggucaaagaaccaguaagcaaaugauagacuagucaugauucagccuuuaccaccaacauugcacucacauuuucaaaaccugaggacaaugaucugcucauucuggaacaguucuauccucagacuaaguaauauuugaccaauaaguuuuacauaaguuucaggcaaagguggaaacaaaacagaugaugaaaacagcacugacuuuuuauuacuaaagcuaagguuacagcaacauugguuuucacuaugcaucacauuugugaauauuacaucuucugcuguggcauaauuuaaaaauuacuagaguuguuucuauacucacaagucaaacacugaacugaaaaaauauugagguuuuaauauuagcucaauauauuucacaaacaugaaugaucugucauuacuauuugaaauaaaauguccagagcccuuucacugauuccuaaauuauauucucaguaucauauuaaauuugugccaccaauuucaagaugcuguaugauucagauuuuacucccucauugaaacuuuucaggaaacuuauuuucauuguuauacauuaaagaugugucauuuggauaaaaucauaagcauguauauucaacgaugagaaauucgaguauguuuguuguuuuguauaaguugugcaacuauaccaaaagaaagucaaagcauuaccuuccuuacaguuuacugaaacacaauuaugaaauuuaagcggugugacauauaacacagcuucuaauuacugcuagaagaacaagauguaauuuaccucaccaaauaaaucauaucuaguuucagaagaccuuagugcuauacugcucucauaacccccaaggaguaaaaacaauacaaguguaccacgagaagaccucaaaauccuucacauuuacuccaccagcugaauucaaccuaacagacuaaauuaucuggagcagggcuucaguuaaggcugcuccagcuagguaaagcuacuaugccugguacuuugggagaccuagcauauggaaaagaagggagacuugaaaggauuagggaaaaagacaagacacugggguaaacucuacucuugggauaacuaagaagauaaauaauuacuacggguuuacuuuaguuuuguuuuuccaucagcaauuugggcuauuauaauaggucuguaacccuaaucaccacgauacagagucccagcuugagaaaaaugaaaugacuuaucaguuaccuuuucaaaguaauacauuaaauacaaucugaaaaagcacucugguguccaaaaaacaaaaacaaacaaaaaaaaccaacugaauacagagcaccaccucauuccuuacucugcaaucucaauuuugucuuuucuuaucuuuacuccaucuugcccuaccucuguuuguccuaggcauccuuucccucuuacauauuauagauguacagagacgcaaaacagaagaacaacuuuauuuguggaauuuacauaccagggcuucuugccuacaagacuucaaaccaagguaccguauuugaaaugcccaauuuaaauccugugcaacauacaugagggaauaacauuuuguaaccaaacccaaaucguagaaucuuugauaaaaccccaagagcaccacacaaacacauucucaauugcuuuuaauauauuuuccucuguaaaggacaaaaaaugcugugcuugaggcaauaaucaguggccuagaaugauuucugaagcucuugacuuuaccauaaaaguuguacuaagacacugauugaaaauuacauuucaaauauaccgcucacuaaagaaaugucaacaagcucugggaccaacuuugaguuauuguccaaggaagacuaaaaauagccccccaauagcgauuuaauuuuaagaaaauacaaaaguagcuuauuuaggaguauuuuaaugaagaugaagagaacuggaaaucagugaaguuuucagcagccucuucagauaagaccuaccuuaaauugccuucaggugugcacauuuuaacauccagugaauugccuggagguugccugggguuucugcugauuauagcaggcggugaaaccugaacuaauaauuacggccaggaggugagagcccuucaggacgccacccugggcgcgcuccccgggagcagcccaccgcuugcugugcuuccaucaguccuuuauuagguaaaggguuuccccccaccccgggugcuuuaagaaugcguuuaauaagaaauuucucacaggaucuaacggaauaaagugccaccaaaauaaccuuuucgcaguuuucguaauugugauggagugggaaaggggacaaagccgucaaaccgggugcccgguggauccgcggaccugaucuuccugcacggacccgagagagagucccuagacgaggaagaggggaaaggcauuuguaggguguuaacugguggacucgggaccagagagacagcugcggauuccccucggggugaugcuccgugcaggagcggucacggcguccagaggaacccgcgggugcaaacuccgggagcggcuugcagggugacggcggcggcccccgcuccccgguaccugaugaugucgucgcuguggccccgguagaacuucugccugugcucccgcgggcuguacaccacgccgacccccgccacgaaguauacgaucuccuuggccgcaguguaguagagguuguugcggcacugguggccccgguagccguacacccacucgagccgcagguggcagcucggggcgcuccgggccgccaugucggggcgcccacccgccgcucccgcucgggcccgcggcggcgacgggaggcggcggcggcccggcaacgaaagcccucccgcuggcugccgggacuucccgccagccgcguccucuaagccgcgcccgucaggugcaucucguuucgggggccgccgccgccucagcccacaggcgggaggaaaacccucgccucgcggaacaugcugagggccgcgagcgccgccggcugucaaguggaugcccag

SEQ ID NO: 192381 - RNA, 177923 nt, Homo sapiens
cugggcauccacuugacagccggcggcgcucgcggcccucagcauguuccgcgaggcgaggguuuuccucccgccugugggcugaggcggcggcggcccccgaaacgagaugcaccugacgggcgcggcuuagaggacgcggcuggcgggaagucccggcagccagcgggagggcuuucguugccgggccgccgccgccucccgucgccgccgcgggcccgagcgggagcggcgggugggcgccccgacauggcggcccggagcgccccgagcugccaccugcggcucgaguggguguacggcuaccggggccaccagugccgcaacaaccucuacuacacugcggccaaggagaucguauacuucguggcgggggucggcgugguguacagcccgcgggagcacaggcagaaguucuaccggggccacagcgacgacaucaucagguaccggggagcgggggccgccgccgucacccugcaagccgcucccggaguuugcacccgcggguuccucuggacgccgugaccgcuccugcacggagcaucaccccgaggggaauccgcagcugucucucuggucccgaguccaccaguuaacacccuacaaaugccuuuccccucuuccucgucuagggacucucucucggguccgugcaggaagaucagguccgcggauccaccgggcacccgguuugacggcuuuguccccuuucccacuccaucacaauuacgaaaacugcgaaaagguuauuuugguggcacuuuauuccguuagauccugugagaaauuucuuauuaaacgcauucuuaaagcacccgggguggggggaaacccuuuaccuaauaaaggacugauggaagcacagcaagcggugggcugcucccggggagcgcgcccaggguggcguccugaagggcucucaccuccuggccguaauuauuaguucagguuucaccgccugcuauaaucagcagaaaccccaggcaaccuccaggcaauucacuggauguuaaaaugugcacaccugaaggcaauuuaagguaggucuuaucugaagaggcugcugaaaacuucacugauuuccaguucucuucaucuucauuaaaauacuccuaaauaagcuacuuuuguauuuucuuaaaauuaaaucgcuauuggggggcuauuuuuagucuuccuuggacaauaacucaaaguuggucccagagcuuguugacauuucuuuagugagcgguauauuugaaauguaauuuucaaucagugucuuaguacaacuuuuaugguaaagucaagagcuucagaaaucauucuaggccacugauuauugccucaagcacagcauuuuuuguccuuuacagaggaaaauauauuaaaagcaauugagaauguguuuguguggugcucuugggguuuuaucaaagauucuacgauuuggguuugguuacaaaauguuauucccucauguauguugcacaggauuuaaauugggcauuucaaauacgguaccuugguuugaagucuuguaggcaagaagcccugguauguaaauuccacaaauaaaguuguucuucuguuuugcgucucuguacaucuauaauauguaagagggaaaggaugccuaggacaaacagagguagggcaagauggaguaaagauaagaaaagacaaaauugagauugcagaguaaggaaugagguggugcucuguauucaguugguuuuuuuuguuuguuuuuguuuuuuggacaccagagugcuuuuucagauuguauuuaauguauuacuuugaaaagguaacugauaagucauuucauuuuucucaagcugggacucuguaucguggugauuaggguuacagaccuauuauaauagcccaaauugcugauggaaaaacaaaacuaaaguaaacccguaguaauuauuuaucuucuuaguuaucccaagaguagaguuuaccccagugucuugucuuuuucccuaauccuuucaagucucccuucuuuuccauaugcuaggucucccaaaguaccaggcauaguagcuuuaccuagcuggagcagccuuaacugaagcccugcuccagauaauuuagucuguuagguugaauucagcugguggaguaaaugugaaggauuuugaggucuucucgugguacacuuguauuguuuuuacuccuuggggguuaugagagcaguauagcacuaaggucuucugaaacuagauaugauuuauuuggugagguaaauuacaucuuguucuucuagcaguaauuagaagcuguguuauaugucacaccgcuuaaauuucauaauuguguuucaguaaacuguaaggaagguaaugcuuugacuuucuuuugguauaguugcacaacuuauacaaaacaacaaacauacucgaauuucucaucguugaauauacaugcuuaugauuuuauccaaaugacacaucuuuaauguauaacaaugaaaauaaguuuccugaaaaguuucaaugagggaguaaaaucugaaucauacagcaucuugaaauugguggcacaaauuuaauaugauacugagaauauaauuuaggaaucagugaaagggcucuggacauuuuauuucaaauaguaaugacagaucauucauguuugugaaauauauugagcuaauauuaaaaccucaauauuuuuucaguucaguguuugacuugugaguauagaaacaacucuaguaauuuuuaaauuaugccacagcagaagauguaauauucacaaaugugaugcauagugaaaaccaauguugcuguaaccuuagcuuuaguaauaaaaagucagugcuguuuucaucaucuguuuuguuuccaccuuugccugaaacuuauguaaaacuuauuggucaaauauuacuuagucugaggauagaacuguuccagaaugagcagaucauuguccucagguuuugaaaaugugagugcaauguuggugguaaaggcugaaucaugacuagucuaucauuugcuuacugguucuuugaccauuuuauuaucaccugggauugccagugguggugccacaugacauuucaucauuuucucaguaaaggcugaaucaugacuagucuaucauuugcuuacugguucuuugaccauuuuauuaucaccugggauugccagugguggugccacaugacauuucaucauuuucucaguaaaggcugaaucaugacuagucuaucauuugcuuacugguucuuugaccauuuuauuaucaccugggauugccagugguggugccacaugacauuucaucauuuucucaguguugcuuguaguucuccaucuucuuuuugccaucuacuuguguauacuucucuagucauuuaucuuuuaguuauauuuaucuuaguaacugguuuauauggcaauuaguuucaaugucagaaauaauauagggcuuuuggggucacuuuuuuguucuuuuucucaaguuauauugauaaaauucuccaguuauucuaucaauauaaaaucuauaaaucuauaaaaucuguaucuauaaaaaucucuagucuagauuuaagacuaaguuauaaaauaagcuacuaccaguuuuagcauaagaugcacaucuauaccuuggucuauauuuugaaacuuuugccaguuguuacaagaaugcgauagcuuuuuuuuuuuuuuaaacugagacaggcccuugcucugcgucacacaggcuauagugcaauggugcaaucacugcucacuguaucuuugaaaucuugggcucaggugaucaucccaccucagccuccccaaguggcugagaccacagaugugggccaugaugcugggcuauuuuuuuuuuuuuuucgguaaagauggggucucuguauguugcccaggcuggugugcuggacuccugggcucaagugauccucccacuuccgccucccaaaguguugggauuacagaugugagccaccgugugcagccagagugcaauaucuuuucaaauuuauuauucuagguacuucccguaagcaaauuuuugcaagauuguucuuaaggauauuauugagaguuuacaaauaaucuauaccagugaagaccauugauggaauauaauuaacuuggggcauuuuguuauuugacucugcuuuccuuaugggagucagagcccauuguuuauguauuaaguagguauagaauuuagaguacuuuuuuuuuuuuuuaacauagugaaagggucucaccaguuggugaugagcucaaaugacgaugcaucugaaauauuuugaaaaguauaccacacuauaugguugcagguuaaaauaauaacuguucauugcuucuauguauggcuuuuuuaaaagacaaaaugaaggguguagaagcuauuuucuuuauuugugguaaaucguguucuuaagaaaaaauacugaccaagucuuauuguaguuuaguaaaagugguuuuugacagcucaguauuuaugguauagaaacuuaauuuauucaacgcaagucaaaauuguaauuggaaaagcgauucagaauaacauuugcacgguagauagauuuuuuuuguguuuauauggguucagaguagcaacuuuuuaagcucugguaggaauuacuggaaaccuacuuguagucuacuuaaugcuucuagauacaugcucaugauuucccaaaccuggcuuaucuucaaaauaguuugaagagcuuuucaccaguuucuagccuuuugcucaaacgcacaaagucagaaucuucuaggguuggagcccaggaaucuauuuuuuaaaaagugccucagauuauucuguuugggaaacacauugcccccaccaugccuagaauucuuaacacaagccguuugagaaaugggcacaaacccucuccucaaaccugauaccagaguuuucuuaagcacugugcaauauguagaaguagugcuucaaaaaguauuagaaaacauauuuaauaaaaugucccugugcuuaaguaacuagaauuagauggacuuaacauuuauuuauagaccauguaacaauuauauuugguaagauuucauuuuauguguugcaauaucaaaauauuuaugguuuuuuaaauauugcauaauuuaagggauaaaauuaagagauguuuuccaggaaaaguaggaauuaacuagaauaauaguugaaguuguaauagauguguauuaaguauauauucuuuagggagaagccagauuauuagauuuacauuuaauuauuuuccuuuauuauuuuauaaugucuuaugugcaaauaugcagacaauuaauaaaacauguuuuggauauacauuaaggaaaacguggaauaaugaauuauuagaagcuauuaagaacuuuuauuucaaaguuuucucauccaagaaauauuuguugagcuucuguuuugugcaagaaucccugccuuaagauacucagaguuuagacacaaucagaugcucaaugagcauauguauacuaggaauagcacuaauguaccugugauaugguauguacauggggauauaaaaaguucacaguguuucuuauagaauauaauaccuaagcuaagucuuugaggacaauagggagaagggucaucagaagaaaugaaagaagguauagcauucugggaagagguaacauugugugcagugguuuuguguuaugagagaauauuugaagaauuugcuuauacuaucuucaguuccuuuucucccauuuacucuuggcuuuguucuguuucaccauagcaguucuuguugagguuaccagugaccucugcauugccaaauccagugguuaucaguucucaucuuauuugauuuuucaucaugauuugacauaguugguucauuaguccguuuucaugcugcugauaaagagauaccugagacugggaggaaaaagagguuuaauuggauugacaguuccacauggcuggggaggccucagaaucauggugggaagugaaaggcaguucuuacauggcggcagcacgagaaaaugaggaagaugcaaaagccgaaaccccugaugaaaccaucagaucucgugagacuuacuaccaugagaacagugugggggaaacugcccccaugauucaaauuaucucccacugggucccucccacaacacaugggaauuaugggaguacaauucgagaugagauuuggguggggacacagagccaaaccuuaucaguugguuacaccuucuuaagacccuuucuuaaguggcauuuaggacauaucuauuucuugguuuacuuguucuuucagcaaauauuuacugaacaccuauuauuugccaaagacuauucuuaucacuagagauauggcagugaaccaaacagauaaaauugcccacccuuauggagcuuuuaucuacuggguggggagacacagaauaaagaagguaaauuuuauauauguguguaaauuuuuauauaugcauguauauauguauaguuuguaagagcuaaggaaaagaaggugagaaaaugcgauagaaacuauugggaagaguuuagauagguauuuagauaggguggccaggaagaccucacuguaaaggugacacuuaaguagagacuaggaggugagguaaugugcuguguggaaaggacauguuaaguaaagggacuaucaaaugcaaaugcccugaagcagaaugccaguauuuuugaggaauaguaagaauguuaguguggcuggagcagagugaacuugaaggaaaguaguaagaaaugaggucugaugagcuaugguggugggggcagauuuuauaggcuauugagaggauuuucacuuucccaucugagaauggaaguuauuggaacuauuuaaucaaaauagugacauaauuugacuuacgguuuaacaaagucacucuggcuccuauguugagaacagacugaagagaggcaggggcaggauggaagcagggagaccacuuaggagacuguugcaguaauccagucaggaaguauugguggcuuggacuggggugguaacagugaaaguagugacaaaagagcaaauuuuuauguauuuugaagauagagguagcaugauuuacuaauggaucacauauaaauugugagagaaaagaaaggucagugaugaucacagaauuuuuggucagaacaauuggaagaauggaguugcuggcuacugaauugggaaacaguguuggaagagcaaguuuuauauuuuggacagaaggaaagaucaacagcucuguuuuauuuuacuaaauuuauuuuaaauuuuugugguuacagagugaguuuaucuauuuaugggguacaugagauguuuugauacaggcaagcagugugaaauaaucacaucaagaauuggguauccuuccccucaaggcuuuauccuuuguauuacaaagaauccaguugcaaccuuuuaguuauucuaaaauguacaauuaaauuauuacugacuauagucacccuguugugccaucaaauggucuuauucauucuaacucuuuuuuuguacccauuaaccauccccacuucccccugaguccuccacgacccuuuccagcuucugguaaccauccuucuacucuauguccauuaguucaguuguuuugauuuuuagaucccacaaauaagugggaacaugcgauguuugucuuucuuugccuggcuuauuucacuuaacaaucuccagucccauccaugauguugcaaaugacaggaucucguuuuuuuauggcugacuaguacuccauuguguauauauaccacguuuucuuuauccauucaucuguugauagacucuuagguugcuuccgaaucuuagcuauugugaacagugcugcaacaaacauuggaguguagauaucuccuugauauccugauuuccuuucuuuuggguauaugcccugcaguaggauugcuggaucauaugguagcacuauuuuuaguuuuuugaggaaccuccaaacuguucuccauagugguuguacaaauuuacauucuccacauccuuuccagcauuuguuacugccugucuuuuggauauaagucauuuuaacuggggugagaugguaucucauuguaguuuugauuuggaauuuuuauuauggcuuugaucuuguuauuuguuauuggucuguucauguuuuggauuucuuccugguucaaucuugguagguuguauaugucuaggaauuuguucauuucuuuuagauuuucaaauuuaguggcauagaguuggucauagaagccacuaaugauccuuugaauuucugcaguaucaguuguaaugucuccuuuuucauuuccaauuuuauuuguaucuuguuuuuuuuuucuuaauguggcuaaagguuugucaaucuuguuuaacuuuuuaaaaaaaaacaacuuuuuguuuccuugaaauuuuguauugguuuuuuaaaaugucaaugucauuuauuucugcccugaucuuauuucuuucuacuaauuuuggauuugguuugcucuugcuuuucuaguucuuuaagauguaucauuagauuguuuauuugaaguuuuuccuuuuuuuugauguaggcacuuacaacuuuaaacuucccuuugaguauugcuuuugcaguaucccauagguuuuguuauguuguuuccacuuacauuuguuucaagaaauuuuucaguuuccuuuuuaauuucuucauggacccacuggucauucaugagcauauuguuuaauuuccacguauuuguauuccucuuguuauuaauuucuaguuuuauuccauuguggucagagaagaugcuugauauuauuucaauguuuuucaacauuuuaagacuugucuuaugacccaacacacagucuauccuugagaauaauccaugugcugaggaaaaaaaugugcauucuguagccauuggaugaaauauucugcaaauaucuauuagauccauuuggucuauagugcacauuaagucagauguuucuguguugauuuucugucuggaauaucuguccagugcugcaaauggguuguugaaaucuccagcuauuauauuggggccugucucucucucuagcucuaauaauacuugcuuuauauaucuaagugcucuaguguugggugcguauauauuuaaaauuguuauaucuucuugcugaauugaccccuuugucauuauacggugacuuugucacuuguuuuuuuacuucaaaucuacuuuuucugguauaaauauagcuacuccugcucuuuuuugguuucuauuggcauggaauaucuuuuuccauccuuuuauuuucaguccguguguguauuuauaggugaaguguguuucuuggaucaguggaagcuccauugaucuguuccauuggaucuuccauugaucuguucauccauucaccuacucuauuucuuuugauuggagauuuuaguccuuuacauuuacaccauccuccagacuguggcugucuuuucacagcucuacuaggcagugcccuagugaagcuguguaggggauccaaccccacauuugugugugggggcuccaaccccacauuuccuuuaugcacuucccuagcagagguucuccaugagggcuccgccccugcaacauaccucuaccuggacguccaggcauuuucuuuucuuucuuucuucuuuuuuuuucuuuuuuuuugacauggagucucacucugucuugcccaggcaggagugcaguggcucaaucuuggcuuacugcaaccuccagcucuuggguucaagcgauucuucuguuucagccuccugaguagcugggacuacaggugugugccaccacaccugacuaauucuguauuuuuuguagagacagaauuucaccauguuggcccggcugaucuugaacuccugaccucaggugauccacccaccucagccucccaaagugcugggauuacagaugugagccaccgugcccgauccaggcauuuucauacauucucugaaaucuaggcagagguucccaaaccucaguucuugucuucugcacauuugcaggaccaacaccauguggaagcugccaaggcuuggggcuugcacccuccaaagccauggccugagcuguaccuuggccucuuuuagccacagcuggagugguggggacacagggcaccaagucucuaggcuguauguagcagaggugucuuggaccuggcacaggaaaccaguuuuuccucugaggccuccgagccugugaugggaggggcugccgcaaaagucucugacauggccuggagacguuuuccucuuugucuuugugauuagccuuuggcuccucguucuuauguagauuucuguagcaggcuugaauuucuccccagaaaauggguuuuucuuuucuacugcaucaucaggcugaaaaauuuccaaacuuucaugcucugcuuccucuugaauucuuugucgcuuagaaauuucuuccaccagauacccuaaaucaucucucuuaaguucaaaguuccacagaucucuagggcaggggcaaaaugcugccagucucuuugcauaguaagauugaucuuuacuccaguucccaacaaguuucucuucuccaucugagaccaccucaggguggaccuuauuguccauaucacuaucaucauuuuagacaaagccauucaacaagucucuaggaacuuacagacuuucccacaucuuccugucuucggagcccuccaagucuuuaggaaguuccaaacuuucccacauuuuccuaucuucuucugagcccuccaaacuguucuagccucugccuguuacccaguuacaaagucacuuccacauuuuuggguaucuuuaccaauuuacugaauuaguucguucugacacugcuaauaaaaacauaaucaagacuggguaauuuguaaaggaaagagguuuaauugacucacaguucugcagggcuggagaagccucaggaaacuuacaauuauggcagaaggggaagcaaacauguccuucuucacaugguggcagcaaggacaagugcagagugaagagggggaaaagcccuuuauaaaaucaucagaucucaugggaacucacuaucaugagaacagcaugagaguaaucgucaccaugauucaguuaccuuguccaggucccucccaugucuggggauuaugagaacuacaaaucaaggugagauuuggguggggacacaacuaaaccauaucaauaagaaaugcaaagaggggauaaggauauacaaaagaagugacuauuuuuaguaauuauaauuagugguaguaucauugguauuguuauucugagucuguggugugugcaaggugggauaaaacaaaucaguaauuuggggacauucugauuuauaaaucuauuacauuugagaaccaaaauucucaggauggaagaaaaaaaaucagauguaagugugaagaacugugaaaguucugcaguuuuacccuacuggaaaguuacuaggagccuaucacaauuucuuagaugcugacagaacacaccagcuucugggucagagacaaaaggauuuaucacuuuguauaugcacagaaaacagcaugagcauuguauuuguaucagucaucuuugcccgccuaaacccacagggugauauagaggagccuaaauugugaguuuacaucacagcuaaguaaccuggaguuuagggaaacugaaucuuuuauaauagacugcaaacaaaccugcuugugaugguuaguuuucugugucaucuuggcuagguuauauaguaccagaugauuuaaucaaacauuaagugagcugugaagguauuuuauagauaugauuaacaucuuaucaguuggcuuucaggaaaggagauuauucuuuauaaggggccccacucagccaggugcaguggcucacacuuguaaucccagcacuuugggaggacaaggcagauggaucacgaggucaagagaucgagaccauucuggccaagaugaugaaaccccgucucuaccaaaaauacaaaauuagcugggcaugauggcgcgcgccuguaaucccagguacuugggagucugaggcacaagaauugccugaaucugggaggcggagguugcagugagccaagaucgcgccucugcacuccagccuggaugacacagugagugagacuccaucuuaaaagaaaaaaaaaaagauuuuuuauaaacaucaacugcugcccugcccuguggauuuuagaccugucgauccucacagucaugugagccaauuccuugaaauaaauccauuuguauguauucuauucuguuucucugcagaacccugacugauaaaguguccuuugugcuggagagagauacauuuauuauacugaacaguaaacaaaucuacccuuugugcagagggagauauuaucuuuauuuuucaagucuguuugcuauacaaauauccuccaaaaaauagccuagaacaaagacagucaauaccucugcauucagaauuuucagaaacacgggcuggguguggugacuuaugccuauaaucucagcacuuugggaggcugaggcagguggaucacuuagaggucagaaguucaagaccagccuggccaacauggugaaaccccaucuguacuaaaaauacaaaaauuagcuggaugugguggugugcuucuguaaucccagcuacuugggaugcugaggcaggagaaucucuugaaccugggagguggagguuacagagugagccgagauugcaccacuguacuccauccugggcaacagagcaagacuccauuucaaaaaaaaaaauuuuuuuucagaaacaugagagauccauagagaauuauuuccucacaguaacauagaaguaaaaauuuuguaguucuggauuugaauuggaaauguccauaugaacucacaauguaucauauaugcauuuuuuaaccuaguucuauccacugaaaguuuacaaaacugugacaaagccaguauagauagcaagucccagacucuggucuuaaaauucauuccucaagauaaaaacuaaggauuaauggagaaacagcugauccugguuugcgccuagaauaucuugacaucagagagcagaggauauauaaaagacuaguagggugacaaacaaaguuccaaggaggcaauaugaagugacuucuacaugggacaauuugagcuuuuuaauuaggguaagaauugcaguaaauucaaguucaagguaauuggucaccuucuaaagaugacagagaaccaacucauuuucuuggggaugauguaaaugaaagacgugccauuaucccuuguuagccuuuauuauauaaacuguugauacuauuggacauuaaguaauuagccauaggucucauaacuuaucaguggcagaaggcaggaucugguucaguucccuuucuguugaguaaaucuauauuucugugcuauauuuaaacuucugauaugauacucauaguuucgcuuuuucuuuauggcuucaggaaaaaagauauuagaagaaggcuuuaaucagucaagauagacuaaauuuugguaugguaacaaauauccccaaaaccuggauugcuuaauaacgaagguauauuuuucauacccaucauuaauuaguuucccuaaggguucuguucuuugugguuacucuugaacacagacuaauggagcagugauuaccuugaacauugaugguugcuugcgccagaagaaaagagagcuccaaaaauucucacauauacaaucuacaaucuaaaugcuuuagcauggaaguuucaucacauaggcuccuaacucauuugaaagaaaccccaaaaacuaauaacauuguuccaaccaaccacaaagaagcccaaaaaugaaauccuguuauaugcuuaaaagggagaaaacccaaauaucuuugauaaacugcauuauugaucccugaaauauuuaacuuaccacuuuguuuuguuuuguuuuguuuuugagauggagucuugcugugucgccaggcuggagugcaguggcgcauucuuggcucacugcaaccuccgcuucccugguuuaagugauuccucugccucagccuccugaguagcugggacuacaggcgugcgccacauugcccagcuaauuuuuuguauuuuaguagagacaggguuucaccauguuugccaggauggccuggaucuccugaccucgugauccacccgccucggccucccaaaguucuaggauuacuggcgugagccaccacacccagccacuuaccacuucuuaaccuuccacaguucuauguccagaaacagaaaauaacagaauugucaauauaauauauacuuaacagggcaaaccacaguggcuucugagaaaagucguacacucaaaauugaaguuuuuaacucuuguguaccugaagagagccccaaacuugcaggaauccauacaauauuaaacaaaucuuuauuguuauugauaaguaagaacuuucucuugcuguuuuguuauuuguuuucuuguuguuucauugucuuuuuuuuccuucuuucguucaggucuuauuuuaguuaaggugauguucucuggugauaugauuuaguuuucugcuuuuuauuuuuuguguauccauuuuaugucuuuugguuugagguuaccaugagacuugcaaauacuaucauccauuauuuuaagcugauaacaacuuaacacuguuuguauaaacaaagagaaaacaaaaacucuaugcccuaacuugguccccucauuuuuaaaaauuugcuguauuuuuugagacaggaugucacucuuuugcccaggcaggaguagaguggcacagucuugacucacugcagccuugacuucccaggcucaggugacccuccuaccucagccuccugaguagcugggacuacaggugugugccaccauguccagcuaauuuuuguaguuuuuguagagauggauuuugccauguugcccaggcuggucuugagcuccugggcucaagcaaucugccugccucagcucccaaagugccgggauuacaggcaugagccacugugcccggcccauccuccugcuuuuuaacuuuuuguuauuucuaucuuauuguacugcguaugucuuaaaaaguuguuguaguuauuauuuuuauugguucauuuagucuuucuacuuaguauaagaguaguuuacauaccacaguugcaguguuauaauauucuguguuuuucuguguacuuacuauuaccagugaguuuuguaccuucaaaacccacuugggauuacuuauugcucauuaauguccuuuucuuucugauugaagugcuuccuuuagcauuucuuguaggacaggucugguguugaaaucccucagcuuuuguuugggaaagucuuuguuucuccuucauguugagggauaauuucacuggauauacuauucuaggguaaauuuuuuuuuacuucagaacuuuaaauauguuaugccacugucuccaggcuuguaagguuuccacuguaaagucuucugccagauguauuggagcuccguuguguguuguuucuuuucucuugcuucuuuuaggacccuuucuuuauccuugaucuuugggaguucgacuauuaaaugccuugaaguagucuuuuuuggguuaaaucugcuugguguucuauauccuucuuguacuuggauacugauaucuuucucuagguuuggggauaucuuuuucuguuguuaucacuuugaauaaccuuucuacuccugucucuuuaucuagcuccucuuuaaggccaguaacuccuuuauuugcccuuuugagacuauuuucuagaucuuauagggguacuucauuguuuugguuguuguuucuguuuuuucauuuuugagacggggucuugcucugucacccaugcuggagugcagcaguauaaucucagcucacugcaaccucugacucccagacuuaagugagccucucaccuuagccuucugaguagcugggacuacagucaugugccacuaugcccagcuaauuuuuuuuuuuuugguagagacaggguuuugccauguuacgcacguuggucuugaacuacugggcucaagcaguucaccugcuucgaccucccaaagugcugggauuacaggugugagccaccaugcccgacccacuucauuguuuuuuauuuuuucuuuugucuucucugauuaaaauaaccugucuucagacucacuaauucuuucuucugcuugaucaauucugcuauuaaaggacuuggaugcauucuucaguaugucaauuguauuuuuucagcuccaggauuucuguuugguucuuguaaauuauuucagucucuguuaaauuuaucugacagaauugugauuuccuucucuguguuaucuucaauuucuuugaguuucuucaacacagcuauauuuugaagucucuuucugaaaggccacaucucucuguuccuccaggauuggucccugguagcuuauuuaauucuuugguuaggucauguuuucuuggaugguguugaugcuaguagauauucuuuggugucugggcauugaagaguuagguauuguugucuucacuaucugagcuuguuuguaccuguccuagggaaagccuuuccaagauaucugaaagaacuuggguguugugaucuaagcuguaucugcuuuagggggcaccccaagcccaguaaugcuguaauuguugcagacucauagaggugccaccuugauggucuuagacaagaucccggagaauucucuggauuaccaggcaggcacacucuuacucauuucucuuacuuucucccaaacaaauggagucucucucucucucucucuucugagccaccuaaagcugggggugaaugacauaaucacccuguggccaccaccacuaugauggugcugggucagaccugaagacagcacagcacuuugucuugcccaaggcuugcuguaaucagucccugguuacugccuauguuugcucaaggcccugggguucuacacucaggugguaaagccggccaggccagugugcuucccuucagcgcugugaguucccccaggcuuggguggguccagagguaccauccaugagucagggacuagagucaaaaaccuuagaagucuaccugguguucuguuguacuguggaugugcuggcacucaaaccacaaggcgcaguccuucccacucuucucucuaaagacagaggagccucucccuacagccacugccugccaccacaggccauggagagcacuaccagacuacugccaauguucccuuaaggcccaagggcucauaagucagcuuguggugaaugcugccuggucugggacucacuuuucagggcaaugggcucccuucugccccagggcagguccagaaaugccaucuaagagucagguucuggaauuggggacccaaagaucccacuuggugaucuacccaccccuauggccaugcugguaccuaagguacaagacaaaguauuuacuuuucacuccgcuuuucucaagcaaaaggaguuucgccccauggccaccacaguugauaaugugcuguauccuaccugaagccagcaagccucagaggcucacuuaaggcccuugacauaguacccggguauugcuacugguuauucagggcccaagggcuauucaguuagcagguggugaaugcugccaggaguagguccuucccuucaaggcagcaguuucccuucugucccagggaauaaaaaugucgucugguagcuagggccugaaacaggggccucaugacuuugaccaagcaacucuguuuuagaaguguucuauuugagauuaucugauagacaaccaagugggguuuuaaauuaggcuguugaacauacaugucuauaauucagggaagcaaucugagcugguauagauuugaauguuaucagcauauagacaguauuuaaagccaugaaccuagaugagaccacugaaggagugaguuuagauaaaggaucuaauaaauggauuccuguggcacuccaacauuuuaauguaggggagaugaagaacugacaaaaauguggccagagaaacacgagaaaaaccaagaguauaagaucauggaagucaagugaagagaguauuucagggagaaaggaauuaucagcuguguccaauaagaugaggacugcuucaccuuagcgaaguuuugcuauaauuauauuguaaucauaagacuccccaaaagacuguguaugcccaggggaaaaggaagagcaggaagaagaugagaaaaugagucaugucauuauugguacacaaaacuagccucuuucaagauucguuccaauguauaacuauuauguauucauaacauuucuuaaaaacagauuuguuccagcaguuucugcuuuacuugguuauuaaaaaaaugacacauagcuggcagcccuggaucguugcuucugaaaaguguggucuucagacuagcaacggcaucaccuggaaaguuacuaaaaaauacgaauuaucugggcucauuccagaucuaccaaauuagaaacucuaaguguagagcccaguaaucaguugugugguuuuguuuuuuguuuuuuguuuucuguuuuuugcuuuuuugagacagagucucgcucucgucacccaggcuggagugcaguggcaugaacucggcucucugcaaccuuugccuccggguucgagcgauuaucuugccucagccucucaaguagcugggacuacaggcaccugccaccacaccaagcuaauuuuuguauuuuuaguagaggugggguuuuaccauguuggccaggcuggucuugaacuccugaccucuggugaucugccugccuuggccucccaaaaugcuaggaucacaggcaugagccacuaugcccggccccaguaauaaguuuuuuaucaccuccaggugauguuaauauaaucuaaaguuugagaacacugcuccagauuccugauucucaacccuggcugcuuaauagaaaguuaaaagaaaacaaacaaaauaaaaccaccaauggccaagccuuacccaaagaaauugugauuuaauuuguuuagguugggguccagguaucguuuguuguuuguuucuguuuuuaauuuuuaagcuucccaaaugauuguaauaugcaggcaggguugaaaaccacugcucuggauuuaauaguaauccauguucaggugcuggccuaggagucaaccugaaaaaaaccucaggaccuagccaaauccacucauuuacuauuaugcguuauaugacaauguggguaaguacugggaccuccuuaaauacuuugggcuucuugccuaaggcccucccacgcuggauauucccuguuuggagauuuauuaccaagcaaaguuuuuguuuucuauugguggaucuguucagugucaucaugagcugaaaacaccgaaagacagauauccugcauuaucaguccagaaaaaugcucacucacagggaaccuggaaggucauaauuaugugcauccuguaugauaucaagugagguguacuaugacccagugccucaggugaugauuucagcagacucguggaguagcugcaguggguuuggcugaauuuaaagguaaacuggauuguuaaaagaucaaguaaaacauagugccuaccuuguaacacuggcaugcagauaccuccgaaggaguaagcaugaagggaaacaugaaauaauuagaguaauggacagaauauguugggaugacuaggaguaguuagggagagcuucucugagcaaguuauauuugccccaaagcaugaauaauaugaaugcggcaaagauuugggaggucauuccagacaaagacuuugauagcauaaugagcuuggccauuuuaagggauagaaaggccaguguagcuggaguguagugaacaaaaggaaaaaugguaggagcuaagguuugagaaguaggugaggguauaccuuuuuuuuuuuugagauggagucuugcccugucgcccaggcuggagugcaguggcaggaucucggcucacugcaaccuccgccucccagguucaagcgauucuucugccucagccuccccaguagcugggauuacaggcacgcaccaccacgccuugcuaauuuuuugugucuguaguagagacggguuucaccacguuggccagucuggucuugaacuccugaccucgugaucugccugccucagccucccaaagugcuguuacaggcaugagcuaccucguccggccgaagguauaucuuacaaaggcuugaaagugccaucuuagaugguucagguuucauucuaauucgguaggaagcuauuggguuuuuaccgagguaaaugaugagaucagauuuauguuauuuuuaaagaucaccuggcuauguugagaaagcucuaaagggaagcaauagaggaauaaugguagguagacagaaggcuaccgaaguaguugugauguaagaugaaugcugguucagauuaagauuguagcagaaaugacggugaugauagagccaguaggacaggcuaauagaaugcaugagaugagugaggaaaagauaaguagugaggaugaaauuuagcuucuuggucugagcaauugaauggauggugauaucauuuacuaaggcaaggaggagcagauuggaaagguaaggaggaaaucagauucucuuuaggaugaguuaaauuugaggaauguauccauugugcugaccuagagauacaggguugggaguuaucacagucuauaugcauuuaaagcugugggauuggaugaaaucaccugggaaaggaagggaaaacagccaagacaaagcccucauacacuuuaauauucagagguggggugcaggagauagugccuaccaauggagacagagaaggaagggcugauaaacugugaagucaggaagccuagagaggaaagucuuucaaaaacguggguggucaguuaugucaaacacuacugaaaaauggaggggaauaaggacauacaguuuaucauuagguuuggcaaugucauacaugaccuggaaaaaacuguuucagugaaggagaagagaugaaugccuacuuugaaguauguuaacacaauaaagggagugaaaaagaugagacaccucuuuugagaaguuuugcuuugaaugaggagcagagaaaugggaugauggguaauuggucaagggaauuguuuuuuaauggguauauuugaaugguaauaggaaugacucaguagugaggaagcaauaauuccagaaagcauaguucuaggaguaaaguacuugaaacuaaggagaaugggaccuagaacacaagcggagaguucaaggaguauagacauaaagagaagucagagucugccaguacaguuagauuagugaauuucaugggaaugaaguaucuucuuuaauucgaucuauguuaaucauuaaguacaagacaggcuuaucugcugcaaggcagagguugauaggggggaacugugcucaugugagaguuuggagguugagaaaaggaugcacauuuaccagcuaaguguuuaauagaguucucuacuaguguacagugcucauuugagaugugugagauaaauguaaaggaacauugauauauuugcauguaagaauggagauuuaugaggaagaugauagcucacuuuauguuuguuuaacauguuauuuccuuauaguuaugauaaauuuagagauuaaauacuuaaagcaacuuaauauguaauugugggauuugaugacagugcuuauaucuaauuaauuuccauuacucagcaauauuaauaggaagaagaacuuuaaaaaaaucuguucuuuccauauauuucagaugauagugucacaauauggauggguaauaaucuuguuaaauguuuuagaaugggaauauacccucagaugauuacaucugucauuugucucccaaauuaauccauaaauguugaguuuuuacuauauguucagcaauauacuaggcauuauguggaugaaacuuaacuguaagauauuaaguuaaccugaaggauaccugaacaacacucaugcuuucauucucauuaagaaaauuggaccaaucggaagagaaucuucagauuccaacuguccaaaagcaauacauucagcuccuauccaauauuaauccugcugcuuguguacuggaucccacucuuuuuucccuguuucagaaacguucuuaucuuaaccuacaucagcauuuuuucucuguacugaauggucucuugucaacaaaugaugugaaaaacaacugaauaucuauuaugaggaaaaaaugaaccccagcauauaccucaccauauauaaaauuuaaaaggugagagguaaaacuauaaaauuucuagaaaaagcauaggaaauagaacacaaaaagcaugaauuauaaaaaguaaaauuauaaauugaaccucauuaaaauaacuuaucagaccuccagguaagugaagacaauggcagguauguaguaaguaaccucccaaaaucucuucuccagacuuucugugcaaaccauagccccagcauuacuuaaacagagaauaccaaaacugcaaaaugacuguaaguaaaaagagaaaaagaaacaaauuucagcggccguuucacaagcgcucuuuccucuccucugcugcugagcuuuguugcgaacaaugaaccuaaaugacugaaaaacagugucuuaacaguaucuuaacuguaaggauaaagaccaaaaaaaaaaaaaaacugcacauaaugcuguaaucuaguuaguaaaauuguccuccacagggcuaccaauucugaacugucuuugugucuacuaaaguaaauagaccauagauuaugagagccuaguuucucacucuuggaguaagaaguuauaaauaaagggagaagucuuaaaugagcccugugguuucggauuagaaucugaaguguugauacgaauucaugauuuucaaauacuuagauacagaauguaucuauguauacagacuauagaauguaugcauggguuaguauacauaacuauauuuccuaguugagacaaucuggcgugucaccuauuuuuuguaaauaagguuuuaauugaauucagauaugacuauuuguuaccucaguauuuuacaagugcauuucuauuacugcccccuaaggagcccuuuuagauauugucuuuucucuaaacaccuguauuaguccauucucacacugcuauaaagaaauaccugagacuggauaauuuauaaagaaaagagguuuagcuggcucacaguucuguagguuguauaggaagcauagcaguuucugcuucuggggaggcucaggaagcuuccagucauggcagaaggcaaaggggaggcaaggcacuucacauggcuagaguagaaggaagcgagguggggagaucucaugagaacucacuaucaugagaacagcacccagaggaagguguaaaccauucaugagaagcuaccccaugauccaguuaucuccuaucaggcuccaccuccagcauuggggauuacauuucaacaugagauuugguuggggacacagauccaacuauaucaaugcccucacccacuacaaaauuuuaauagcucagauaugcuauauaucaguuccuauauugaauguauuucugugcuuuaugcaaucagaccucuaugcauuuaagaacuaauuuuugccccuucggagaugauauugcucccaaugggaaugcaugguuuacauauuaucuauggcugauuuaguguuauaauaacccaguugaguaguugugacagaaacuguauggcccacagagcguaaaacauuuacucucuagcccuuuccagaaaaaguuugcuaacuuuugaaauaaaauauucaugaguucaagcugauauaaauagauggguuaaauaaauaaauagaaaagauaacuuccuuguaguagaauucuaauuaauaaauguugaagaaaagagagaaaaaagagaaucacauuauaggccaggugcgaugucucacgccuguaaucccagcacuuugggaggcccaggcgggugggucaccugaggucaggaguucgagaccagccugaccaacaugguggaaccccgucuguacuaaaaauacaaaaaauuagccagguguggaggcgggcaccuguaauuccagcuacucaggaggcugaggcaggagaaucacuugaacccuggaaguggaaguugcagcgagccaagauugcgccauugcacuccagccugggugacagagcgaaacucugucucaaaaaaaaaaagacaaucacauuacggaaauauuuuaguaguaaauguuacugacagaauccgccaauaguugcuaaaauuagugggugaaaguuugaggagagaaauaggauuugcauagucucacaguaucuccccuagcauacuuagugacuacaaagaaaaacuuuguaguaucuuuacaguggcauguacuguuuaaccaagggaucgagguaaacaucaucaguaauauugacacccuaaaccuucugauacgauguggaaagaaggacaaauguaauuuuugugguauuuuuacccaaaaugcauaaccccacuuuaaucaugagaaaccaugacaaauccaaauuuggagacauuuucuaaaauaacugguuaguauucuucaaaaguucccagguuaugaaaggaaaggaaagucuaagaaaguuuuauagagacuggaaguugcuaaggaggaauaacaguuaaaaugcagcaugggauccuggauaggaucuuggaacagaaaagagacauuaguggaaaaaauggugaauuuuugaauaagguuuuuaguuuagguaaugauauuguacuaauguuaauuuccuucuucuucccgauuacuauaugguuauguaaaauguuuauauuguaaugaagugugaugagggauacaagaaaacuguacuauuucguaacauuuuuauaagucucaaauuaguccaaaauaaaacacuucuuaaaaaaauuaaaaucuuuugcucuuuuaaauauaccauuaagaaaauuaaaagguaggccacaagcagacacacauaugcaaaaaaauacaguugagaaaagaauuguaccaagaauauauuaagaacucuuacaguguaacaauauuaugacaaauaauuuaaaaauaggaaaaaugcuuuuuguccagaggcaggcccaguugugggaaguauaugauaguaugcagaggcuaacauccuagacucuuagcuccaguauaaugaaaagggaccucugggagcuggaaauuauggggaaaauuguaggggguacggagcucaagaagggcaucuucauaaggguauaguugacucacuucugugcugcaugugcaggaacugccugcauaucaggcgcuuugagaacugaccuacaaucauccaaguuucagauuugccccuuugguguguguacaugugguagcacugcaaagacuuuaaaacugaacuaacauugggaccccagaaggagggcagggauauguaccuugaaccuaauuggauugcuugucugcugaaauaaauaaaaauaucagcauucucuggaaaauuuuaagaggauucagaguuuauaacuuaauauucgaagugcucaggauauaacugaaaauuagcauauaaaaauuacuaaaaucucaacaauuuauacaagaaaagacaacaguugucagccccaggaugaccuacauguugaauuuaugaaagaauguaaaacauuuguuauaacugugugcuaucgggggaaaccagcccccgauacucaacguggguccuuuucuauuuucccuaagugucggccagucugagaaauaaagggaaagaguacaaaagagagaaauuuuaaagcugggugucugggggagacaucacauguuggcagguuccgugaugccccucaagcugcaaaacugguaaguuuuuauuagugauuuucaaaaggggagggaguguacgaauagggugugggucacagagaucacauacuucacaagguaauaaaauaucagaaggcaaauggaggcagggcgagaucacaggacuggggcgaaauuaaaauugcuaaugaaguuuugggcaugcauugucauugguaacaucaggagaccggguuugagagcagacgaccggucugaccaaaauuuauuaggcaggaauuuccucgucccaauaagccugggagcgcuaugggagaccggggcuuauuucaucccuuauccacaacuguaaaagacagacauucccaaagcggccauuuuagagaccuccccuugggaacacauucucuuucucagggauguuccuugcugagaaaaagaauucagcaauauuucuccuauuugcuuuugaaagaagagaaauauggcucuguuccgcccagcucucaggcagccagaccuaaugguuaucucccuuguucccugaacaucgcuguuauccuguucuuuuuucaaggugcccagauuucauauuguuuaaacaauuugugcaguuaacgcaauaaucacaggguccugaggcgacauacauccucagcuuacgaagaugacgagauuaagagauuaaaguaaagacaggcauaggaaaucgcaagaguauugauuggggaagugauaaauguccauuaaaucuucacaauuuauguucagagauugcaguaaagacaggcauaagaaauuauaaaaguauuaauuuggggagcuaauaaauguccaugaaaucuucacaauuuauguucuucugccauggcuucagccggucccuccguucggggucccugacuucccacaacaguaugccaugaaguaacuguucuuaaaacaaauagaauguuggaaguucucagcaaagaaauagaaguuguagaaaaauggaauacuuagaacugaaaauauaaaaauauaaauaauucuccaggggacucaauuucugagucugcaugguagccagacuggccccaaagauauccauacucuaauuccuggaaccugugaauuuuuuauguuaaacaaagcacacaugacuuugcagauauaauuaagauagggauguaccuuaagauauugagaguaucuugaauuaucuagaugggcccagucuaauuaugugagcccuuaaaagcaaauaauuuucuuuagcuggaaugagaaaacaugcagcagaagucagaaagauucaaagcuugagaagaacucaaugugccguugcugauuggaagauggaggugguaacaucaugaggcaugcaguuggccuugaggaggugagcaguucccccuugacagccagcaggggagugaaagccucagucccuuuaccacaaggaauugaauucagcuaacguucugaaugaacuuggaagcugacucauccccagagacucuagaaaguaauuuaguuguguuaacaccuugacuuuuggccuugugagacuguaugcacaggacucagcugagccacacuaaccagauuucugcccugcagaacugggagauaauaagcuuguauugcuuuaaggugcuaaauuuaugguaauuugugacaucagcauagaaaacuaauauaauacccuuguuacaaacuaauauguuacuuuuuucuuuggaugcuggcaaagacgugaaauuccuagguuagagacaaaggacuuuauuauucauggcauagaaaacagcaugagcuagucauggcagaaugcacauccuuuucaagugccaaaacguuuaccaaaauaggcuauauauuauaaaacaaaccuuaacaaauuuaaaagaauugaaaucauauagaguauguucucugaccauaauggaaucaaaauaaaaaucaguaacacagaacagaagggaaaguagaauauauuaugaaaaugaaaagaagaagaaagugaaaauacaacauaucaaaauuuguaaaauucagccaaagcaguguuucaagggaaauuuggagcauuaaaaugcauauuuuuuaaaagaaaaauaaucucaggucaguaaucuaggagucugacuuaagaaaauagaaauggaagagcaaacacaaaaacaaacaaaguaggaaauaaugaagacaauuagugcaaacagugaaacaauagagaaaaaccuaaaguugguucuuugaaaaggaucagauugauaaacuucuagcuaggcugaccaagaauaaaaaagagaagacaaaaauuaccaguauucaucaggauaucacuauugaccuaaagacguuaaaaggagaauaagggauuacuauaaacaacuuauacauuugacaacugagaugaaaugaacuauucccucaaaagauauaaacuaccaaacuuacaagaauaaaugauuccaauuccacacaauugcuuauagaaaauagaagaggaaguacuacuucucaacuguguuuaugaggcuggcaucacucuaauacaaaauccagacaaacauuugaagaaaaggaaacuacagacaacugucccucauuaauauagauguaaaaauucucaacaaaauaagcuaauaagcaaauaaaauccgucaguaggauaauauaucauaaccagguuucauuccagguaggauucauuccaggaauacaaggcugguucaacauuuaaaaauuaaucaguguaauucgcuauauaauugcuaaagaagaaaagccaggugacuaucucaguaguuacaggaaaagcauuugacagaauuuaauacuuauucauauuuuuaaaaugcuuagcaaacuaggacuagaaguccacuucuuuaacccggcuauaaaagcaucuguaaaaaccuacagcuaaguuuauuccugauggugagagacugaauguuuuccuuguaaaagcaggaaaaagaccagagugucuauucuugucacuucuaauuaaacauccugcuauuuuauugaguauuuuugcaucgauguucaucagggauacuggccugaaauuuccuuuuuuuguuuugucucugccauguuuugguaucaggaugaugccggccucauaaaauggguuagggagaauucccucuuuuucuauuguuuggaaguguucuggaaggaaugguaccagcuccucuuuguaucuuugauagaauucggcugugaaucugucugguccugggcuuuuuuuugguugguaggcuauuaauuacugccucaauuucagaacuuguuauuggucuauucagggauucgacuucuuccugguuuagucuugggggggugugugugucuagaaauuuauccaguucuucuagauuuucuaguuuauuugcauaaaguuguuuauaguauucucugaugguaguuuguauuucugugggaucaguggugauauccucuuuaucauuuuuuauugugucuauuugauucuucucucuuuucuucuuuauuagucuugcuagcugucuaucuauuuuguuaucuuuucaaaaaaacagguccugauucauugauuuuuugaaaggguuuucuucucugucuccuucaguucugcugugaucuuaguuauuucuugucuucugcuagcuuuugaauuuguuugcuuuuguuucucuaaguguuuuaauugugauguuagggugucgauuuuagaucuuucccacuuucaccugugggcauuuagugcuauaaauuucucucuaaacacuucuuuagcugugucccagagagucugguguguugugucuuuguucucauugguuucaaagaacguauuucugccuuaauuuuguuauuuacccaguagucacucaggagcagguuguucaguuuccguguaguuguaugguuuuugagugaauuucuuaauccugaguucuaacuugauugcacuguggucugagagacuguuuguuaugauuuccauucuuuuacauuugcugaggaguguuuuacuuccaauuauguggucaauuauagaauaagugcuauauggugcuaagaagaguguauauucuguugauuugggguggagaguucugucaaugucuguuaggucugcuugguccagagcugaguucaaguccugaauauccuuguuaauuuugugucucauugaucuaauauugacagcgggguauuaaagucucccacuauuacugugugggagucuaaaucucuuuguaaguuucuuuuuuuuucccccgagauggaguuucacucuuguugcuuaggcuggagugcaauggcaugaucucagcucacugcaaccucugccucccggguucaagugauucuccugccucagccucccgaguagcugggauuacaggcaugugccaccacaacccgcuaauuuuuuauuuuuauuagagacuggguuucucuguguuggucaggcuagucucgaacucccgaccucaggugauccaccugccucggccucccaaagugcugggauuacaggugugagccacuacgcauggcccgugucuuuguaaguuucuuagaacuugcuuuaugaaucugggugcuccuguauugggugcauauacauuuauaaacuaucaucagagcgaacaggcaaccuacagaaugggagaaaauuuuugcaaucuguccaucugacaaagggcuaauauccagaaucuacaaggaacaaauuuacaagaaaaaaacaacccuaucaaaaagugggcuaaggauaugaacugacacuucucaaaagaagacauuuaugcagacaacaagcauaugaaaaaaagcucaucucuggucauuagagcaacacaagucaaaaccacaguaugauaucaucucauacgaguuagaauggugaucauuaaaaagccaggaaacaacagaugcuggagaggauguggagaaauagggacacuuuuacauuggugggaguguaaauucguucaaccauuguggaagacaguguggugauuccucaaggaucuaggaccagaaauaccguuugacccaagaaucccauuacuggguauauacccaaaggauuauaaaucauucuacuauaaagacacaugcacauguauguuuauuacagcacuguucacaauagcaaagacuuggaaccaacccaaaugcccaucaaugauagacuggauaaagaaaauguggcacauacacaccauggaaugcuaugcagccauaaaaaggaugaguucauguccuuugcagggacgaugaagcuggaaaccaucauucucagcaaacuaacauaggaacagaaaaccaaacaccacauguucucacuuguaagugggaguugaacaaugagaacauaugggcacagggagaagaaugucacauaccagggccuguuggggcuggggugcaaggggagggauagcauuaggagaaauaccuaauguagaugacagguugaugagugcagcaaaccaccaugacacauguauaccuaugcaacaaaccugcacguucugcacauguaucucagaacuuaaagaauaauaauaauuuuaaaaaaacaacauccugcuagaaguucaagccagugcaaucagacaagaaauaaaaaggcuuauagaaagaaaaggaagaaauaaauugucucuauucuuagacaacaugauugccuacauagaaaauuccaaauaauuuauuuuuuaaaaacucacacaaaaaacacuacuccuaaaacucagugaauuuaucagggucacaggauaccaggucaacauacguaaauuaguuauauuucuaccuacuagcaaugaacaauuggaaacugaaauuuuacagcaauacugucuacaaaagcucaaaaauaucuauauaaauuuuacaaaaucuaugcaaggucuauguuauauacuaaaaacuauaaaaugagacagaaaacaaagaauaccugaaaaauggagggcgggcguacuauguuuauggauuggaagacucaauauaauuaagaugucacuucucuucaaaguuuuuuauagauauaauacaauucuaaucauaaucccaacaagauauauaggauauacagcugauucuaaacuuuauaggaaagaugaaguaauuagaauagccaaagcaauuuggaaaaagaacaaagguagaggacucacaguauucaauuuuaaggcuuauaauaaagcuauacucaugaaggcagugugguauuggugaaaggauagauacauagguuaaugguguaaaauacagggugcaauuuguggaaaaguaauauagauauggucaauugauuuuugacaaaagugcuuggggaagucaauggagaaaagauagucuuuucaauacauggugcuggaaaguuaggaaucuuacauaaagacagcaaaaaacaaacaaacaaacaacuauaaccuacauuacacuuuauacaaaaauuaacucaaaauagauuguagcuuuaaauguaagacaaacuauaaaaguuuuagaaaauaucagaggaaaucuuuauuaccuuugguuaagcaaaagcaugguccauaaaacaaaagucaaugaacuagauagacuucauaaaaauuaaaaaauguuugcucugugagagaaacagagaaugcaaagaaaagcuacagucugggagaaaauauuugcaagucccauguaggacaaagggacuuguauugagaauauaugaaauacuuugaaaacucaaaaauauaaaggcaaccuaaugaaaauggcuagaagacuugaacagaucauuauaagaccaauuaguccaugugaguagucaucagggaaauucaaauuaagaacacugacacuaccaaauauuaguaggaauguggagcaacuggaacuuucuuacauugcuggugagaguguaacaugguacaacuacuguggaaaacugacaguuucuuauaaaucuaaacacggacccacccuauccuuuuucucuaacuugacuuugaauaccucuguucuauuguaugaagauuuuguaguuaaacuaugaggaccugcauaguuuuucuccccaguuuuuuuuuuuuuuuuuuuaagagauggugacuugcccugucacucagacuggaguauaguggcaugaucacagcucacugcagccuugaacuccuggccucaggugaucuucaugccucagccuucugaauaacugggacuacgggcauguaccaucacaccuggcuaguuguuuuauuuuuuguagagguggggucuugcuguguugcccaggcuggucuugaacuccuagccugaagugauccuccugccucagccucccaaagcacuggguuuacagacacaagccaccacacagccuuccuccccaguuuucaagcuuggggaaauuucccucauauuacuuguaguaaauauaugcccuuuuugaaggugagaaaacaagaugaagauaaagaauuugcuaagaagccugugaagagcagagccagaauuuugaacccaugucugucuaacuucaaagguuuucuuugcauaaauccuuauacuaaaaauauguguacagacaguaaugucaguauuuuuuuucacuuuuuaaaaacugagauaugauucacauaacauaaaauguacacuuuaagugcacaauucagugauuuuuaguauagucaaaguuuuucaaccaucacuucuaucuaauuucagaauauuuaucaccccuaaaaaauucccaagcucauuagcaguccuuauccauucuccucuccuuccagcaccuggcaaucacuaaucuacuuucuuuauggauuugcauauucuggacauuucauaauguauuaauaugauauguggcccuuauauaucuguuuuccuucacuuagcguaauguuuucaagguucauccauguuguagcauguauuaaugcuuuauuccuuuugucauuuuuguuguguggauaccacauuuuauucgugauucagucaaacauuuggauuguuucuacuuuuuggccauuugugaaugaugcugcugugaacauuuguguacaaguuuuguguggacauauguuuucauuccuuuugggaauacaucuaggaauagaauugcuggaucauacgguaacuuuguuuagccuuuugaauagcuaccaagcgguuuuccaaagaggcuacaucauuuuacaaucccauaaucaauguuuaaggguuacgcuuuuuccacauccuugccaauacuucauauuuucugucuuuuaaaauauagaagugggccaggcgcgguggcucaugccuguaaucccagcauuuugggaggccaaggcagguggaucuccugaggucaggaguuugagaccauccuggucaacauggugaaaccucgucuuuacuaaaaauacaaaaaaauuagcugggcgugguggugcaugccuguaaucccagcuacuugggagacugaggcaggagaauugcuugaaccugggaggcggaaguugcaguaagccaagauugcaucauugcauuucagccugggcaaugagagugaaacucugugucaaaaaaaaauaaauacacauauauauguauauauauguauauuuauagaaguggacugggagcaguggcucaugccuguaauacuagaauuuugagagccugaggugggaggaucucuuaagcccaaaaguuugagaccagucugggcaacauagggagaccccaucucuacaaaaaaaaaaaaaaaaaauuagacaggugugguggcacccaccuguagucucagcuacuugagaggccaaagcaggaggaugagucuuaaguaugggaggucgaggcugcagugaguggugauugugucacuguacuccagccugggugacagagugagacccugucugaaauaaauaaauagaaagaaaggagagaaagagagagaaaggaagaaagcaagaaaaggaaggaaggaaagagggaaagaaagagaaagaaaaaaagaaaugguauauuauugugauuuuugauuuguauuucccugcugacuauugauguugagcaucuuuuuaugugccuuuuguauaucuuccuuggggguaugucuguuaaaauccuuuauuuguuugaaaaauuggauuauuuauaguuuuauuguugauuuguaggaauucuuuauauauucuuaauagaagucccuuaucagauauaugcucugcaaauauuuucucccauucucuggguugcauuacuauguucuugaugauuguccuuagaagcauaaaaguuuuuaauuuugauuaaguccauuuuaucugcuuuuuuuuuugucacuaaugcuuuguguuauaucugagaaaccacugcuucauucaagauugguaagauuuaugccuauauuuucuuccaagaguuuuaacaauuauuuuagcuucugauccauuuugaguugacauuuguauaugguuugagguauguguccaaauuuauuuuuuuguauguggauauauauucaggugucccaguacuauuuguugaaaugaccauuuuaucccccauugaauugucuuggcaccacccuuguugaaaucaguugaccacaaauguauggguuuacuucuggacucacgauucuguuugauugaucugcauauccuuaugccaguaccacacugucuugauuacuguaguuuuguaguaaguuuguaaguuuagaaauuggaaagugugauuuuuccaacuuuguucuuguuuuucaggauaguuuugguuauuuugagucuuucuggauuuuagaaucagcuugucaguuucuucaagaaagacaacuaguauuuugacaaggauuauguugacucuguagaucaauuugagaaguauugccaucuuacaaauauuacauuccucuaagcccagaaaugagaugucuuuccauuuauuuagaucuuuuaaaauguccuucaguggguuuuuguaguuuucaguguacaaaucuuguacuuuguuuaauuuauuccuaaauguuuuauuccucuugaugcuacuguaagugggauuauuuucuuuaauuuuuuuauuguucguugcuaguguauagaaauacaauagauuuuuuauguugaucguauauccugcaaccuugcugaauucauauuagcucuucauuuuuugguuguuucuuuguggauuccuuaggauuuucuguauauaugaucauaucaucugccaauagagaucuuuacuuuuacuuuuuguuccuuuuccuggccuauuuuucuuggcuagaauaucuaauaaguuaaaugagugacaagaacugacauccuuguuuuuucccuuuacuuagugggauugcuuucaggcuuucaucauuaaauauguuauuagcuuuggguuuauguagauguccuuugucaguuugaggaaguuuccuucaguuucuaguuuauguguuuuuaucaugaagggauuggguuuugucaaauaauuuuucugugucuauugagauaaacauauaugggaguuuuuuugaccuuucuucuguuaauaugccauauuuguugauuucauauguugaaccagccugguauucccacucaucuucucucccauugauuaccccuuuaguauucccugacuugaugaauaccaccccaaaccauucaaauacccaagccagaaacccgagucaucuuagaccccucucuuccccuuguccccugcauccaaucuguuaauuuuaucuucuuuauuuacuuuagagacaggaucuggcccagaagcccaggcuggaaugcaguggugcagucauagcucauugcagccuugaacuccuggguuccuugaacuccuggguucaagcgaucuucucaccucagccccucaaguagcugggaauagagguguaugcugcuaugucuggcucauuaaaaaaaauuuuuuuuuuguagagacaaugguuugcuguguuucccagggugaucuugaacuccugaccucaggugauccuccagccuuggccucucaaagcacugauauuauaggcaugagccgcuacacccagccuugauucuguuuuaauauccuccuaauuuuccccuuuuagugauucuccaccgugaugccaggugugauuuucuuguucaucucaagggcaaauaugauauuguaaauugacauauagaaaaaauuaucaaauagaaauuuauauuuuccccgccuucugcugauguacauaaacuauuaccaacugcuaggucuuugucuuguuuuuagagacucauagauuuuuuuuugcgaauuaugggugaccuuucuguuucuuaaaauggaauuuauaauuuaagaauuaguguuauaguaggagugcuacuaaaugcuguauuuagacauuaagauuuugucuaacuuuauccagugaaaggaauaguaaaaugggaaagaaggcuuggaaacaggugaauacuaaaugaggaaaaggcuaccaauuuguugcugugauccaauugcucucuugugagaguucuuuucuugagaaguuuacacacaauauauugcagggauuaugaaggguauaauuagcuuaucauuaacuguuuaucacauauucuaugaaguaguaacuguuagcauggauuuuuauagaagcuauuuauuuuaaauccaaauuaccugcugggcgugguggcucacaccauaaucccagcacuuuuggaagcugaggcaggcggaucacuugaggucaggaguucaagacuaaccuggccaauguggcgaaaccccaucucuacuaaaaauacaaaaauuagcugggcgugguggcgggugccuguaaucccagcuacucaggaggcugagacacaagaauugcuugaacuuggcgggauggagguugcagugagcugagaucacaccacugcacuccagccuagcugacagaacgagacucugucucaacaaaaauaauuuuuaaaaaauccaaauugucuaaaguggauaaagucuaauguucacacugguauauguguuuuacaucuaccaaauacuauaaaaucuguauaagcaauuuuuaauaauacuacuuauuuauuuccuuauuuuacagccuugcauugcauccugaacgaguguugguagcaacaggacaaguugggaaagagccuuauauuuguauuugggauucauacacugugcagaccauaucaguuuuaaaggauguucauacacaugguauagcuugcuuggcguuugacuuagauggacagguaugugacaguuuuucauuuuuuucuaaauuguauguuaagguauauuauagaaaaugauuauaaaucuauaaauauuaaauuggacacuugaugaaaauuauuuguccaaagguggagguggguagguggggugggagguugauauauaacaaugggguuuuuauuucaucaugucaagaacuuucucaauugaauuaauuauuaccuugaaagccaaagugauuuugauucaguggaauauuacaugguuauuauacagauuuuucuauguaacucuuuuccagauaggguauuuugacaggacagauggaugauaucuuaggaaaauuaaguuucucagaaagcuguauauguuuuauuuuaauuuuauuuuuuuauuuuuagagacagggucacgcucugcugcccaggcuggagugcagugacaugaucauaacucauacucuugggcucaagcaauguuccugccucaccuuccugaacaacuaggacuacaggcacauaccaucaugccuggcuaauuuuuuuuuuugguagagaugggaucucacuguggugcccaggcuggucucaaacuucuggccuuaagcuauccuccaguguuguugaccucccaaagugcuggaauuacaggcuugagccacugcacccagccuguauuucaauuuucaguuaccuuaaagguugucuauuaaaauuauauuuuuauugaauauaauggaacaauuccuaugaguuauuuuuuauacaaaaucaaaguucacaacaaaggauauaauuaucauucaacugacuaaucaguuucuaaauuaucaucuacuucuagucaaugauuuuaaaaaguuaaacaagccaagagcuuuuuuuguggugcuuuuauggaaauuguuauaccuaaaaauacuuuaaaguuaccaguaaaaaguuggaucuugcagguuguucauuuauaaucuuuaaaaguuuuauguuauaauuagacuuuaaaaucauuuuaaauuuuagaacaauuuuaguuaucugcuuuuuaauucauaaaauuaguuuuauagaccucaauuuuacagaaacaaauuacaguguguucuauccccuugaacaugauagccaguagauguuuuuauauauuacucugaggaauagcuucuuugaguagcauagguuaaugugauuuucugguagugagaugagagaguucccuugaccccuuugcaggacuuguaacaaggguguagcucguuuaguuggcugcccagcucaaaccccuugugggaguggggcaugcaggugagagguugcaggagagcuggggugagugccuuugggugcuggcuugccuguggcagcaucuaagguuacccacaaccucuggagccccagaggguguguguuacaaacaauauucuuugacaccagcagcuuaaguguugaacaacucagugaagagucagugugacagccuuuuuggguuccugcacccagugcauccuggauuguccagcguccaggaagaaccagguuacacgaacagauugaagggugguguauauggaggauuuuauugagcaauggaaguggcucuaagugguauggcgaacuggagaggggauggagugggaagauaaucuucuccugaccauccugggccaaacuccucuugauaugcagacacuucucuucucuccuucucuacagugcuguuuugcuccuccgccaguggaguuuggggauuuuauggguacaggguugggguugugggccagagugauuuuggcaaaggcaacauucgggugggaaaacaggagugcauguucucauugagggccagggguccaggcuugaggguggaacccuugccagggaccccaccuucuucuacccaguauuucccugccuccuguucauauuaguaagagaugacuuucugguaauggaucuauaaagacuuaauuggaaucucuuauuuggaaaaaaaaugugcuucuagguuuauaucaccauauagcaguguuuggcaauugcacaaacuuaauucauaucccauuuuugcuauuauuuuucaagucuuaauguucugucagaauuucauuuucuucuuuaaaggaaauaauaccuauuucauagcauaaaauguuauaaaacaaaccuacaaaguuauuuuuaaaaaccacuuauuuaagguguuaugaaauucaagccauuuuaauuauaagcaucuauaacauuaaauauagauauuuucuucuuagcuuuaaauuugcccuuucuaaauguaauauauugcauugcugaggaauuucuucuauauauccaaggagaaaucaugcccauagcuuuuacuaguugaaaguguuuaauuucacuuacuuugagcaacuuauaggaaaagucuuggguacauguauuucauuaucagagaucuucaugagaacauauuacuuaaaauuuuaaguucauaaaaacauaauagcuaaagguguugagcauauaccaagugccagguauuaugcuaagccugcauuaucucauuuaauccucccaacaacccuuuggaauagaugcuauuauuaucuccuuauuuaaauauuugaugugcuaaaauuuuuuauggauacuuccaauucaguuaauggacacaaauaagauuuugucugggaauaggaucagguaggaauuugggaagauggauagaggcuucuuuaucugguuuucuuucucccucucugauuauuuuuaucuuuaaaggagucuuuccuugucugcuucuuaaauaucaguguucuucaggagucuguagccuuuucuuuucacuuuacuuacauucucugggugaguauauaggcccaugacuuuaacuuccauaucagcuaacaguggcucuggcuucucaacucuaaauaucacacuugaauguucuguagauauuccauuuucuacauuuaaaacugaauucucucuuuauucgaacacuaucaaaaaaaaaccaacaaacaaaaaaaaacucuuccucuugacuucugcccuaccucuccagccuugucucuugccgcuuuccaguuagcacuccuucccuccccuggauugaauuacuggcacucucuugaaagcaccaugaucucucuaaucuugagguccuuuguucugaaauguacuauuacuuuucuacaaacugucucugacucucucuuccaauuaauggauuaagcauuacuuuugcuugaaaacuuuauucucuuucucaccuaccaagucuggguuaaaagaaaugauaaaguaaaaaaugauaaaaagcuagaagaggagguaguauuugcugugucauuucuaccuuguccugucuguuguugcguaaucuaugcauagggauguugguuugggucaugauauguuuaucaagccuacagagaaaguacucucaagucuaguuuguuauugccuguaguugcagaacuagauguauugaggcucuauuuggauacauggaauuuuaaaguuuuuggccaauuguguuuugcuguguguauuugaugagcuauaccagacagaggagacauuaguagaaagaacagcagugccccucuggcuauuccucacuuaauauacuugucuugugaaauuuuaaccucuacacaguauucugauagcaagagguagauacauuuguucuagcuagauuuuugcugaugcccuuugguucccaaauaguaaauacucucaggagguacaaauaaucuccucuuguucucugggcuuucugcuagcuugauuugauggagagucauaacaaacuguauucuguaucuuuuuauauaaauuauucauucuaccaauuuuggaguuuaaauaguaaaacuuucuuuucagaaauuguaacuggguacuagauggcauuucucauuuggacaguuagagggcguagguucuuaaagcuaauuaagguuaugguaaacuaauaguaauaauaauaauaugaugcaaacauuuauguaacaucagucauauaccaggcacucuaacuccuuuaaguaguacauaugucaauuuucacaguaaccccugugagguauuuuuauuuguccccauuuaacuaugguuauaguaaacuaauagcaauaauaauaaugauaugaagcaaacauuaaauaacauuaaccauauaucaggcacucuaacuccuuuaaauaguguauauguugauucucauagugaccccugugaaguaauuuuauauccccauuuaauaggugaagaaaguaagguacagggaggcuaaauaauuguccaaagucacccugcuaguaagagaugauguucaaaccuaggcaaucugcuaccagaaucugugcuccaaaccaccauuugauaagcugucuauaguaagugaaauaguaaauauuuuaaacuuugugggccauuuggucuuugcuauaacuacucagcucugcauugcagugcagugugaaagcagucauagacaaugcacgaaggaaugaguguggcuauauuccaguaaaacuuuauuuacaaaaacauagguacagacaggauuuggcuugagaguuguacuuugcugaccccugcucuaaaccaguacuuuucacaguauguguuguggguuuuuccucacauuuuucuuguuauuucuucugugaccuuucaguuacuuagaaguauguuguuaauuuccaaauauuugggagauuuucuggauaacauucuguuacucuaauucuguuuuugucagagaacauacucuguauuuuaauuuuuuaaaauuuauugacacuuuguaauccaaauuuuugugaucuucaugauauuucauguauauuuggaaagaauaugaaaaaguauauucugcuguuuccuuucuucuguuuauggugcuaucgucauuuauuuauuaauacuucuacauauuuugaaaaccccauaauaacuguuauuuugccguaaauaguuguuaaaacuuuuuuaaugagaaaaaucuuacauauuuaaccacuuggacacucucauauguguaaguuguuucuauuugguaucauuuuacuucugcaugagaaaacuuucaugaucauaucuuguagugcagguuuacugaugauucauuuucucagcuuuuguuugcuugaaaaagacuuuguuuugacucaauuuucaaaggauauuuuugcuuaguauacaauucugugcugacuuuuuucugccucagcacuuuaaacuguuuguccauugucuucuaacuuacaucacuuuggaugagcagucuaggauaauuuuuaaaucuuuguuccuccauacagcaguuguccuuuuuugucuggcugcuguuuagaauuugcccuuuagcgauggcuucagcaauuuguuugccaugugucuuguguguuuuuucugugugaaugauuauccugcuugggauuuguugaacgucuuaaauuuguggauuuaugguuucaucaauuuaggaaacuuuuuacuauuauuucuucaguuuuuuuuuuucuuuuccucugucuuuucucuccuucuagagccaugauuaccuguauguuagaccacuugauauuuuccugcaggucauugaagcucugucaauucuuuuuuucuuuuucuuucuguacuuuauuuuggauggguucuauugcugugucuucaaguuuauuuaucuuuucaucauugucugagcugcuguuaauccuuuggaguaaauuuucauuuuagauaauguaacaguuuucuguguuguucuuuuauaucuuuuuuuauucuugguauguuugagauaauucuugucuugaaaauguuaauuuuaacagcaaaugucuccuaauuuuaauuaucucuggguuuccugagucuguuucuauugagugauuuuccccagguuauuagucacauuuuccuguuucuucacauaccuguaauuuuauuauauccuuuuaaaguauauggacacuguucuggcaaauagucaaguuccucaugaaucaguuucaucuuugugaaaagcuugcuuucaaacuuugaugaggcagcacuagaguagcuuuugcucuagaauuacugguauaauuucacuauuaagguaugacacucuccuccugaccucaggauuccuaaugacugcccagcgaguucaaagagguaucuucauucugguuauugagaauuugagugauucuggacccuuugugaucucugagaauuuuuugcuuuuagcucucuaguaauuguucuuuuucuagaauuucuucuuugcaugaccucauagaguucauccuaugcaugcagagauuaauauucucaaaucuuacuauagauaguuuuacuggagcucuuuuccugcucugcaaauucuaggcaucuuguccucucugaacuccaggcucuguuuguccaaauuaguaagucuaccaggcucuauuuggauuccaccuuucugugccauggucuagaaauugccuccuagauggaagcucgggugauuacaggacuuaauuuauuuguuuuccccucuuucaggguucacagugcuuuacuuccaguugcaaaugucugaaaacauuuguuucauguauucuguacaguuucuagcuguuuauggcaggggugggucggggaggguaaguucagaccuugauacuccuucauggcuagaaguccaucuuuuguguuuuuaaaccucucucauacuuucggucucacuguccacuucuguuuucaacuuugucuuuucaucuccugcuaaucuuguauuuaacucuuccauugaauuuuuaacuuauuuuauuuuuuguuucuggaaguuccguuugcuucuucaggucuccuuggauacuuuuuauagucucguauucuuugcucauauacagauauuuugaauccuuaauuuuauuucgcacauuaagcuuauuucucacguuaagcuuauguuauuuaacuaauaaugccauaucugauguuuuuugcaaggccgacuuugcuguuuguugugacuugcccauucucacucaugguuucuuauuuuguuguguuuguguguguggguggggugguuuguuuauuuuuucagcuuauuauuacuauuuuuugagacagagucucucucugucucccaggcuagagugcaguggaacgaccucagcucucugcaaccucuaccuccuggguucaagugauuccccugccucagccucccgaguagauggaauuacaggcgugagucaccacgccuggcuaauuuuuguaauuuuaguagagacgggguuucaacguguugcccaggcuggucucaaucuccuggccucaagcaauccaccugccuuggccuuccaaagugcugggauuacagugugagccaccgcaccugacccuuuuuuuuuuguuuguuuguuuagcuuauuuugauugaauugcuaccuguaggaauucuuugagggauagaucaaaguugcgguacuucauuuaggauuuauauuugcuugggccacauuguugaaguugcuugaagacacagccaacccugaagacuacuuugaauuaaauuuccuaguugaaggauucauguuuaaugagaauuuaggccagcaaccaugugaaggaugcuugugguuacaaauguucagggagguguuucucccucuucaugaguugccuccgcuucuuuaggaagggguuauuuguuguuuccgagagguuuacugcuuuaaucagaggcggucugcaauucaaauccccaccuuagguaggcccuagacuuugucuccuaucuuccucagcccacagcacagaaaucagggguacaaguauucacccgaugccuuuagaguccaguagguguagguguuuucucauccuccagguuucccacuggaaaauuucuuaauuuuucgacagcucaucaguccauuuaaaaacaugauuuuacauuuuaucuaguauuuuuaguuuuugguaggagguauauuuaggauauuuugucaauccuacuguuagaaauggaagucucucuucuguuucauaaugugaagaucuauacauauguggaaacacuaacaaggugaaauacauucagccuuuaugaggucuauaaaauauaggcauauauguuuuauguuuauaaaaacccaugaguauaauuucuuugcuauuuguaauucaguuucucuuugauuuguuugccuuuuuauuccuuccuggacuucuuggacauaaaucagcgcuugguuucaguuggacuugauucaaagaaugcaguuuguguuugggacuggaaaaggggaaaaauguugucuauggcuccuggucauacagauagaguaaguauucucuuuugagauuucuaaugaguacuggaagggaaagaccagaagagaguucaggagauuuuauucuucuguauuuuguuauugccagauaggucauauguaauuaaaauuuuacaauugguaaauaauuguacagauguaaaaagucuuaaaguguuagaguacauauguauuguaggacuuggaaacaugauuugauauguauagcauuggcauaagacuuuuuuucuuuuuuuuauuauacuuuuaaguucugggguacaugugcagaacgugcagguuuguuacauagguauacacgugccauggagguuugcugcacccaucaacccaucaucuacauuagguauaagacuuuuaaccugguguuugcuucaguaaaaacaauguauuuucuuuacauuuuuuaaaacaguuuuauugaaauauaauugauauacauagggaugcacauauuuaaggugugaaguuugauggguuugacauaugcagacacccauuauucaaaucucaauuuaaaaauugaaugguuugagccuagggucuguuuaguuugguuuaccacuaauuuguuacauauguauuaugguuaaggugaaaaauaauguugcuuguguggauuuaaaauuacguauuacuauuacauuuuuuagagaccuaacauuuuuaacugaugacuuguuagaauauauauuccucauuccaaauuguauauaaacaauacaucauagccagcuuuuaauuaaauauuauacuauuuuuauggauguagaucaaaaaaguuguaaacuccuaaaagugucuaauuuguguguauguauauguaguaaaauccuaaccugaaccagcacagaggcauggccaaugacuguauuuggugggaauuuaucauucuaaaaguuggguagaaaauuuuguguauauucgcauuuuggagaauacauuugguuuuuaguaggugcacagagaggccuauuacacacacacacacacacacacacacacacaaacacacaauuuagaccauuauuaaaauguuggauauauuuuauuagacagcuggcauguucuuaccugcuuagaucaaagcauuuugcacaugacuauuuggaauuuauauaaauagacccguuacaaaauaugacacugucaauggaguuuuugaaaguauuauugugguugaauauuucaaaguugcauugauauguuuuucauauaaucuguauuauggugaguuguuaaauauuaacuguaauauguauucuuucuucauuaucacuaaagagcaucacuuuguaaauuuuuggaguauaccaaaaugugaaguguacauuuuaguauaccaaaaauguaaaccuuuuagagguagguugauaaggugucaaagaaacaugacgacuaccagaaagcagaauaaaugaauuauuuuuuaaauguuaguuuuucuuucaucauuuguuuaauuacauuucucauucguauuuuauuucaccuggguuuuugcuuguuugcuuuuguaacaaaauguuuugcauguauuuagaauuuauggaauuuuagaaaauaaugaagccuggagacuccccaaaauuugaguuaacuuugaccuuuaaacagugaaaaaaauuacuguaaaaucaguguuuggauucuuuauguaaacaguucugagugauagaaagcuauaaagguguuucuuauuucuaggcuguguaagugucacguuccauucugaaucucuuuucuguagaaauuaugcaagcaccucccuucguguccuaauucuguucaaccauucuuguuauuuauggaccaaauuuuuuuaaaaauuaaaaauaaacagagguguuaaauuuuacuccaguaguguuugaaguucauagaaaugaagaaaugcuuuuuauuucuuaucauuuucaaauuuacuuuauuucucauaagauuuugaagugugggauguugauuauuauuuauugaggaauauuauuuuaugauuaggaguuugggccauuuggucuuuuggacaggauuuuuaaaugauucuggaaauaaguauuuuaaucaugaaucugauuuguuuacagauauuugauauuucuugggauuuguaccagccaaauaaacuugucagcugugguguaaaacauaucaagguacuagaagggucuuguuuuauaauagucacguuuaguucucugcugcuaaguauauauugcacuguuaacaauuuagccuacuuucagaauuuugauaguacuuauuuuuaaaauggcaauguuuuuauuguucuuauguucagucaaacaaauauauauauuauuugcuuugaacuauuguaaggaauauagguaugaauaggaaauuaauaagccacauuccauaaagaaaucuguagucuagugaggcaggauuuacuguguccauccuguuucuucauguuucacuuacaaaguaaaauguugagaauaggaaagaaaugaagaguuuuucauuuacauagaauggugugggagaagcaacaugaguagaccuggcuuugccauuuauuagcuguuuaaccugcuaugaguuauuuaaccucuuugagcuuuuauuuucacauuuuaaaacugugacugcuguuaccauccucaaagaauugaugauuaaauaaggcggcaguguauauucaagugcuugucauagugccuaacacauggucugcuuucugaaaguguugcuuuuccuuuuucuauauuugcucccugauuugaccucagccuuuaaauuuuuuuuuugacaaauaaugauaguacauauucauggguacauagugauguuuugauacauaaaaauguauggugaucagauuaggguaauuagcuaucaucccaaacauuugcuauuucuuuguuuuaggaccauucaauauccuccuucuagcuauuugaaacuguguauucauauuaccuauacucauucuacagugguauagaguaguagaacuuauuccuccucucuaguuacaauuuuguauccuuuaacaaaucucuccuugucccucucucagccuugauagccacuauuuacuuugcuuaugaaagcucuggguuuuguuuuauaauuacagcucagauuuugaagccuguaaagucaguggugauauucauuauuauguuuauaguuacuuuuaaaucauuggaacaaauuggaauuaacuugcuuuacuuccacugucugauguaacaguuccugguaacaguuaauuccuagugaauuaauuaagguucuguguucacauucuuuauuucaauaugccuaacuccauccacguuuucuccagugcaucuuucacugcugcugcaauucuugauuuguuauucugguauugauuugauugauggauaguaguaaauauuuauuuuuugacaaauauuuaauaccaaaaaggcuguaugcugggcuuuaaggcacaugauauaagcacugugaagguauuuuugucuuguucaucuuugauggacaguguguuugauaugguacuugauauauauuaagugcuuaauaagugauuggcaaauuaauuaugaauaaggagaucuuacuauuuuauauuguaaguaaagcuaaaggcuccauuuucagguuuuuauaaaaagcuuaucucaaacuaaauaaacuauauuuuuauaaugaguuacauuucuuucccuuugcuagaagaaaugaauaguaacauaguucucuuugcaggcaauacaugugaggaaauuaauucccagagaugaucuagaacugcacuguccaaccauacauagcuauuuaaacacaaauuaguuaaaugaaacuuaaaauucauuuccucagucacacuagcaguacauuucauaugcuuauguaucuaguagugguuacuguauuggaaagcguguguguguguguaauauuuucaucaucacugaaauuucuauuggucaauauugauuuggauucuagaacaauaguucuuaacccuugcugagcaucaaaauaauuuggguaccugggcuucaugcuucagagauucugucucaguucaucucaauugggaguccaggcaucccauuuuaugauuucccaggugauucuaaugugaagcuaacauugggaaucacugaucuagaagaaaauaauggauucaaauuaggacaugcugaaagaaagaaaacaagccacuuauguacacaaauuauggagauuuuaaguuuaaaaauuacaaaguuuaauuaaaguacucauuagaucuuugaauagauaaugaucauaauuuuuaguucuuugaggcuucaaauuuuaaaauaagaauauaugauaauaaauuauuuuaaauguuaauuacuuauuacaaaguugaauuuuuucuuugggccuaauuucuuuaugcagaacuauuuaauguauguaucucugcccugucccauuuuuuugguuuauuuuuuagagaugggauccuaccauguggcccaugcuggagugcaguagcuauucacaggugugauuuauagcucacuguagccucaaacuccuggccucaaaccauccucccaccucagccucccaaguugcugagacuacaggcguuugccacuguguccacuuccccccaacuccuuuuucuuuaaauuucucuccgugaacuauaaaaauuuaccuaauuccaccuaauagaacaaaagcccugguaaugaagauucaugguuaacuucuuauuuucucccaagaaugaacaaaucauuccacauggacaucuaucuuauuuuuuuaagcuuuacaagcaaagcaauugcucagcuuugaaaauaucaaauauuauaguuacagugagcugcaguuaccgugagcuguagcauacucuuuuuuuccuauccuuaauguuucuaucagagagaguauguuagauuugguccuuuuucuucuucuuagucuaugaugacuuaccuucauuuucauugcuaaccgauucccaacuuuuuaaccuaaaauuuuuuuuuuucuugagacggagucucacucugcgcccaggcuggagugcagugguacacucuuggcucacugcaaccucugccucuugauaucaagcgauucuugugccucagccucccgaguaacugggauuacaggcaugcgccaccauaccuggcuaauuuuuguauuuuuagcagagaugggacuucgccauauuggccaggcuggucuugaacuccugaccucaggugaucugccuaccuugcucucccaaaaugcugggauuacaggcaugagccacugugccuggcuuaaucuaaguuuuauguagauuucuuuucagaaaccuaaggaaagcauagcauauuuuaaaaauaaucugauucaaaccccuuauucuuacagauaagaauugaaaccagugacuauauagcuaugcuauaacguagcuuuugacagcacuaggaugagaaucugaacauugaaugcuauuuuaucauaaggcaauuucuuaguuaauuuuuagcucacugcucuaauauagcaucaaaguauugggaauguuuuacuuuauuuuauaagaauucuuugguaauuugauuauacuauauaccuuuuaguucuggaguuuauguggaaaugcucugaccccaaaacgaggugucuuugguaagacgggugaccuucagacaauacugugccuagccugugcaagggaugaauuaacauauucuggugcacucaauggggauauauauguuuggaaaggaaucaaucuuauacgaacaauacaaggagcccaugcuguaaguacauuuaaguauuuuaaacacuuucauguguauuacuuaaccuugucuuagaaugauagacugcguaauauaguauauuguuucuagucaguuugguugcuugaaaaugcuuuucuaacugaauuaucuauuuguuuucaagauuucaaugaagaaaucaauuagacucauugauauuuauuacauuaguauaauuaguaucuuguuaaagcuauugcuuuaguauggugucuuucugaagaguaguguugaaaaaaagcuuguugacuucaaucuaaaaguauucuagauuaaccacaccagaauaaagcuagugcucuugaggcuaauuuaccagaggcaauuaaauuuucguguaaauaacuuacuaaacuuaaaaagaaaucugcuguuuaaauucuuagcguuuuuugguuugagcuuuuuagcaguuugggucccccuuacaaaguaaagggagcuagauagcacaaagcugccauguuguuaacagcaagaucuuuguguagaaaaguccucagugcauuacauuucuauuaauuggguuuuccuacccuuuucuuuuuuacuuuuuaaauuuuuugugguuguugaauugguuuucuuuccuuuauucauuugaauauuaggguuauuaaucuuuugacagucauacauguugcaaauauuucuccaaucuguuugucuuugcuuauuacaucuuuucucauaugaacaaauuuaaaacuugugggugaucugccaugccuagaaaagucucucacagcccaaaguuaccuaaauguuauucugaauuuuucuaauauucuuguuuuauauuuaguuauaaauaguuauuuuuuaaguucauguauaauucauuuuuacaugugguauaggaauuaaauuuauuuucuuuuauguucuauccauauaauuaaauaccaccuugguuauauauagucaugccuugauauuuugggggggauuggcuccagaaccacagauaccaaaaucuacacauacucaagucuugcccugggaaaccugcauauguaaagcccucccuaucuauggguuuugcaucccacaaagauuguauuuugaucuggguuucauugcuaauguggaacuguggauacacagcugacuguauuuauugaaaaaauccauauaagugagccagugaaguucaaauccacaaggggcaacuguauuaaguucuuauggacuuacuucuagauuuucuuuuguguuuucugauguauuuguuuauucuuauauccuaccaaaauauuguuaaauugguuuaaaaggguuucuaccuucauauaguagauguucuuaaaaaauauuugucguuaaauuauuuuauuuccucuucuaggcaggaauuuuuagcaugaaugcuugugaagaaggcuuugcuacugguggcagagaugguuguauucgucuuugggauuuaacuuuuaaaccaauuacugugauugaucucagggaaacagaccagggauacaaagguaauaacaaaacaaaugucuuauuacuaggcaaacucuaaacuucccaaagauuaucucuuucuuucagugaguauaaauguaaguuuuguaaauauaaauaagacuuauauuugccucuucacccuguaugcauuugauuaaaauucuucuauuaaggagaaauuuugccuguaaagaguuuagguucauuguuaggagaaagauucuuucauaagucuaauaucuauuauaaugggaccuauagagagaugugagagguacucacuuagguaucuuuggauuuugaaaguauuuuacuauuagaaugcuaaauauaacuauuuaacaaacuauucuaaauaaacaguuggggguaaauauugaggguugggaaacuuuuguucaggauaauuuaaauguggauagguguauuuuuccuucacccaaauuugucagcaauugggggauuuuuuuuuuuucucuuggggauuaaaaaaaauugauguaauaaaacaggaccuuuuacuauaaaagcuacccacagguuuguguuuaaaccauauuccagucaccuacaaguugugugaccuugggcugguaauuuacccucacuguaaauaaggagaauaagaauaaauauauuauuuaggauauaggauccuauauaugaauugauauuucucaaauguuuauaaggauagcacauaauaagcauguaaauguuaauugguauuuuauuuucauuaguuuugcuaaacauuauugugcuuuaaagcuuacaaaauaauuugagacuuuuucuuaucugauccucacaagaacauugugagguacacggugucuuuauauuggccauguaacacacaugagaaaacugaaaaacacgguagcuuuccuaagauuacaaaagacauucaggaguaggcagaaaaaguaaaauucucucuuuuuaaugauauuauaaguauauugaagaaauauagacaaguaaaaagauuauuaaaaggaaaagaauacaauucuauaaagguaauuuacuaauugaguacuuauugaacaaugcagacugaaguguuauaagacuggcugagcaaguagacauggcuagaguugucuacaagggagaaggaagaagaguacaugucuugaaggauggguaggaacuagguacauaaaaagacaaauauuucauguagaaaacaacauggacaauugaagaaaaugugaguauagaucaaggacuuacauauuucuucugucucacaucuaagauauaaaagguacaaaauuaacuucaauuuaggaagauuggaauuauugacacaggauauuuugggugcuaccuugccagcuggagaccuccauggcgggcgcaaugccccugucccgggcugcacugggcuccaggcucgccaggagguacccugcccacuuggccuggcaggcugcgcuuggcuuauacucuggcuggaucccacacuugcugcaggauccaugcucagccuguggcugggccgggugugcugugaccugcuucugccuugggcguuggcgucugguugaagggaaugugguggcaccuaaaaaacuuggggacucuagcggcccugaagccccaaaggggguguuacagcauguuaauagcucuuucaguccugcccaauaaaugggggcauguggugcccagcggcucccucuccuguugcuuggugaguaggaggggagugcugcaugguuacagcucugucuguacucacuguuuggugaguuccaaguucuugucccacauccaagaagaaagaaguuauacuggcagcuggcaggugagcaaggcaaagaguuuuacugagugacaaaacagcucucaauggagaggguacccgagauggggugaagucagguagucuccccugcccccaaccccccacccaaaggugggcaguccccaaauauggcugagucuggagccuuuaugggcucagaaugggggauugcaugcugauggguuugugaguaaaaaaaggcuuaaaaaaagcaccccucaaagaugggcacaacacuauaaaaaaaaauuagggaaggauaaauauguguaaaguaagugaaagguggggaucaaucagaggaaagugcaccaaaugggaagagacguucucaguugguccauggauuuaucugagacuuguagcuuggcuuucaggcuuuaaacugucuuagguuugaagguuggcuuucaccgggacuugccccuaucugcauagggauuugucugccuccugcugcuaucauuauuacagcauuauauauuaaauacaauuuacuuuuuacuagguuugucuguaaggaguguguguuggcgaggugaccacauucuaguuggaacacaggacagugaaauuuuugaaauuguggugcaagaaagaaauaaaccuuuucuaauuaugcaagggcauugugaaggugaacuuugggcacuugcuguccauccuacuaaaccuuuggcugugacuggaagugaugaucguucggucagguaagcaaauuauaaacuaauuccauaggcuggaauguauccuuagauaaacauaaagaaaacauggccaggcacuguggcucacgcccguaaucccagcacuuugggaggccaaggcgggcagaucacaaggucaagggauugagaccauccuggccaacauagugaaaccccgucucuacuaaaaauacaaaaauuagcugggcaugguggcgggcaccuguaaucccagcuacuugggaggcugaggcaggagaaucgcuugaacccaggaggcgaagguugcagugcgccaagaucauggcacugcauuccagccuggcaacagagugagacuccaucucaaaaaaaaaaaaaaaagaaagaaaaaauacuccgauuaaaacuuuauuagcucaugguauaacaaaugaacauaaguaauacugaaaauuaauagaauuauuaguaauauuuuuucucuuacaaauauaugauauggaguuuguuccauaucagaauguacaaaacuaccuccuccuuuuuaacaggaauauaauauuucacugcauggauauacuguaauuuauucaacuaauccauuacugauggaagauuaguuuccuccaguuuuguguauuuuagaaauacagggcuugcagugaauaucauuauacauuugucauuuuguacauguaugaauaucucugauaaauguuuagcaguagucaaaggaugugugcauuuuaaauuuugauagauaaggccuuacauagaggcagcaacaauuuauacaccuauugugaauauauuaccagugccuguuuucucacacccuuaacagaacuaauuauaaucccaaaaggugaaaaaugauaccuuguuauauuugaaaauauguauuucucuuauauugaggguuguuauguuuuuauauguuuagaggacauuuuuuucuuugaccuguucaagcuguuugccuauuuucuguuaguucauaggucuuuuucucuacuugauuuuaaauaagaucuaaugauaccuguuuauauauuaaagaaauuagaaaccuugucugugauagugguucucaaagugugguuccuagacgagcaacaucagcauuaccuaagaauguguaagaaaugcaaauucucaggccuuuuacaggaccuaauaccagaaauugagcgauuugugauuucagaagccuuccaagugacuacgauauacucaaaaguuugagaaccacugaucaaauuuaggaauugagauuuguuuaccccaguuugucuuuuuuuucccugauuucaucuguaaauauuucuguuuguaucuuuaaaagauaucucaaacaucaccacaauacuguuaucacacaguguucuguaucuagcuaguauagaaauuccugauugucucauaaaauauuuuuaugauuucuuaaaaucaggacccaaaugagcuucauauauugcguuugcugauaugucuuuucagucucuuuuauucuacagcuuucuuccuucccuuuuuguucuucuuacaguuuauucagcguuucccacauucuggauuuggcuaauugcauacccauaguguauuuuaacauagucuguguucccuguauccuguaaauugguaguuagauuuagagguuugaugagauacaguuaugaauuuucaggauauuuccuagguggugauguacuccugcuugaugguauguaauguguagucuccguuuuuucuaguagcagccauugaugauuaucgucuagauuaguauuucccaaccuuuuuucauugucacuuucuuacauuuuuuuucuugaucacacccugucuuugaaauuuuaagaccacagacaacuauguaucucuuuuuguauuguggccccuuaagagaaugcaaaccauuguaauauuuaagauauuuuaccccuaagaauucauuuuuaaccccuuucaagaaauauugcccccguugagaaugcauggccuaaaucuaucauuuuaauaagaauuucaaaugguggcauucuaauacuuacauuuaccacucauuauucauuuguuagcuguaauauuucuauaaagagaauuucuucucaucaauuauuuguuuauccugguuauaauaaaggcagaaaggugcuuaauucuuucccuauauuuaccaauuuuaaaaguuaggugguucccuagaauccuuucuguaaacuuuccacauuucuugccauuuuuucuguaggguuguugaucuuuuucuccuuuacuuuuagcagcucuuuauauauuauggauguuaacucuuugccuauaauguaaauugcaaguaauuucaauaguuuguuacuugcuuuuuuuuuuacuucguguagguuguuuuagguaagcaaaaauucuuguuguuguuguuguuauuuuucauauagcugaauuuaucaguauuuucuuucaugacuucuaggauuguaucauagagaaaucuuccccaaaauuauuuuuuaaaaauuuucaauauauucuuccaguacauuagugguuauauuuuuauguuuaacucccaaucuauguaaagcuuccuuuaguguaagaaguaagauggggacucaaccuaauuguuuccagauaauuacugauguuuuuuaugguaugcuaaucagucaugccauuuacugucauugugccagucuauuuuugggggaugggagauggcauaggucauaugucuguaaacuuacugugggggcuacaccuuaccucacucugugcucugcuaggagcuauucauaauccuuucauuguagaacugcuauuaccaagugccaccuagcugcugccaauaggacaauuguuucuuuaaaaaguaauuguucagacuacuguuccuguuauuggugggcaauuuauuuggaauaaaacaacuuccaaugaaaacaacuaaagauauuaguuaaaaugucaaucaccuuaaaagcuucaaagaacugacaagauagugaggagcuauccagccaauuugugaaagaaaaugggcauuuaggggcauugugccaaagccgcuuuuugcccugaaggcauuuuuccuuuggguaaacuugaccuuuguuuauggcuuugucuuggagcacaagggacagacaagacccagcauuugccaaaggaggauaguccaacguauggugcuaaagcuauaaauuaagcuccaaaaaauaucugcugcagauuuguguggcaguggagaccucacuucuuguuuuaaguuuugauagcacagaaguguauaaagcagcuugauauuguuauucaaauagcauuaauuguucaaaugacuuuaccacaauguaaguuucacauuacauugugcugcuuuugccuuauaauuuuagguugaauucauuagguaacaguauugagucuucaguagaagcuaauuuccaaauccauucaguguuuaauaauaucgcuagaaccugggaggcagaaguugcaauaagcugagaucgcgccacugcacuccagccugggaaacagccagacuccgucucaaaagaaagacagagaucaauucuucuuaauucagaaaaauuucaaucuugguucugagaucagaaaaucacaacaaaacuuaaccacugcuaagccauuuaacugcuguguuagugcaagucaggauuuucugcuucuguaucuggcaaaaauucacagaacugaaaauggccauacugcccaagguaauuuauagauucaaugccauccccaucaagcuaccaaugacuuucuucacagaaguggaaaaaacuaaaguucauauggaaucaaaaaagggcccacauugccaagacaauccuaagccaaaagaacaacacugaaggcaucacgcuaccugacuucaaacuauacuacaaggcuauaguaaccaaaacagcaugguacugguaccaaaacagagauauagaccaauggaacagaacagagcccucagaaauaauaccacacaucuacaaccgucugaucuuugacaaaccugacaaaaacaagaaauggggaaacgauucccuauuuaauaaauggugcugggaaaacuggcuagccauauguagaaagcugaaacuggaucccuuccuuacaccuuauacaaaaauuaauucaagauggauuaaagacuuacauguuagaccuaaaaccauaaaaacccuagaaggaaaccuaggcaauaccauucaggacauaggcaugggcaaggacuucacgucuaaaacaccaaaagcaauggcaacaaaagccaaaauugacaaaugggaucuaauuaaacuaaagagcuucugcacagcaaaagaaacuaccaucagagugaacaggcaaccuacagaaugggagaaaauuuuugcacucuacucaucugacaaagggcugauauccagaauuuacaaagaacucaaacaaauuuacuagaaaaaaacaaccccaucaagaagugggaaaaggauaugaacagacacuucucaaaagaagacauuuaugcagccaacagacacaugaaaaaaugcucaucaucacuggccaucagagaaaugcaaaucaaaaccacaaugagguaccaucucacaccaguuagaauggugaucauuaaaaagucaggaaacaacaggugcuggagaggauguggagaaauaggaacacuuuuacacuguugguggaacuguaaacugguucaaccauuguggaagacgguguggcaauuccucaaggaucuagaacuagaaauaccauuccacucagccaucccauuacuggauauauacccaaaggguuauaaaucaugcugcuauaaagacacaugcacacguauguuuauuguggcacuauucacaauagcaaagacuuggaaccaacccaaauguccaucagugauagacuggauuaagcaaauguggcacauauacaccauggaauacuaugcagccauaaaaaaggaugaguucauguccuuuguagggacauggaugagacuggaaaccaucauucucagcaaacuaucgcaaggacaaaaaccaaacacugcauguucucacucauaggugggaauugaaaaaugagaacacuuggacacaggaagggggacaucacacaccggggccugucaugggguggggggaggggggagggauaacauuaggagauauaccuaauguaaaugacgaguuaaugagugcagcacaccaacauggcgcauguauacauaugugacaaaccugcacauuguacacauguacccuagaacuucaaagcauaauaauaauauaaaaagacauuaaagcagcuguuauaacuacaaaaaauaaauucacagaacugaaagugguuaguuaaauccacaggagcaaaugaaguucaccauuaaugcuauugguuaaaaaaaacgagagagucuuauuuuuuucuucacuaaguacgugcuaaagaauaauacaaugaauaagcacaggcuuuaaaccccuuacguuuucauaaucuguguaaauuucuuuaagccauuuuuucuauacauacuuuuuucccaccaucaguuaguuauaauucaucuuagcagauuccaauuuagguugcauugaauuaguguuuucucaaugauuuugaauauauucuugucucuaguuguuucaugcagacuauucauaaaagcaaauucuugucacuucacacuuugcauugacuccccaaauaaacaauugaguaguaucuguaacaucuguuaacccaugaagaaucaaggaaaaccacucaaaauuauuugucguguuuuuaaauuaauuauugguaguguucccaauauucucaacuuuuggagcaacuguucucacagaaaggcuaacagucuuaaacaagucuguuuucucuggacauauuucuuaagcugcugcaauucaaaaugauuuaaguaauucauuaccaauaaguagcuuuccuugcuuggcuaacaaaucaaccacucagaaacuuacuucucuugcaaccucauuguauuuuuaaauuugugaauaacuucugugaugagauauucuguuuuaaauuuucuaauuuuucugagcuuuccugugaguuggaaaaauugugaugagugcuuagucugguaauguauauuuguauccuuuuagcacagcuacagugucauugcauaauaaaccuaaugcuuugccaucuaauucaauaacaguauaguccaugcuccauugugccuuaaaaauguaacauucuaaguccaguauuaauauauacauugguaaacaaaaauaauaacaaaaugucacuauaugguaauacagauagcccucaaaauucugucaaguuguaacugugucacugaaaauuguaauguacuaagaagcaguccaaagugaugagaguguaucaucucuuucccaguaucucaacucugccucuguagugugauacaaagacaguauguaagccauagacaauacauuaaaaaaacaaaaaaaaaaaacaaaaaacaagaccgagugugguggcuuaugccuguaaucccaguacuuugggagacugaggcagguggaucacaugaggccaagaguucaagaccagccuggccaacauggcaaaacccugucucuacuaaaaauacaaaaauaagccggggaaugguggcacaugcuuguaaucccagcuacucaggagggugaggcacgagaaucacuugaaccugggaggcggagguugcagugaacuaagauugcgccagcacuacagccugggugacaaagugagacucugucucaaaaaaacaaaaaacaaaaaaccaaauaaguauaugccuauacuuccauaaaacuuuauuuacagauacagaaaguagaauuucaaauaauuuucuuguguuucaaaauuuuauuaaaacauuuuuuucaaccauuuaaaaauguaaaaauuauuccuagcuuucagacuguacaaaaauaggcagcaggccugguuuggcccacaggacaugguuugcugucccuugugguaagagcauagaaugucaccagcaaauaucauauuuaauguugaaguauugaagauuuuccuuugaaaucagaaaaaagacaguuaugcuauuuucaccauucuguucagcuauagacuagaagucuuggucaauauaguaaggccaaauguauauguguauagcauauauauguauguguauauauauguacacguacacacacacagauuggaaaggaaaaaaauaacugccauucucaguugguuauauauauauaugauguguuuauauauauagaaaaauccaaagaugaauuacuggaauugaaaagagaauuuagcaaauuuucuggauaugaaaacaauauacaaaaaucauuuuuccuauaaacuaguaacaauuuuaaaaauacuauaaaagcauuuagaaaaucuuaguuuugcugaucuuuuucuaaugucuuggggguagaugccuauuuauuaaauuguagccuuuguuuauuuauaauguaguuauuccuugcuauuuuugggggagauuacuuccaagacccccugcagauaccauaaucuguggauguucaaguucauuauauaaaaugauauauaauuugaacauccuccaaaauacaguuauuccuugaacaacacagguuugaacugcauggguccacuuauagguggauuuucuuccaccucugccaccccugagaucguaagacaagccucuucucuuccuccuccucagccuacacaaugugaagaugaugaggauguagacuuuuaugaugauccacuucuacuuaaugaauaacaauuauauuuucucuuccuuaugauuuucuuaauuguuuucucuagcuuacuuuauuguagguauacaguauuaguacauauaaugcacaaaguguauguuaaacaacuguuuguguuauugauaagacuuccagucaacaguaggcuacuaguaguuaaguuuuuggagaguuaaacauuagacguggcuuuuugauggcaugggaauuggugcuucuaacuggugcauuauucaagggucaacuguacuuuaaaucucuagauuacuuauaauaccuaauacaguguaagugccguguaaauaguuguuauacuauauuguuuagggaauaaugacaaaaaaaaaaagucuguacauguucaguacagaugcaacuaucauaggccuaacuacauuuuccuuccaugguugguugaaucuguagcugcagaacccauggauacagagggccaacuguauaugcauuuaaagcucccaaaaguuccuccuaaguacuguuucagcuauauuucacaaguuuugauuuuaagcaguuuuauaacuuacuucaaaauaguaacaaaucauuaagaguucaucuuugucuuugucuuuuagauuauauggaaguauaauucuuaauuuucaaacaauggguaucuucuaguuaucuuuuuuguuguugauuucuagcauuguggucuggaacagauucugaauuuggauaguuuuaaacacuagacuguauguacauaaggauauauacauaugugugucuacacacacacucucucccuuuggucaggguagaaauaaccuaucuaaaagugaaagaaucaauguacugcauuguuuaaaaaugcauuguauuggcugggugcgguggcucacaccuguaaucccagcacuuugggaggccaagguggguggaucaccagagguugggaguuugagaccagccugaccaacauggagaaaccccaucucuacuaaaaauacaaaauacaggcgugguggugcaugccuguaaucccaacuacuugggaggcugaggcaggagaauugcuugaacccgggaggcggagguugcagugagccgagaucacaccauugcacuccggccuggacaacaggaacgaaacuccgucucaaaaaaaaaaaaaaaaaugcaguguaucacacuacagaugcagaguugagaaguugggaaagagaugguauacucacaucccuuugcacugcuccucagcucauuacaaauuucagugacacauuuacaacuugacagaauuuugaccgcuaugugcauuaccauauggugacauuauuauuuaucaccagugcauacucaucauguugacauaagaggaaaaagauaaaauuggacuuugaguguuacauuuuuaaggcaaaguggagcauggacuuuacuguuauucaauuagauggcaaaacauuguguuuauuaugcagugacacuauaacugugcuaaaaggauaccaaaacaacaacaacaacaacaacaacaaaacauagccagguuggguggcacauuccuguagucccagcuucucaugaggcugaggcuagaggauugcuugagcccacagggucaagguuauaguaagcuaugaucacgccacugcacuccaaccugagugacagagugacgugaugucgccaaaaaaauucaaagcaaaagauucuaucaacuucugucauuuaagcaugaacaauucccauuuucauagauaagaauuucuugccacacaacagauaguuaagauaucuagauuuaucuuaauuaagaugagauuauuuuaaccaaaauauuuuuacuaaaguaugcauuagcuaaccuuuuuuauuuuuuaaauuaaauuuuacaggauauggagccuaguagaucaugcauuaauagcaagguguaauauggaagaaccaauucguugugcagcugucaaugcagauggaauccaucuugcccuuggaaugaaggauggcucauucacuguacuuagaguaagguaugguauuaggguagaaacacauaauaauuuuaucuucagugauacagaauauaaguaauuuucucuucagcgauacagaauauauaauacuuguuguuuuuaccuauuuauccuuuucucuuccccuucuuauuaauauauuucagauguuaauuucaucaaguauaaaaauauauuuauaaaaauagcuuuguccgaaaaauaaauucagaagccuugguuugggggguuaagaaugcuuaauagauuaauggcuaaaauuuugagcuauaaaguuugggucccaacuaccuuuuccuguuaguauagauuuucaguaaugaucccucuccguuuaacaagcugaggcuguuaaaaugggguuguuguuguuguuguuguuauuuacagccuuaugcuuuaaaaaaugcuuccaucucuucuuuuguuugaguaauuagaaaaauuuaaagaauuugguaaagcaguuaacauuuuguguugaauuauagauagauaaauucaauugaauucuaugcagucaguaagaaauuugcuguagauccacaggauaaguacuuacgaagucuuucuucucuaccucagugaacgguaagauccuucgcucaguugcucaauucagaaacuauuaacacaguucucucuuuugccuccccuguguaguuaauuaaagaguucuggagagucuacuucugagauagcucucauauuaaucuccuuccuucuauucucaccauuguacucuuguguaggcuucugucaucuacuaacuggauugguggaauagccucuuagcugaucuucuuaccuccuguuugguuucccucaagaccuuucuucacuccacagugauggugauuccuuuuaaaacacauugugugcuuucuucuuauuucuaaaguaugauaaaggcuuuguacuguccuuaggaugcagcucauaauccuucacgugguauguagugcccaucuuuccagccuauuucucaguaccccaguuucuuucaucuauaggaaacuccuuuccuguaucaccaugccauacaguauauguucagaacuuauucacuaauucuaacugaaacuucguacucuuuaacuaacaucuccccauuaugaacagauacauuauguuuucuuguacuucugagccucuacacgugcugacuccccuuuccgagaccgguuuuuaaguuaacauuuuuuauugugguaaaauauauaauauauaaacuucacauuucaaccauuuuuaaauguaaaauucagugccauuaaguacauucacauuguugugcaaccaucaccacccucuagcuucagaacuuuuucaucuucccaaauggaaacucuguacccuguaaaaaauaaucccauucuuccaucuccuaagcccaugauaaccaucauucuacuuucugggucucuaugaaagacauaauuugacuacucuagguaccucauauuuuaaaaaaaugaauauaacauuugaauauaaauuaaagcuuuuuccacagagcucuauaaauaugucauauuacuuuauuuugucaugcugaaacagcuucuugaagagagaugaaagacuacgaaaccucccuguugggcuauccauacuguuauaauuugggcacugauuugaucuauugauucuggaaucucuguaacuaucaucaucuaagauuaaacaucuguucuuuuucucauugguuguuuaauuucuuuggaggcugcucuucaguuuugcagguuagaaauaauaaauagaaacaccuggucauuacuuaugaauaauaauuaauauucaugaucagcuucauuuuuucuuuucuguaagaacugaaaguauuggaaguacuggaauuggagugcucacuuauagagguuuuacaagaauuuaagaugcauguaaaacaccuaagaauuccuaucauaucugauacacauucaaaaguagugauuuuuuuuuaguuauacauuuacuugcccuuucaguuacugaaugcaguagacuggaugaaaaaguuuuuauuccuaauaagacuguauuuuagcaccugaauccaacauugcuaauaguauugaaaggguuauucugauuauuaaaugccuuuaaaagugaaccacaaaauucuaacucacaaaauggucuucuuaauccaucugaauuuaucugguuacuauuucuucuugauuugcuuuguauucuccauaugguaaagcaggauucauuacugaacauaacuuuuuuuuuuuuuuuuuuuugauauggagucuugcucugucacaaggcuggaguacaguggcgcaaucucggcucacugcagccuccgccucccagguucaagcgauucuccugccucagccuccugaguagcugggacuauaggugcgugccaccacgccaagcuauuuuuuuuuuuuguauuuuuaguagagaugggguuucaccauguuguccaggauggucuugaucuccugacccugugaucugcccgccucggccucccagagugcugggauuacaggcgugagcuacugugcccggcucauaacauauuaaaguaccugcaccaggaguggggguuauguuagaguuggaagaaaauagaaugaauuagaaucucacaucaugauucuuaaauuaguauauaaggugguaugccaggguaaagccacaauaucuucuuaaaacuuaucuuuucuucauaauaaaaacuguuaacaauuuuaaaauuauuuuguaaccagucugccuuuuuaaaaauuuauuuuuguguccccccagcuucauuaaggcaugauugacaaauaaaaacuguauauauuuacgacguacaacaugagauuuugguuauacauauacuuugugaaaugauuacaucaagcuaguuaacauauccaucaccucacauacuuaaccacuuuagggggugagaacauuuaagaugugucuuagcaauuuucaaguauauucuacauuauuauuaacucuaaucacugugccauacaguauaucuucagaacuuacuaacucguucuaacugaaacuugguacucuuuaaccaacaucuccccauuucccaccuguacuccuaaucccuguuaaccaccaaucuacucucugcuauguuugacuuuuuuagauuccacauauaagcaagaucaugcaguaucugucuuucucugccugguuuauuucacuaagcauaaugugcaccagguucauccgugugguagcaaaugacaggauuuucuuccuuuucuaaaauuauuuuuuaaaauuuuuguagagccugggccucacuguguugcccaggcuugucucaaacuccuggccucaagcaauccuccugccucagcugcugaaagugcugggauuacaggcaugagccccugugcccagcuaauuuucuuccuuuuuaagaaugaauaguauaucucuuuuuuauucauguguacauugauggacacuuagguuggcuugagggaaggggugacaugaguaauguaaaacuguccuucccuccuucuucaaauaugucuuuccuuauugcuguguuacauacagauucuauaaucucucaccauguuuucuuagcucuuaugaacauuuuuuuuauuuuaauuuuuauuuuaaguuacaaaguacaugugcagaaugugcagguuuguuauguagguaaacaugugccacggugguuugcugcaccuaucaacccaucaccuagguauuaacccauuuaugccagggguugcaaauuuuuuuuuaugaaaaaucagaccuuggcaaugaccuugagcaguaagauauaaauaauucccacaagcuuagcguuccaguaauggagcacuaggcauaaaugguuugagcucaguaugcauuagcuauuuuuccuaaugcucccccuccccucaccccacccccaaaggccucaguguguguuuuuccucucccuguguccauaguucucauuguucagcucccacuuauaaacgagaauaugugguguuugcuuuucuguuccugcauuaguuugcugaggauaauggcuucuugcuccauccaugucccugcaaaggacaugaucuccuuccuuuuuauggcugcauaguauuccaagguauacauguaccacauuuucuuuauccagucuaucauugaugggcauuuggguggauuccaugucuuuguuauugugaauagugcugcagugaacauacacaugcaugcaucuuuguaauagaaugauuuauauuucuuuguguauauacccaguaaugggauugcugggacaaaugguauuucugguucuagaucuuugaggaaucgccacaccaucuuccacaaugguugaacuaauucacauucccaccaacaguguaaaagcauuccuauuucucuucaaccucaccagcaucuguuguuuauugacuuuuuaauaauugucauucugacugacgugagaugguaccucaaugugguuuugauuugcauuuuucuaauaaucagugauguugagcuuuuuuucauauguuuguuggccacauaaauguugucuuucaaaaaguguccgcucauguccuuugcccacuuuuuaaugggguuguuuuuuucuuguaaauuuguuuaaguuccuuguugacucuggauaucagaccuuugucagauggauagauugcaaauauuuuuucccacucuguagguugccucuuugcccugaugauaguuucuuuuauugugccgaagcucuuuaguuuaauuagaucacauuugucaauuuuuguuuuguugcagcugcuuuuagcgauuucuucaugaaaucuuugcgcaugcccaugaccugaauggcauugccuagauuuucuucuaggguuuuuuguaacuuuguguuuuacauuuaagucuuuaaucccucuugaguuaauuuuuguauaagguguaaggaagggguccaguuucaguuuuccgcauauagcuggccaguuuucccagcaccauuuauugaauaggagauccuuucccccuugcuuguuuuugucagguuuguugaagaucagaugguuguagauguguggucuuauuucugaauucucuauucuguuccauuggucuacccaucuguuuuuauaccagcaucaugcuguuuugguuacuguagccuuguaauauaguuugagguucaguagcgugaugcuuccugccuuguucuuuuugcuuaggauugacuuggcuguacgggcucuauuuugguuccauaugaugucuuaaguaguuuuuuucuaauucuuugaagaauaucagugguaguuuaaugggaauagcauugaaucuauaaauuacuuugggcaggauggcaauuuucaugauacucauucuuccuauccaggagcauggaauauuuucauuuguguucucuuuuauuuccuugugcagugguuuguaguucuccuuaaagaggucuuucacuucucuuauuagcuguauuccuagguauuuuauuuguagcaauugugaaugggaguucauucauaauuuagcucucugcuugccuguuguugguguauaggaauucuugugacuuuuacacauugauuuuauaucccgagacuuugcuggaguugcuuaucagcuuaagaagcuuuugggcugagacgauggaguuuucuagauauaggaucaugucaucugcaaauaaagacaaucugaauuccucucuuccuauuugaauaugcuuuauuucuuuuucuugucucauuucccuggccagaacuucaauacuguguuaaauaggaguggugaagagaggacauccuugucuugugccaguuuucaagggcaauguuuccagcuuuugcacauucaguaugauauuggcuguggguuugucauaaacagcuuauuauuuugggggauguuccuucaauaucuaguuuauugagagguuucaacaugaaaggaugcugaauuuuaucaaaggcguuuucugcaccuauuaagauaaucauauggucuuuguuuuuagaucuuaugugaugaauuacguuuauugauuugcauugguugaaccagccuugcaucucggggaugaagccuccuugauugugguggauaagcuuuuugaugggcugcuggauucaguuugccaguauuuuacugaggauuuuugcauugauauucaucagggauacuggccugaaguuuuuuguugguucucugccagguuuugguaucaagauguugcuggccucauaaaaugaguuagggaggagucccuccuuaucaauuguugggcuauuucagaagaaaggguaucugcuccucuuuguauuucugguagaauucagcuauaaauucaucuggucaugagccuuuuuugguugguaggcuauuuauuacugccucaauuuuagaacuuguuauuggucuauuuagggauucagcuucuuccugguucagucuuuggaggguguaugugucuaggaauuuauccauuucuuuuagauuuccugguuuauaugcauagaaguguuuaugguauucucugaugguuguuuguauuucuguggggucaauggugauauccccuuuaucauuuguuguuaugucuauuugauucuucccucuuuucuccuucauuagucuagcuagcagucuauuuauuuuauuaauuuuuucaaaaaaccagauccuagauuaauuaauuuuuuggagggauuuucaugugucuaucuccuuugugaagguauuuuuaugcauggaugauucaaauugguauuucugcaaggggaguagcauuggaaaguccuuuuccaccauuuugcuguccucacuucccaccauuuucuguuuaaaaaaaaaaaagcucauaucauagagucauaugaaaacuugcaaauauuuuaaaguagaaaauuauauauacacauauggaacuuugacuuacaguaagcuacacuguguuaucaacagcaaacuccucagaggcacccauuccuucucaugaauagugagagagacuucauaauaguggaagagcuugauaagcaaggcuaaugaauuaugcugaagauggaguaagguuucccacaggguaugggauagacuauuaauaguuguaaauacauaaaauugucauuuuauuuauugauugagacaaggucucgcucuguugcccaggcuggaguacaguagcacaaucacagcucacugcagccucgaacuccugggcucaagcgauccucccaucucagucuuccaaguagcugugacuacuuggaaguagccaccaugccuagcuaauguuuuaauuuuuuguagagauguggucuugucauuuugcccaguugaucucaaacuccugagaucaagcaguccuccugccuuggccucugaaagugcugggauuacaggcacgagccaccaugccuagucaaauugucauuuuagauucuaccaauggcuagccacuugucucucucugacaguguuacuaccacauuuuaucaacuuuaaaagggaucgugacaguuuuugcugaagaaaucacacauucauuuaaaauuuuucuucaaauuauuuauauuuuuucugcucugcgucuugggaguaguaaguuccaaaaguugucuccuggcuuuaaaaaaguaacucuuuguguacguccauuauuuuuucacaugaaaugguugguugcacccccaccaaagagcccuauuagaacaugcucaaugugucccaucuuaaguuucaugccucaaaccaaagucucucucucuuacaucacauuucuacuuuccucccuuucacaggaguauuucucauaaaacugucuaacuuuauucucucuuuucuucuaauuaucaaccucuauccucauuccuauaugccuucugcuuucagcuuuauguugaaaaacacugacuaauuguacccuaugucccuaaaacuaggagacauuuuucacuucucauuuagcuugaauuuccagcaguauuugauucucuuaaccacuugcugcuucucaaaaugcuuucucccuuggcuuuuagguguuucuucucuuucuguuuucagcuuaccucucuagccccauuuucuucauaggcuaauuaucuuuugcccagcaaguaaauauuagagguccucaaaacucaggccuagacuuucucuucuuuuuacucuauguuuucucccuagauagucucauucugccucugcugucaguuaccacgcauagccuaaugacccuggaugcacagcuccagcuguuaucucaaaacucgagcuaugcauauccaguuacuuauuuaacaucacuuggaugucucaaaggcaccugcaacucagcauuuccaaaacugaacucaugauaucccucccaaacugaucaucugucuaugggccguauccuaguuaauggcaccauuauccauguuccuaagcaaaaaccuagguguuuuccuugauaccucuuucuccugaacccaccaucuguaauccaucagcaccacauccuguugauuuugcuuuccuaauuaauuuucuaggaacauuuuaauuaagguuugugaauaagauuagaauuauaucuuuaaccuauaguacguauuacguccuauaauaguauggaguauaauacuacauuguauuuuaaagaagcucacuuuuuucugaagucugagaaaccaucaucugcaguaaccuuuuaauugguuuugauccuauuacuaugcuccuuuaauuuguuuuguuguuguuguuguuguuguuguuguuguuuugagacggagucucgcccugucacccaggcuggagugcaguggcaggaucucagcucacugcaaccucugccucccgaguucaagugauuuuccugccucagccuccugaguagcugggauuacaggcggaugccaccacaccuggcuaauuuuuuguauuuuuaguagagaugggguuucaccguguuagccaggauggucucucucugaucuugugaucugcccgccucagccucccaaacugcugggauuacaggcgugagccaccacacccagccuuauuuguuuuuuacguuggaaccaaaucagugauuugacugguacaucuuauccuagcuuaaccucacaaauuaaggccaaaaaucuuaauaagacauaugaggcccccacuucaugauucucccucagcagacugaguucacaccaaaguccccuuguuuguguccauucaacuacaguggccgucacaagcugaacuugaauacuuucucuugccaucagcucuuucacauacuguugucucugcugaaacagguccuuuaccuccauuuccuaucuucugcugagcuaaaucucauucauuccucagaacaaaauggagacaucauagcuaucuacuccacuuccuuugauaugucuccccagaaucacucagcuagaaaugauucuucgguuguaugcucugaucaacucuguaccuuuacuuugugauguauuaugaacuguucauguaugaguauucccaggcuuuugccuccuucugcuucuuaaaagaaaccauagugaucauauauuagucucccagagacuuaauucagaauguuuuaaaaaauuaacaaauuuucaucuaauaguugucgucuuugcuuuaaauuugucagagaaacucuucaugugagagaguggucauauaauucacaauauugacggagcgauauuauacuaaaauaccaaucagucaaccacaaucucucucuguuaccuucuaccguguguguguguguguguguguguguguguguuggugagcaguggacauguuaacagaaaaccuuggacauaagacguucuucucuucuuaauuggaagcaauuaagucucuaaacaaaaaugcuauaaaaaauaccaaaauacuucugaagaauuuuccagaagcauuuuaaugcaggucaugaagauuauaauuauaaaauuuuaaauaaaggaggcauaaaaaguaaaagcugccaaauagugccuuagacuuuucuuaaaaaucuuacuccauauagggagggaggaauggauggauggauggauauggagcaaagggcaauacgguauauggauuuaauguuaacuugaaggagucccugggaaaugcagaggcagcuguaugagucuaugcauaggaagaggaccuugcaaguugcagaggcagaagugauguugaccagggaaacuuuaaaaaaaaguacagaagcuucaaauaauacaaucuuggauuuaucuuggggcucauuuuucuauuucuauuucuaguacuauguugguuagcauaaucaguaaguacuguaauuaacaggcccacagcuguauagugacucaaauacaacugaagauuaauucuugcacauguguaacagaagucaauaaaagcaaaauuuuucuggagaaaagucucugacacugauugaaaauaagaauuuuuacuucccccuaccuuuucucccucccucuguuucuccuucuccugcccacaaacuccacaacuuuggaaacuccgugguguuuuacuacauauuuauccaucuuuugguuguuacuaauaucuguauuauuuuggauacucaauaagaagucaucauugaaaaaaaguuccacuucacuggucaacauggucccuaagggaggaauguguguucuauuuaaaaacgucaaaaagauuagccggguaugguggugugcaccuguaaucccagcuacucgggaggcugagguaugaggugagaaucgcuugauccccagagguggagguugcagugagccgagaucaugccacuggacuccagccuaagcaacagagcgagacucugucucaaaaaaaaaaaaaaaguauuacugaaguaauauagaugaauucauccuuuauuauuuccuaaauguaauuuugcacauuuagcuccuuacaaaaaaaaauuguuugaaaauuauaguguuuaaauuaaacauuuuucauaaacuccauauuuacaaagaacuucuuuuaccauaaaaaucuauuacuuuauuuccuuuauucuuuauuaacuccagaaauuuaguauggaucucugaaguacuuaaaguaauuuagaaacugaaauucagcauuuuccuguacaucuggcauauauuguuuccauguauuucuguucagcaacguauuguugcugaauuaauacuacuuguguuauuuauguuuacuuuauaguuuauaaacacuugauacagcuucacggucauuuuagacauguuugaaacggcauuaauucuguugugacuucuguucauguagucucauuuuuuucuuuuuaacagagauaugacggaaguuguacauauuaaagauaggaaggaggcaauucaugaguuaaaauauucaccagauggaacuuaccuugcuguuggaugcaaugacagcucgguugauauuuauggaguugcucagcguuauaaaaaaguuggcgaguguuugggaucccuuaguuucaucacucaucuggacuggucuucagacaguagauauuugcagacaaaugauggaaaugggaaaagacuuuuuuauagaaugccagguaacaauuucuagcaaauuauagauuuguaguaccuauacaauauuuuagaguuuuacuggaagcagaguguaaguuacauuugaucauaggaaaucaaagaagaucugagcuaauauuucaggcauuguagacuuuucuacaauauaauacaauauauuauuguauucuacaauaauucuacaauauaauacaauaaggcugccuuauauugaaauccuuuuggguuuuuucucaacucuauugagguauaauugacauuaaaaauuguauauauugaaaauuuacaauguaauguuuugauagauacauugugaaaccauuuccacaaucaagcuaaaugauguaucugccacuucacaguuaccauuuuuguguguguguggugagaacauuuaaguuccacucucuuagcaaauuucagguauaucauacaguaacagcauuauuaacuguacucaacaagcuguauauuagaucuucugaauuuauucauccuguauaacugaaacuuauaucuccuuauauccaccccggcccccaccaaccucuaccucucccagucccuggcaacuacuacuauaaauccuuugguucuuaauuaaaacugcuuuggcuggaggaucuaaaacagauucucuuuuuauugaauaccauaccaugaguauaguguaugguaaaguaccacuguaucuuagucaaaaaugccauuuuuauggguggaacuaauuaagugaauauaauuacuagaagugugugaccaauacauuuuuuuuguguuuaucucaaauaaacuuugcaggcugggcauaguggcucacgccuguaaucccagcacuuugggaggccacaguggaccgacagcuugagcccaggaguuugagaccagccugggcaacauggcgaaacccugccuuuacuaaaaauacaaaaacuagccaggcauggugguaugcaccuguggucccagcuauucgggaggucgggaugggagggucauuugagcuugggaggauaaggcugcagugagccguuauguugccacugcauuccaacuaugccacagauuaagaggcugucucaaaaaaaaaaaaaaaacaaauaaacuuugcaaauauuaauaauauaacuaacuaacuuugaaaaacagaauugcaaccaaagauuuuaaaagagaggaauaggcuaugugcagugccucacgccuguaaucccagcacuuugggaggccaaaguggaaggaucucuugagcccaggaguuugagaacagccagggaacauggugagaccacaugucuaccaaaaaaaaaaaaaaaaaugagcagguugugguggcaugcaccugcagugggaggaucauuugagcugggaguucaaggcugcugggagccaagaucgugccagugaacuccagccugggugaaagagcaagaucguggcucuaacuaaacaaauaaguaaauaaauuaacaagugagugagugcaugaauggauggaauaaaagcagaaucaucaaaauauuaccuauuaguauuuuuuuuuuuugagacggaguuucgcucuguugcccagguuggaguguaguggcauguucuuagcucacuacagccucugccucccagguucaggugauucuccuaccucagccucccgaguagcugagauuacaggugcccaccaccaugcccagcuaauuuuuguauuuuuaguagagauggaguuuuaccauauuggccaggcuggucuugaacuccugaccuucagugaucugccugucucggccucccaaagugcugggauuacaggugugagccacugcacccagccacugcauaguacuuuauuuguugugacgcuuagggaauuagucacuaucuuccaauaaccuauuauauaaaauuagcugcauaauucaauuaaugcaucuccccaaaaguuuuucauuaacagucuauauguaaugaagacugaccggguccuaaaguccucuuaccuaauguaaauauauuauccuacacucauccuuucuucuuggucuuuuccaguucucucuuuuuccucaacuauguaucuuaggcuucuuuuuuaauaccugauuugccacuuucucauagcuuuuaccuuuuuuauaacuuacccuguuaugacuaaucuguaucauuuuuuaaauaagauucaguuuuauucuccacauaauugaaccugcuaagcuaaucauucaaggcaaugugugucucugaaucaguauaauuucuguaguagcuuuuuauaaauuucuugcauuuaguuuucuuuucucuuaacccaaacuuaucuaccuauuuauguauuuuccucuaaguggggugggaagauacauuaaauuuuggaauuuacuauguucucaguacaguuuaggcuugagaaaaucaaaugaaauaacuuuuuaaauuaagacucugauuuauuuuuaggaggaaaggaagugacaaguacagaagaaauaaaagguguucauugggcuucauggacauguguuucaggccuugaaguaaauggaauuuggcccaaguauucagauaucaacgauauaaauucaguagauggaaauuauauuggccaaguuuuaguuacagcugaugacuauggaauuauaaaauuauuccgauauccauguuuaagaaaagguaccuuuucuuucaaaauauuaaguaaccucucucucacagaagacuuucguguucuugcagaaaauuagucuugagauaaaggauuucauauuuuuuaaaauuacacugauuggugaaggguuucauuuuucuaauucaaaaauuauugucauaugcugcauuuauuuuggucaugaaguuuuauuagaaaauucuuuuugaauucauauguuguuaugaaugcacuauaucucuuucuuuucaaagaaacguuuuucuuuucacuucgugaauucuuucauagagucagacuguacaaugaugguuguauuuuuuuuuuuuuuuugagacagggucucacucuguugcccaggcuggagugcaguggugaucucugcucacugcagccuccaccucuuggguuccaucaacccuccugccucagcuucccagguaacugggauuacaggcaugugccaccauucccagcuaauuuuuguauuuuuaguagagacaggguuucaccauguuggccaggcugugucuuaaaguccucaccucaggugaucuccccacgucagccucccagaguacuaggauuacaggcaugagcagggucugauaugguuuagcuuuguguccccagccaaaucucauuuugaauuguaaucuccagguguuaagggaggaaccuggugagaagugauuggauuaugggggcaguuuccucuaugcugcuguugugauagugagugaauucucacgagauccaaugguuuuauaaaugguaguuuuuccugugaucucauggacuucuccuucaugccacccugugaagagggugccuugcuuccccuucaccuucugccaugauuguaaguuuccugaggccuccccagccaugcugaacugcugaacacuuuuaaaccaucagaucucgugagaacucacucacugucacgaaaacagcaugggggaaacugcccccaugauucgaucaccucccaccaggucucuccuucaacacaugaggauuacaauucgagaugagauuuagguggggacacagagccaaaccauaucaaaagacuggcuaaauaucuaacaauuaaaguacccuauuucugagucccaccacauagccaggacaugagagucaccaugcacaacaaauuuuaagaugauacuugccugguuaugaagugugagauucaguaguagucaugaugaucuuccucuuagacguugcuccuacuuacuguuucacauacugaccucuaugcaaaaacaaaaaugcuuuaaucuucuuaguuuucuuagucaagugaauaggauuuauugauuauuuuuaucauuugcaagagagaagucgauauuauugcacaauaauuuuauuucauuuauaaaauguguaguaguucuuugaacugcugugugaauauuuuaccaaagccuaagaaaauuagucuugucuaagagauuauucacuccuucaaggacauaaguauaaauugcuucucuuuuuuguuucccauuuguuagcuuuuuuguuaguaauuuauuuucuaguaaggaugauuucuauuucuaggcacuugugagucagcuugagauuguagcuagguaagugggaaagacagaauacgacuacugcauuuuuaauggauuaauauaaguauuuuaagauuuuauguuuugcagaccacuuaggccaaaaaagauuauguauuaauugaauucacauaauuacauaccuugaaguuggcaguauuacuagaaauauacucuuucuuuuagauuaauuauuaaguugcauugcuaguccaacuuagaaaaauguagcugguguauuaauauauuuuagauauccacucagguaauauucauuaggugacuucuuagaagugcagcauuuacaaaauguggacuuuaaauaauagaaguaguuuauguuauagaaucauuguaauugaaacaaaaaauauacgaaguuagcucaaagagagaaugaucauaugaaccacauauacccuacauacugcacuuuaauuucagcccaaagcauuccaccccucuucauauuuuuuucuucauuaucauccucuuuuucucuaguuucaccugcucuugaccauaaucucucugaaagaauccaggacucuuccuaggcagcagcauaggggcugugguggacagugagcaggucagggucagggagaauggagaggugagggcagaguuacguuagcccaucaccuccaucacuguuaauaauggccaagacccccucuguacuucuuguugacaaaugaaaauuuauauuuggagaaaauaucauuuagauuccaggaaauucauaggaaaaaccaaauaucuaacaaagaaaaauuuauaacggggacugauucagugcuguuuuccauauuguugcguguagcuuuaaugccuuuuuuucacugcugcaaaauauuguguuguaaguauaugcugcaauucaugcauuuauucuccugucauuggacauuugggucauuucccaucuuuugauauuaaaugcagguuucucaaaggagugaaauaacuaggagugaaauuucugggucauggagaaugugaacguuauaagaaaauaccuaaauauuuuccaaagugguuauccaguuuuacaaagccuauugauucagcacuugauauugcuauacuuucuaacuuuugcaaacccaguugguguaaaugaugucacauugaggucuuaauuuccauuugucugacuacaaaugagguuaaccaucuuuuaaaauauguuuuggucuucuguguuuucuccucugucaaacauggguucauaucucuuuccuauuuucuguuggguuauuucuuuuauugaucuuuaagaauuacuuuauauacucuaauaauacaaaugcuuuguaauuuuuauaguuugcaaauaucuuuucccaguuuuuggcuugccuuuuuauuuucuuaaugauguguuuucuuggccaguucuuaauuucaguguagucaagucuauuucucuuucuuuucuuauagguaguguaguuuuguauauuaagaaauucuuacuuuuacuagggucagaaagauauuuucauauauuuauuauucccauaucuagaaguuuaauaucauuaaaacauaguuaaauggaaaaaaaucuuuugucauauugauaccauauauugaaaauauuuagaucauauuacccuugugugaaaauacacauuaaaacacauuauaaaagaaauggaaucauugaaacacaaauauuuuaguauauuucuuuauccuuaccaagaauuuucauccucuuuuaaauuaggaagcuucuaugaucauuauaguuugucuugauaaauuuuuucucugagauauuuguacuaauugaugauacacuguuuaggccuuaacuauucuuauuacugaaucauuuuuuaucauaguuuucauaaucaaaagguaccuugugagcauauaauccaauuuacauuuaaaacugagaaaauggaguccaaaagagguuugguggaaugcucagacuuccgugcuauuaaaugaugcucaagcacuagucuuuugauuucaauucuaauauucuuuaaggcacaucaaacuuuugcccucuucugugcauuauagggguuggaaucauguucaugcccucucaguuuccuuuacuacucuuuccuacauuacagucuagcauuccaacucaaaaguccaagcagagcaaaaggaaauauaaucuuugcuuuuccuuucuuuuucucuuucuucaaauaucuaaugaguguuugcuauauaccaggcaccagagauauauauuaaacaagacaccacugcugucuuuaaagagcuuauaguuuuauuggaggaguuaacaaguaaauagacuauuacauuucaguguuauauaaauauaaucacaagggguaaucacagagaauucuggaagcauguaacuuggucuuggugagucaaagucauuucaugaaagauaugauaucuagguucacuuuuaagauacccauuuaucagaacaaguuauuaaaaauuaaacugguuauuaaaaaauuaauacagucccauugacuaaaaauacugguuucucuuagacuuauuuuacaacuuucuuguuuagcugccuugguuuauccaagagggucuuugagaagucucaaagaaaaguuuggaagggacuuacaggauuauuuguaccucucucuaucacucgguauaggcagaucagaugcugagauaacucuuuaauuguccuaacauaacaaauuaguagaucuuagaacuuggaauuuuauuuguuagaauuucuggcuuuaacuuuucagacucucugaugucuaagagugcuuaaggguugcaucaaagguaguaguaguagccaaagcccucuugacaggcaaguaaugcauuccuauauaagagcccuuaccucauaggacuuugcugggcugaacuaugcgaaguuaaauuagugacuuauauuaagcuacauaaaaaauuuauuccuaaaauaacaguauuacuauuaagcagcaguaaauuauaacuuuagaugaguuuugauucuaucucaugcauuaaugaugauaguuaucuuaaauuaaugacuaagaugaaaguuuuucuccagaauuucguugauggggcuuugacauccugauauacaagucuucuauaacuuaauauaaaguguuuaaaacaauaucaaaaggaagcuaagcaucauuguauccuguguauuuuaauaagaauaucuguauaaugccacauaccaggaggaggagauagagaauauauucuaaaaauauauuccugucagaugugguggcucaugccuguaauccugacacuuugggaggcuaaggcaggaggauugcuugagcccaggaguucgagaccagccugggcaacauagcaagacccugucucugccauaaauaaauaaauaaauaaauaaauaaauaaauaaaauauaucccuauuaucacauagauuuuuaagaaaauuaaccacaaaguuaaaugauuccuuuauuauuggagaaauuggguguauaccaccauagccaaaugaugcagcuuaacaucucuaaugauagaacugaccauauccccugaaaugacauauccaaaaggauacaacauugcccuuacccaaaacacaucaccugaaucuaaucaugaggaggcauuagacaaaacccaaauugaaagauuuuuuuuaaauaucuggauuuuuaaaaugauuauaaaggacauuguuggaacaacugggcauauuugacuuugauuaauaugaugcauuacauugauugacuuuuuaaugucgaaccaaacuugcauuccuggcauaaaucucauuugauuauguuguguaauccuuuuuauauguugcugaauucauuuugcuaauauuuucuugaugacuuaagucuuaaaaggauccucuggcugcuuggguugagaauaauggggguaaggucuaguugauuaguccuuugaauuucacuuaagcccaaaggccucaggccaaaacauucaaauguuuuaauauaaaaacaguugauccccagguuuuucucaaagugguaagauaaugccucacagccuuugugguuccuugugaaucagcagaggagauauuugcauuccuugauacagauucauucauuuguucaauuuuugagucagcauuuuucccauuuguuuauaauucagauagaaggaugauacagugguucauauauaaaaauuguuugaaaugguauuuuguuuagcauuuguuuaucaauuuaaagauauauuuuuauuauaggggccaaguuuagaaaauauauuggccauucagcucacguaacuaaugucagauggucacaugauuaucaguggguuauuucuauugguggagcagaucacucugucuuucaguggaaauuuauuccugaaagaaaacugaaagaugcuguucacauagcaccccaaggugaguaguaugcauuagcuaaacaguuucccugucaaauaauucuucaguaacccccaaauaacaauuuuauauuaaaguauaaucuggccucauaaguuaacaguguaguuuguuauuaguagaaauuucaaguuaaaauauuaguucuauauguuuaaaguuagaugucacagagugugaaauacaaaguaauuuugauugcguuuuaaucuaucaaauaaugagugaagaaacaguuauauuaauagcaaaacaaacauuuaauauauccucugagagauggguaucuagauuuuguaaaugcuuuuauugacaaaaauuaucuaaugucaauucaucuguugcauauaguauuuuuagcuauuuuucauguuaauuauagguuauauucacuuauauuugcacagacauuuaaauuugauguagcggucauuggggagccagugaagggauuuaaaggagcuauugaguuugcagugaguggagaggaagauaaucuguaguacaguuuacugacaucugugucacuugaauagguaauuucauuugauuguuuuauggcuugucuccaugucaacugacauagcucuuaaucauuaauuuuucagugcuguuuugaaaaugaaucuucuuuaaacaaguaacauuucauuuuuaaaaauuacagaaagucuggcugacucucauagugaugaaucagauucagaucugucugauguuccagaacuggauucugaaauugaacaagagacacagcucaccuaccgucgacagguaauuuuccauaucacaugguuuuucucuaaaaagucuaauuucuucuuuaucuugcuccccguuagucaucuguuguuaucuuuuguggcuuuaauuucucaagcaauguaugacuauauuaguuuucccacugucaguguuagaguacacuuguguaaaauuuuuuuuauauuaaaugcuugguauauuaaguaugcuugccuucuauuugccuauaggauuuugucauaguauacucacauuuauuccuuuaacaauauucuuuuaugaaguauaaaaauuuccuggaacacuauguaucuauuugucagugugauauguagaaaaugugaauuuguuuguucuuuccgagggaguaaauuucaugaauuaacuuuucauuuaagacuacuauuaaagcuguuguuuucagacaaugucugaaaguuauauugggaguauacgaacaccuuuauuaguauauauucuaagaauauuucuacuuguauacauuuuuaaagguuuacaaagaagaucuaccucagcuuaaagaacagugcaaagagaaacaaaaaagugcuacuucuaaaagaagagagcgggcuccaggaaauaguauucgauuacacuuuguucacggguauaaaacaacuaucuuucauuuauuuguuugaauuuugguucacacuuacuagcuuaacaucucuaaugauagaacugacuguauccccugaaaugacauauccgaaaggauacaacauugcccauggggaaaacacaucaccugaaucuaaucaugaggagacauuagacaaaaccaaauugaaagauauuuuuuaaaauaucuggauuuuuaagaugauuauaaaggacauuguugggacaacugggcauauuugacuuagaguaauacauuacauuguguguaauauauuaaugauaugugugcuuugugacuuuaaacaagucacuuaaccucucugugucucuuuuuuucugucuguaaaauggagauaauaguacuguguuaguccauuucacauugcuauaaaggaauaccugaagcuggauaauuuauaaggaaaagagguuuauuuggcucaguguucugcaggcuguacaagcagggcaccagcaucugcucagcuucuggugaagccucaagaagcuuuuacucauggcagaaggcaaagggggagcagguguguuaccuagcaagagagagagcaaggaaaaagggaucgaaagggaaggggguuucuggacucuuuaagcaaucagaucuuguaugaacuaaucaagagagaacucacucaucaccaaggggauggcaccaagccauucaugagggaucagcccccaugacccaaacacuucccaccaggccuaauaucccacacuggggaucacauuucagcaugggauuuggacagcacaaauauccgaaucauaucaaguaccuaccuuacaagguucugaugaggagugaauaaggcaaugcuaguggugacuuacaacauuauguggcacauaauaagcacuauguaaguguuuauuaaauaaaaaauaaauuugucuuaugaaaguuucauauguauggaaaugggccucuuuaaacaauuaaguaaaauguaagagauaaucaucuccccucaauaugucuaauuuggaaugauauugugacuucuucuugcaugagcauuuuugccuaaauauuuuaauuucaccaaaauacggguucuggauucucuuagaacaucuggcaauacgggucucacauuucagcuuggcagaaacagauuuuccaaucugacucuuuucuaccauucacccagcauucguuuucuuaccugacugauaauacuuaucaagaauuugaaaaaggauuuaauuaguacaaguauuuuuucucuaguguuaaaauggcaguaguuucuaugcaguuguauuuuaugaauuggguuucuuugaagugcaaaccaagguugcuauaaauagacuuauauugaccauuuuaagauuugacuacuuugucuuggaugaggauaauauuuuaaaauuguaguuuaaacuuauuuuuggaauauacguuguauucucaugguccaacaauguguauaaaaggguacaguuugaaaaucuuucucccaccucugcccucccagccaucauuuccccucucugcagauaguuacuguuacuuaguuucagaaauacuuauacaacaaauacaaauauacuuuucuauaccuuuuacuuauaaaaagcaauuguuuuuguuuuauaguauacaauuuuaauauuauacuuauguaaaugguaguauacuauacauacuauuuucuaccuuguuuuuuucacucaguauuauagcuuagauuuagcuauuugcaguccgagcaguucauaaaaguuuauuggaucugagauggugguauuuuuuuaauuguucaggcugggcaugguggcuuacaccuguaaucccagcacuuugggaggccaagguggguagagcuccggaguuugagaccagccugggcaacauggcaaaaccccaucucuaugaaaaauacaaaaauuagccaggcaugguggcgcacagcaguagucccagcuacuuggagggcugaggugggaggaucguuugagccuagguggucaaaauugcagggaacugcagucacaccacugcacuucagccugagugacagagcgagaccccaucucuugaaaaaaaauuguuuaguauccuguaaaacuggaaauugaaugauucacccaaaggguaccuacuucuccccuguauauucuguauugaucagauaaaaggccaaaauuaauuauauaugauuuguuuucuauauuaguuacagagguuaugacugucgaaguaaucuguuuuauacucaaauuggugaaauuguguaccauguggcagcagugggugucauuuauaaucgacagcaaaacacacagcguuuuuaucugggucaugaugaugauauucucugccuaacuauucauccuuugaaagacuacguggcaacaggccagguagguuugaaagacugacaauaagccagauaagcuacaccuuuguuugaguuuaaauaaauuaaucacauaucucuuuuauguucuaggauaugaagaguaaagaauucuuuagaaugaguuuuauuuucagauuauaaauaaaauuuaccccaaacuuuuuuccuacaguuuuagaguuuuuauuauuuuaauucauauuauuuuaauuuaaauuuggaacucauagcucuggcuuguuuuauuucugucaugauauuaauuuuuuaaauuaguaaaauuagagaaaacauaaagacuagaaaucuggugucuuuagguugaguuaccuaaaacaaauguaaauuauuuaacaaauguccugugacaaaccaaaggacuaugucucuuuauuuuacaaccaugauaguaaucuauucagguuuaccaaaguagaaagcacaaauauugaaauaaaaaacccugagaaaaucuuaacugauaccucucuauauggauauucuuagagaaggaagggaagaaaugauguuuauagauucuuccuuuguguaaguacuuuacuaguuuauuaauguauauuuauuuuauucucaccucaaccaugugagaguaaaauuauuuccuucagucuacaaaugaugagguuuagguuuggagaaauuaaauaauuugcuuaagaucaaucaguuaauagguaguaaagccuaaagccuucagucugucuggcuuuaaacacuguguaaauauaccuucuagcuaggauauguggaaaagggaucaacuugcauccuccuauauagcuuuccugaaaggagagaaaacuccucccuuuuuucuuucucccauucuucuuccuuuuucuuccuuucuuugugccucuccuuacuugcucuuucucuccuuccuuucccucuccuucuuccuuucuuucauucacucaaaaacauucaucaagcacauucuauguaccaagaaaugugcuaggaauauaaagauaaauaagacaacuucuugucauggugaaaacucacauucugaguugugauacaguguccuaaguauagagcagagaagcuucucugaucuauauuuaugacaauaccuuagcacuauugauguuucggggcagguaauuauuuguugugggaggcugaccuaugcauuguaggauauuuagcagcaucccuggucucaacccauuagaagccaggaacacccacuucccugaguuguggcaaccuaaaaugucuccagacaguacccagaugucccuuggaaggcaaaaucacccuguuuuuaaauguagaaauauguacaaagccugguagcaauguaaugaagaacuaaugauuaauuuugcccaguagaaucgaagaaacccucauagagaugaugacauuugagcugaguuguuuaccuggcagaggggaaguugggggaaagcauucuaaguguauuacagcaucuguaaaaguagggcaaaaaaaaacccagcuuauuuaaagaacuaugaguaacucacaguguucaaaucuuagaaugcauuauggacauuaguugaggaacuaaucaggaggguagguagagguuaaaacuaccugguuauccuauauauuaacacaaacugggucuuggaugcacaguuguauuuaaugguuuacgaucuaaccuuuccgguacaggcacuuucugagaaacguuuguccucauuugggacauuuuguugucagguuuuuguguuuguuuuuguggguauuugccucauuccaccucugaguuuucagguagacagaugugauuaaaaacucuguucuaaggugcuuguuguaguggaguaauggguuugcaguaauaagucaugcuuuuccacugaaggggagggcuugggaaucccugagacuagauaaaguuaagucguuggaagaauuccuugauuggaaauuuuuccuuuguguuuugaugcuuuguuuccugaaaauaacucagggaugcuccugguuuguccaucuacuguuuugauuccuuggaucccacccauucuuucacuuuaagaaaaaaaaacaaauaauuguugcagaggucucuguauuuugcagcuucccuuuuguaagaagcacuuuucccaaauaaaacaauuuaaaaaaaaagaaauuuagaugaaaaaucuagagaguuuugucuuuuggagaauuaaauacaaagaauaaccucuugucaguaacugugaucuuaaguggaaaugaaagaaugugaaagaaacuuaccuggaaagucgaauaacaugacuaauuguacuauaauuuggaaauuuuguuuaauucagcaaauacuuguugagugcuuccuauucaaaagcauuaaauguuguggggaaacacagagauaacucagacuggcugccacuaucgggagcucacaauguaguauaagaauuggacaaauuauucuguguguauauguauguguguguguauauauguguguguguauauauagauauaauucacuaaaaauacacugauuuagaugucuugugggcaacucagauucaacauaucuaaaauggagauaaauaggauuaaucuucccuuccaaaccuguucaucguuucguguuuccuucuuagaacauagcaguguauuaacuugguugccuaagccuggaaguuaaucuuguucuucaccccuaaagcuagucaguccucaaguagcacccauucuuucaccugaauauauauuuauucuuuaucuucaauauucuuuucaucuuuaauuuuuccauaucucuacugacaaucaaugcuucacaauuucuaaaacauuacuauagccauuggucuucugcuuuuuuccucuauccauuuuucccauucacuaguaaucuuucuaaaagucuuaaaauucuuucauauuuauuaguguuaauagccuguaggcugucuaaacagcugucuaaauagccacaagcuauaaaugauaagagauaaaaaggggagguuggagagucagacuugguuaaaugcaauucaaggcauaacauuaaugcagaguuggaaguugacucccaaugcaauucaaggcauuuaaccaagucugacucuccaacuccccuuuuuaucucuuucuauuugccucuuuguaaacuauuuuuuugccuucugagauagauagaauuuguccaacacguauaaugcuauuucacaucuuuuacuuaguuccuucgucuuggaaaacucuuccccuccacuucuauucaaccuuccaacuuuaucuaauuucugcuccuuuuaagacuuaggcuaagccuaucugagaacucucccaaccucucccuucuccccuucaucccugagugagaugcccuaaguguacuuuaauaguacucaauauuauacuaaauacugucuauaccucauggaaugugauauugaaauccaagccuuuccacuuauucgcuacuggcaaauuaccuaaccucucuuuaccuucguuucuucauccuuuaaaauaaggauguuaucuguucccaucucguagaguuguugugauugguacaugagucaauguucguaaggugcuuagaacaguuucuggcacauaaauuacuucucagugaguguuagucaucaucauaauuuccaggugagauguccaguagacaauugaaaauguaagucuuggauucagaggaaaaguaacugcucgagagaaggacuugggagguauuuauugauuuaaccacugaaacuauagaagugagauaccucagggcaaaaaugaagaaugagaagacuggagaauuaaagaccaccuugggagagguuuguauuuaaguaacaggugaggaaauugagaaggaaacucaguaguaggagucaaggaagcugggcgccguggcucaugccuguaauccuagcacuuucgaaaacugaggcggcagaucacuugagcccaggaguucaagaccagccuggacacguagugaaaccccaucuuuacaaaaaauacaaaaauuagccgggcaugguggugcaugccuguagucccagcuacuugggaaguugagacaaggaggaucacuugagccugggaggcggaggucgcagugagccaacaucaugccauuucacuucagcagggcaacaggagugaaaccuugucucaaaaaaaaaaaaaaaaaaggaaacuggagaaccagaagagaguaguacaguaaaaucaucaaaagcaucaaauucuguagaaguuuuuauauaaaaagaaaacuuaaaaguuacugguacuacuguguacccacaaaaaauguuaaaaauuuucuaaaaaguuacugguaauguuuggcugaauaacuuagugaaauauuggcugauugcaguguuauuuguuauaucuuuuuauaaaaucaaucucggccaggugcgguagcucacaccuguaaucccagcacuuugggaggccgaggcaggcagaucaccugaggucgggaguuugagaccagccugaccaacauggagaaacccugugucuacuaaaaauacaaaaaauuagcugggugugguggcacaugccuguaaucccagcuacuugggaggcugagguaagagaaucaccugaacccaggagguggagguugcggugagccgagauagcgccauugcacuccagccugggcaacaagagugaaacuccaucucaaaaaaaauaaaaaauaaauaaaucagucucaaaauuaacuauaauugacagcucuauuaauuauuucaggaguugucucuauauacaaagauauuauaucucuuuaugcuuaugguuaaagaaagugauuacuugagucuagaggaauaauuaagaauugauaguuuaccugugcauuagugaacaucauaaaccaaguuaaaaaauaagugacagagugcugcaguagauuugccuuuucaggucuauagacaugcuugguacuuuaacccccucugaauauuuguuuaccccauuauuuuagucuagaauucuuuauauucaaguucugugcuuucugaaggcccaccuccaguaccuucucuucuauggacucauucugcacagccuuuucauguucauuaagcaucuauuaagagguguuugucuuucauugauaauguccuguuuuuccagugaguuugcaaaaguuaccugaaugucuuauugcucguuguaucuagcauacaaacaauagauauucaguaagcauuuaucaucuuuauugaugaaauauaugauaaaagucacauaguguuaguuacaucauuccuggaaacacugagccuagccucauuagcuuuugaacaagcauaagaaaaaaauaucagucacuuauauaguuugcuuuaaauuuuuauuuaauaaauuucugugguaaauaagucaagcuguaaaaaucucuuguuuuauuuccuuuuaguagauauggaaauaaauaauuuaauuguauuuaauagcuucuauaauucuauuuuagguugguagagaucccucaauucauauaugggauacagagaccauuaaaccauuguccauauuaaagggccaccaccaguaugguguuagugccguugauuucucagguaaggcuguuugcugucucaguaagaauuaacaaaaugcagaggcaacacauagcauuuuaaucuaagucaguguuaccuaagcuugucauuuagcugugacauucacaguuuuuaucaaauguguauacuguuauccuuaucaaauacuaugaaaguguggauuugcuagcuaguuuauaauuauaacuuaaugaguauaguuuuaauacuuauuaaaauuuacauguuucuguuaacauaaaaauguuuaucuacguaacaaccuaaauucaucucaguuaccacaggugguuugcaucucccacgcugggagggcacugaucucacuuaccguuuuauagccagaguaaacuuugaaaauguuuaggguaaaaggcuagcaaagaaagaguugagaauugaaauacuuauuuuagacauauuuauacagugacaauuuuaaacugucuuguaaaaauaauuucagaucauauuagcgcuuuucuguuuguuuaaaaguuugaccacuacagauagaucuacggugaaagcuagggugugaauugggaagagggaggaaauacauuaauagagaauucuauauuaagaaacagugaauuaaugcuuuugcugcucugacugaagugauaaauuauccauaguagaguucagagggaaauauauauauauauauauauauucaaagaguugcuaacaguuaagaaacuagaaaaugaauugcaagcuaagugagucaccacgaaaaauaccacuggagcagugaggaacuaauugagacuugcaaagugugguaaaauggaaaauauuuucuuguggucugagccuuuacagccuguaaacaugcacacccauaggauauucacugaucauuugucgcagugauuugucuaauauauucauuauguauugcuugaaugauugaccuuuacuaaaaguagucauauuaguggcagcauguuguuguaacuuacguguuuuucauuugauuaacuuuucauaauuacucaaaguucuuauauuacaguaaauuucuuaugaugaauuuaauuaaauauuuucuucaucccuuuguuaguuuucccuuuccuucuauuuuuuaaaucucuuuuuuccauuuuucuuaucucccuccucccaucccaaccugauggauagauaagggaaaaggagaucaggugcgaugagagcagauacauuuagaggauuugagaaacuuuuauucucccucccuuauaaauucugguucuuuuuauagguguaugcaugccuaacauuuaacauuauuuuaucaaauuuuaaauauaggauguggguuuagaauauauacugaauguuuucucucuucugaauguuaauagucaguuuaucucucucauuaauuuuccacagcggaugggaaacguuuggcaucaguuggcauagaugauagccauacuguugugcucugggacuggaagaaaggagagaaacuuucaauagcaagguaggaaaaaaacuugauaucacauuugcaaaauacuagaauuacuuuggacuuaaaaaaauuuuuaauuaaaagaauuuugaaaucaagcaaauauguaacuuuuuauugcuuccauguuuauuaccauugaauaaauaauauaaucauaguaaaugauuucagaauuucuuuguagauuuaucccuugugaacccacuuuuaaauauaacuauaauauggcauuggauauaacuaucuaaaaucuccacguacaguuagaauguguucuacuguaugauaggcuauuauauagcuguuggagaccauguucaaaugcuuauauuauauauuaaagugaaaaaagauauauaugcauauaugucacaaagaaguuauagguuuuuauuuucuuauauuuuucuucauuuucuaaguuuucuacagugagcauguauuuuuuauaguaauauuaacaaugcuuuaaaggaggaacuagucaacagugucagagauuuuaaccugcuauuuauuaaagcgauguuaaagcacuuuaaauauauagauaaaugcuuuuuauggagcauauagauaaugcucaaauuaacaauaguuuaagaggaauuuuguaguuggaaaggcuaucuuaagcuauaacaaaguauuguuuuaaaauugacuuuaacccauucaugccacaaauagcauucccuauggcacaguacuauaguagguauuauagaugcuguccaaaaggaguucaguuuugaccauuucugucucuugagauucucuugagcagaguuaccauauuaaaaugaugacaaaagaacaaauacacagcccaaaccugagagauaagugggaguaaaauauucguaaauagaguaaucaagauaggguauggauuaggcaagagauuaauacaggaaugaugaaucuucagagcuaaaacauuucgauguuuauuucagaggaaguaaagauaagauuuuuguuguaaagaugaaccccuaugugccugauaaacuaauuacagcuggaauuaaacacaugaaauuuuggcguaaagcagguaagaaagugcuucuuuuuuacuccauagaauuuuaagaaauuauugcuuuugaaaguaauuuagcuaagugcaguguguacccuagacugcauccuggaauagagcaggaacacuaggagaaaaacugaugaaaucugaaugaagucuugaguucauuuaauaauaauguaucaaauauguugguuucuuaguuucaacaaauggucuaugguaauauaagaugucaacauuggcugggcacagugacucaugccuauaaucccagcacuuugggaggccaaggugggaggaucacuugagccuagguguucaagagcagccugggcagcauagugagacccugucucuacaaaaaaaaaaaaaaaauuagcugggcauggugguguguaccuguggucccagcuucuugggacgauaagguggaaggaucacuugagcccaggagguuaaggcugcagugagcugugaucucccacugcacugcagccugggcaacagagcaagaacuugucucgaaaaaaaaaaaaaaaaaaaaaaaaagauguuaacauuaguagaaacugaaguguauaagagaauaauacucuguaacacuuuugcaucuuuucuggaaaucuaaaauuaucuaaaauuaguuuauuuuuuaaaaguaauuuacuguuguauugaugcauuuuaaacaaauacaagauuuauugccauuuauuggcugcauuuauguaguugauaugguuugacuguguccccacccaaaucucaccuucacuuguaauaaucccuaugugucaagggcagggccagguagagauaauugaaucaugggggcgguucgccauacuguucuuguggaagugaauacgucucaugagaucugaugguuuuauaaaugggaguuccccugcauaagcaauuuugccugucaccauguaagacgugacuuugcuccucauucaccuucagccaugauugugaggcuccccagccauguggaacugugaaucaauuaaaccucguuccuuauagauuacccaguccuggguaugucuuuaugaacagugugagaacagacuaauacaguaguauucauacuugcaaaagaauucaauauaugagauuaaucaaauuauguccagacuuuuucuucuguuaaagacauguucuauagucuaaacugaaaaugaaaauuaaaaaaaauuacucauaugcuauuaaaugauacaaaaguguaucauuuauaguacaaaugauacuuuagucauuuguaacuauaaaauaaaaaaugucuguuuucuaaauaguauacuuauaaauuccaucaaugugacaucaaaaucucaauaaauugaaacuguucagagaaaauauguaaauauaggaagaaguaaaacauuauuagaaaagaauaaacuuagugaagacauuucccaaguucaaguaacuuucaaguuguaaauuacaugggacaugaauuaauuuucagucuuggauuuaacacuuuaucaaaaacucaucagauaacagcauaugcguuuacaaaguaaaaagaaguauuuuuacauuuguaauuuuguuuccacaugcuuaaacaaacuucauuugggcaccuuagucacuuguaauugcaaauucgcagcauauacuacaguuguaccucauggcaucagaaaauaucagggauugguuccaggauuccccaaggauacccaaauccaugcugcacaagucccuuguauaaaaugguauaguauuugcauauaauuuaugcacauccuccuguauauuuucagucauuucuagacuaccgauaauaccuaauauaauguaaaugcuauguaaauaguuuguuguacuguuguuuagggaauaaugacaaggaaaaaaagucuguauguauucaguacagagcaaccauccuuuuuuucuuuuugaaacagagucucgcucuguugcccaggcuggagugcaauguugugaucucggcucacuacaaccuccaccuccuggguucaagugauucuccugccucagccuccugaguaacugggauuacaggugcccgccaccacacccagcugauuuuuguauuuuuuagcagagaugggguuucaccauguuggccaggcuggucucgaacucccugacuccaggugaucaacccgccuuggccucccaaagugcugggauuacagacaugagccaccgugcccagcccauccuuuuuaaaaggaauauuuucaauccacauuuuauuaaauccacagaugcaaaaccugagaacauggaaggccgauuuuacucaguauuucugucuuggaaaagaacuaugaauuuguuugaaauaagauuucaagaaagcaaauauucuugcagugaaaauacuuccaaaugaauaacuuucuuucuuaaguuugauuagacguauaguagaccugaaagugaagcauaaaaggaugaauguuaaggcuuuggugagcauuucaaccuuccuuacuuuugggguucugauccacagaguucauuaaccacuugggaaauaaguauccacuuacuuaaccuaacuauuguuuaacccucuaaaugcauaguuuuagguaaacuagguugaaggagaugacuuaggcuugagguuaacauggggcuucuugccucccauuccagaucuaggcuuugagaauuucaaguuaugauuuauuaaucucuccccuaagggauuugaacucuauucaugguagggacagagggauggggagccucugaaaguuuuugaugcaauaauaaugugagcugauuauaugaccucauguaacaggaacauguuaugcuguguguaucaucaagaaaacccagcugucaaugcucugaaccaaagguggcaaacuuuuuccauaaauggccagauaguaaauauuuuaggcuuucuaggccaaaggacaaaaucaaggguauuauguagguaauuauagaacaagagagaaaacuguccugcccugcuuacccuguuugcacccaguugccauuagacauucugucugccagggaaugggucuggcagguuuugguugggagugaaacuguagugagcuucacuaccccagugacacauagauccuaguguguccuucuguuccuggagagcccaaccuucugaauuugggcagcugaccagaaauggggcaacuacuagacugagauuccacugccagauacccagcaguugccauuagcagagucucuagcuuguagguggggaccagcccagacucugggcagaugcuaguuacagccacaaaccagggaggcagacccugggugcagagaaguaaacagacuuggucucugcagcucagagugcuaaccugcucuaguggacauuguacaaaaacagguaguggcaggauuuggcauucagccuguuguuuccccacccugcucuagaagauaguuugcccucuaauaaaggccaguucuuccauuugugcacuagauucuuucucucaucuacucaaggacaucacucuaacucuucuacccuuucucuacuguaucaucaauguuccucucuacugacuuucccuucagcauaaaagugugaugugauuucgccaucuuaaauaagugacacaaaacccucuuucaacuuuauucuccaguugcugaucaauuugucaucuucuaugcuaaaccaccucuaaacaguuguuccuacuuucaauuugcaguuuauguucucuuucucuuuagaaaagucuaaucuaguuuuuuucaccucaccacuccacccagcugcucuuacaaggucacuaaugacucugccuucuauguugagaaaagacagucuucugaauacauuuggaaucuaaccacuuuucgucaucuucuaugauaucacuuuggucugccacauuuaccauuugcccagaugauugaaauagccuucuaacuccuuucauccuugaccucccuuguaucuauucucaauccagaagucagaaugaaccucuuaauaaaucaauugccagaucuugucauuucacuauucaaauguuuugcaucucauguaaagcaaaaguaggccguccuuacaauggccugcaguacugccuuagaccucuccaaccccauuucccauuacugucuccccuucuuugcugcuccauacuugucucccuggauguuacuuagugauuucagucauguuguuguaucggggccuuugcacuugcugcucccucugccuggaacacucuucuagcauggcuugcucuugcuaccuccuucaagucuucauuuagauacaccuucuugaugaggcuuaccuuaaccacccuacuuaaaguggacuccucccacuuccugucuccuuuuuaugcuucuauuuucuccaaagcacccaucaucaucuagcacaguauauuuuacuuguuacauuuauugacugucucucaccaugaagcucuagggaauuuuguugucuugccuguucuguucauaagucuaugccugguacauugaauagugccuggcauguauauuucuuuuuucuuucuuucucucucucucuuuuuguuuggagacaggguuuugcucugucacgcaggcuggagcguacuggcacaaucauggcucacugcaaccucugccucucaggcucaagcuagccuccugccucagccucucaaguggcugggaccacaggcguacaccaccauacccagcuaauauauuucuugaaugaaggaaggaaggaaggaaggaauuugugaguccaauugggaaaaaugggcaagagauaucaauagguaaugauggccaguaaaaauaugaaaaugugaucuagcauaauauucacagaaaugcaaauuuaaacuacaauaaaauucaguugguauuucguauucccuagugugacaacacaaacuguucccaaaggugagaaacaaggaauucuuuucacuguucguaggaguguacauugguauauaaacuucggaaaacaguuuggcaagagcugauaccucucugaucuauaugauaugccuuuugcacauuacccuauuacuacucccaggcauuccuagagaaacucuugcacuuguauagaagaggccuuuacaagaauguuuaaagcagcauugcuuuuaauagcaaaaacuuggaaguaacuuaaaucuccauuaauaggaaaauggauaagccaugguauaguuauauaauggaaugcuaugugguuaugaaagugaguuuucuaacauguaaaaaacucuauaacaaaucauuggugaauaaagcaaguugcaaagaauacauacaggaugauauuuauagaaaaauuuaaaacaugaaaaaugagauugcuuaaaaauucacaaauauuuauauguaaaggaaugcaugagaauaaucaguaucacauucacaauacuaaagcgugaagaagggagaugagguuggcaugacauuucaguuacuuugggaucuuuuuguaggucagcggauauauaggcauucauuguauugggguuuuuaaaugccuuuuuguauucuuaaauaugucauaauaaaaacuuuaaaaaacaucaucaaaagugcuaagggcugauuaaaacagacuuaguccaggucuuuguuuaucuaaaaaguuauggucuaaaugcaguuaugcaagguguuacccacaucacugauugagacaccuguaguuuucaauucuccuuacuguugcaugccuuacuauucaaacaacaacaacaacaguagaaaagaaacuuugcuucuuuauaauugaguacauuuugaaagugguacuuucauaauauuuuuugugaacuagggggaggauugauuggaagaaaaggcuacauaggcacacuggggaaaaaugacacaaugaugugugcaguguauggauggacugaagagauggcuuuuucuggaacauccacaggagauguguguaucuggagagacaucuuucuuguaaaaacagugaaagcgcaugaugggccaguguucaguaugcaugcauuggaaaaaguaaguaaccuaaagagauuuuaaauuaaacaaaauuuguccuggaguguagagcauuuuaagaaguaaaggaacacugccuuucuacuugccuggacuauccagcaguagucugugggcuagggucaucuugaccuuucuuuguuucucuuuucaaacucccgaacacagaaugaaauaggucugcaguguuuuguuuugagauagugucucacucugucacccaagcuggagcgcagugguguggucauagcucacugcagccuccagcuccugggcucaagaaauccuccugccucagccucuugaguagcugugacuacaggcaagugccacccacacccaucuaauuuuuaaaaauuuuuuugguagagauuauguugcccaggguagucuccaacuccugggcuuaagcuauucucccaccucagccgucaaaguauuguguuacaggcaugagccauggugccagccaggucugcuguuguuguuuuguguuuuuuuuguuuuuuuuuaaaguuuaacuucauguucuuaagcucauacuaugugucaaaaaucggcuguuuauauauaaucaccauauccaucagguaguuaccauuuuuguuuucucuuuuuaaggaugagguuauuauguagacuccaagaggauauauguaacuuucugagaguggugaucuaacuuauaguuacagauuuuagaaacuguguuucuaaagcccuaucuaaaaguaaaauguuuagggucacuguaaauauuguugcagauuccauguagacgguuuaaaaacacaauggauucuuaagcuaauuccuguucuuuacaagcuguaacuuuugacuauguucuuuuuucuagaaguuuucaauauaaggaaaaagguuacuauuuuaaaaaauauuuagaucuuuauuaacuugaaccuuuuuuuuuccauagggguuuguaacuggaggaaaagaugguauaguagcucuuugggaugacucuuuugaaagaugucucaagaccuaugcuauaaaaagagcugcauuggccccaggaucuaaaggugauuugagacuuagugggguuuuuguauaggaaaaaaagauuaauugcucauuaaugugugugaucacugagguggaacacauggcauguauuuuuccgucuuguugggcaucagaauuaaguggaagaaaucacuuaacuggauaccagaaucauugccaucuuuucaaaagucuauuuucuaugauacacaugguaaaauauuagugaaauacaagauuaugaauccuaauuuuaacauuaauuuuccaaagaaaauuuccaugugaacaucacauuuaucaccagucaggaacuugugugcaacuuugauauuuuguuucaccuuggcauuuuguugacccuguuucuguagccucacaggccuuuuuucccuuugccauuuguuuguugauuuauuuaagagacaggguccugcugugcugcccaggcuggagugcaguggugcaaucauaacucacugaaaccuugaaccccuagacucaagugguccuccugccucagccuccugaguaguugggacuaaaggcgccugccaccauacucagcaaauuuucaaauuuuugugcagccagggucccucuauguuguccaggcuggucucaaacucaaaugauccucuaaacuuggccucccgaagcacugaaauuacaggcaugagccacugugcuuggccuaccuuuuuuuuuuugaagaggaggaagggugcaagggcagcaucaggcccaacucccuguccgccgaccauccuccgggcugugggcccagagggugcauuuucuuuauuauuauuauuauuguuauuauuauuauuauaccuugaguucuaggguacaugugcacaaugugcagguuuguuacauauguauacaugugccauguuggugugcugcacccguuaacucgucuuugagugcauuucuuccuuuaaggcauagcaccacacucucucugacuucugggccuuucuaccuguuuuuacuuuuuccuaaaacauguccuuccucuuccuuccugcccccuccaguuacuugacaacauacuuauuuuucaaauaucaaaccugauuuuuucuaggaugauuucccccacccucaucuccucucaaaaaaguuagauuccacugcucugugcucccauuucaauaugccccuaacacagggucuguuuuccucacuguaugcucuguaaggguaugaguugagucuaucaucuuuacuaauauguugcugaagccucccuaggacaaguagacauaaauaaauauaguuggcccucuguaucuguggguuccauauccucagauucaaccaacugcaaauagaaaauaugcuagagaaaaauaaaaaguaacaauagaacaauaaaaauaauauaaauuaaaaauacaguauaacagcuauuuacauagcauuuacauucuacuagauauaagcaaucuaaaaguuauuuaaagcacaugggggccggcugugguggcccacaucuguaaucccaacacuuugggaggcccagguggguggaacuccugagcccaggaguuugagaucagucugggcaaaauggcacaaccccacccuacugaaaaaaaaaauauauggaaugauguauguggguuauaugcaaauacuacaccauuuuauaugagggacuugagcauccauagacuuugguaucugugguuguccuggaaucaaucccccaaggauacugagggcugacuauauaucuugaauugaauuaaaauuacuaauaagaauauuguaaauaagaggggcaggagauggauaaggaagggcuaauauaagaagagguaaacaaauagcuguuggaaugguaggagggaaugugagaauagaaucauagacuuauaagacauaggugguacuuauuuagagauuacuaaauugaaugauugagguuaauauaguacauuuauuagaauacuuaaaauacaggagaaaaccuuguaaugugauuuucacugucaaaauagcuuaauuggcaauauauacacuguuguauuauaguaacuguaugucuaaaagaacaucuucauuuaacauuucaggucuucucuuggaagauaauccaucuauacgugccauaucauuaggacauggucauauuuuaguuggcacaaagaauggugaaauacuagaaguggauaaaaguggcccaauaacacuucugguucagguaauuuuaaaugcuaauuuguuuuuuuuucuuuacauacaauugauuauuucaauauauaagagccaaaaguugacagugaugaaaaauaauguuaaauuagggaaauauuuguuaauguauacagaaaaaaaauuuaauguauacagaaaaaaauuuuaacguauacagaaaaaauuaauguauacagaaaaaauuuguuuuuuucuguuaauguauacagaaaaaauuuuaauuugguuauaaugaaaugauugggugucaguaaauauacauauucuucuauggaauaauugccaauauuuugaguaauuucuuaucagaaaauaaaggacccaugaaaagaaaaaccagcuguaauuaauuuaacccagucuguuuuuaauuuuauuuauauaagguauauuuguugagccuaaggcaauuauuuuucucugaaacucuucauuaggccauucuuaaguuucuaagaaaaaauaaaaauguaugcuaaaauuucauuacugaaaauuaaauaucagugaaaagauguaaauaauaaaacaggccgggcgcgguggcucacgccuguaaucccagcacuuugggaggccgaggcgggcggaucacgaggucaggagaucgagaccaucccggcuaaaacggugaaaccccgucucuacuaagaauacaaaaaauuagccgggcguaguggcgggcgccuguagucccagcuacuugggaggcugaggcaggagaauggcgugaacccgggaggcggagcuugcagugagccgaguuuuuaacuuccauuauuuuugaugcuguuauaaauacaacuguuuucuuaauuuugauugcauauuguucauuucuaguguaucaaaaugcaguagauuuuguacauuaacccuauaaccuguaaacuugccguccucauuuauuaguucugauaguuuuauaauggauuauuuaggguuuucuguguacaacauuaugucaucuguaaauacacauaguuuuacuucuucuuguccaaucuggaugccugcuauuucuuuuucuuguccaauagucuugacuagaaccuccaguacauuguuaaauguaaguggugagaacagaacauccuugucuuguuccugaucuuagagugaaagcaucuagucuuccaccauugaguauaagguuaacuguggguuuuucguagaugcuccuuacuaaguuuaaguugaggaguuacuacccuuuuauuccaaauuuguggagcauuuucaucaaaugcuuuuucuaugucuauuaagcugaucauguguuuuucauuuuuaauucuguugauauaguguauuaguugauuuuugauguugucaaucuugcauuccugggauaaaucccacuugguugugauauguaauguuuuauguguauuggauuugguuugccaguauuuuguugaggauuuuagcaucaguauuuauaagagauauugguauuuaguuuucuugugauaucuuugucuggcuuugauaucaggguaauaauggcuguauaacauaauucaggaaggguucccucaucuuugucucuuucccugaccacacccaacuguuaaacuccuuuaauugguagcauauugcucuauuguuuucaacauuuuccuuggguauaaauugugccacaggcuaaaccaaucaaauucaggcuccuuuaaagggauacuucccuagauuaguguuugagguuuguuucugacuccaggcaggcuccucccagcuaucucugcgaguuuacugguucucuuggacaaacuagcuggccuacgguuuagccuauauuuccaguuagccuaccagucuccucccaauuacuuuuuauuagauuuuuuacaaauucuggaaagauauuaaaaaccauauagaagaaaaaauauucaagaauaguuaagaaauuuucaaaacaauuuucacuguuuuugagacguacuuaugcaugagcuuuuucacacucugcuguaaaugaagucaguuccuuugagaagagauuaggagcuaucuggauuucuggauugccucucccuccaggcagaaucucugaaccagggcucuggaguugagagugaggucaauggaauccuuaucuuugaguaucucaggcuuuaggcccugaguacuugguaaggggagaggggacaguagucucagcuuuuccuggguuaccccaggaccccauuauucucagaggcaccacauccaaaguagagccuccaucuggaggaggggcugggcagaaguuaucucccaccugucagcugagcucaacaagaauuuagccucagcaacaggaggcugagggcagggugagaaaugcugacauccugcccuaccuggaaagauagugcucugaccgcgagcuggggggagagagagccuaguguucuugguugcaucagucucggaguuuccaaccagaugaggagggaggaagggaguggaucucaguuuaaauaccguagacucucacuguucuuaacaaauuuuaacagauuuucuugaguaaauguuccuuccuuuguugcaucuccuuggaacuauuuucagagacuuuaaaugcuugcguuuuuuuuuuuuaauugauuuuuacuaguuucacuggugagcaggucuguggagcuccucacucucucaugcaggaaaguaccuccuguguggcaauuauuaacauugcagagcagccaauuccuauucucuccacccagagaaaguuuuaggauuauaagcuaacuuuaauuguagcuugauuauaugguaauuguggagcuaaaguuguuacagagguauuuuauuguguuucccaaagauaaacagaaaaguuuugauagauuuacucacuauucgguauccuauuaucauauauuauugaaugguaucuuuagcuuuauucuaaauaaaacuguguauaaauauacacacacauacacuaaauugauccuauguuuucuuuauagggacacauggaaggagaggugugggguuuagcuacacacccuuaucugcccaucugugcuacuguaagcgaugauaaaaccuuaagaauaugggaucucucaccuagucauuguauguuggcuguccggaagcugaaaaaggguaagaggcucucacacuugaacguagauuaagcucucacaguuuucuaaccuuuacaaauauaagaaagcaaaacuaggcacauuuuaaaaaggcuuuaaauauguugaaauauuuauucaaugucuacuugcucauggugccacauagagaaacguaauuguacucagucuuggcuuuaugggaccuccuaucaucaugccuaaagugagcaaauuuccaauaacuuguugaauaaagaauauagaagguaaacagaagcuaaguuuuucucuccuuugugacuauggauuauacauaauuuagaacuggaaacuuuucuaaggcauaguggggacuaaaaaaaauucaaaaaagaacuaaaaacuaaggguagacagcugaggaaggauauuguaaauagaacugagcccauuuguaggaagcagaugaagcugucaggguagagagacaggguuuccccaucuuggccaggcuggucucaaucuccugaccucaugaucugcccaccucggccugccaaaguggugggaucacaggcgugagccacggcccccggccaauuccaaguuuaaaaugaacuuucuguuuuuuaauucuacacuauuaguccuugucuuguucauuucauguuuucugucugucucuauguggcgucugugugauuuuuucagaucuuuauucuaguuuuuaauucucuuuauagcaguucauucccaucuguuuuuuaagcuacccauuaguuaauuuugauaauugucauuuuuauaacuucuauuuguuuucaaguuugccugagauauuuuaacaucauacuucuuguuuauauuuuagauuuacucuuuucuaucuuuaaucuuaacuacccauuucagauaaagaauauaaaaucuaauugucuccaaggaucucauuuugcuguguuuuucuuaccauucuuuuggauguuuucuuguuuuuuuguuuugguuuuuguuuuuuuucugcugacucccuccuagugguccaucuucuugugcauuuuaaauuuguauuguaaguucauguuugauuggacuuuaccugugggaaucccaugaugucuggauugagggugugggaaucccaugaugucuggaucgaggacuuuuuuuugaaaaacaauauaacccguguuuacucuggaugcuaaugauucagagaucagauuuuuuuaaaauuuggaaauaaugguauuagauuaucacuaugaguauuuuggaaccuaaaauuaacauaaaaauuugaaagcuaguacuauaaugaguacaguuaauguaugucccuucaugaauuccagagauuuuguguuucucucuucaggugucuggggugcuaccaucgagaaccacugaaaauuuauuuaacugggauuacauaaaucauguaauuagaauaaauuugaaucuaagguuuaugaaagccacccuguguuugugaauucucaaguaugauuuuuccuucucuguggagaacccaggccaggauagauaagcuuguuucauaaagucuuuauugccagacacauuuuaaaaaaaagguuucucuguuuuuuucuccugagauaugguuguaauacuagaagaaaaugacaauaugcuguuuggagaguuuuugccaaaaaaauugcauguaauuaaauaacuauuuuauuucuuaagauauucaugagucaaaaaaauuuaaaguaaaaauuagugaaacuaaauauauaauuuaauguuuaguauauugaaauacaaaaagacaaaaucauaauauaaguauagcugugcaguauuuuaauugguaaauuauuaaaaguaaauacuucauaaaaugaagaaaguuucagcauaaaacacugaaauaaaauaacugauguuucuuuuaaagcaaccuuaaggagcaaaguuuauuaaugauaguauuauugaguugaaaaguaauuaauuuugagcaaauuuuuccaauggccuaaaaggcccuuacuauacgcuacacuauacuauacacuauucuauacacuagucugaguaaugaugaaaauauaaguauaauccaguucuaaauuuccugugacucuuguaucaucagauaauacuaucucuuguuugauggcuucaaggacauuuuuuugaaaaaguuuuuuuuuguagggacuauagcaccuuuauuuuuuuauuuuuuauuuuuauuuuuugagacagucuugcucuaucacccaggcuggagugcaguggcaugaucuuggcucagugcauccuccgccucccagguucaagcgauucuucugcuucagucucccgaguaacagggacuacaggcgugcgccaccacggcuggcuuauuuuuguauuuuuaguagagauggaguuucaccauguuggccaggcuggucuugaacuccugaccucaagugauccgcccaccuuggccucccaaagugcuaagauuacaagcaugagccaccaugccuggcuauagccccuuuauugauagcaagcuauaauauuuauuuuaaagaaagcauuuccagguuacauugucuuuaaauuuaugauuuguagaaggaaauuauaauucauuacuauuguauuuguugugaguugaguugugucccccugaaaagauauguugaaguucuaaccccccaguacuugugaauguguccucauuuagaaauagaguauuagcagauauaaucaguuuaagacaaaggcauacuagauuugguugggcucuaaauccagugacugauguccuuauaagaaggccaugugaagauauaggaacacagacacacugggagaaugcagcgugaugauggaagcagaggauuggagugauguaccuauaaaccaaggagcaccaaggauugcuacaaccaccagaagcuagagagaaacaaggaaggauuauucccaagaacuuucacaacggagcauagcucugccaacaucuugauuucagauuucuagucuccagaacugugagagaauggguuucuguuguuuuaggacacacaguuuguggucauuuguuacagccucuaggaaaccaauacuguguucauauuccaguguucaaaaagucuucaagcuagaauaagaauuauucucacaguauuaguuuugcuuaguugaccuuuauuaucucugugaaauuugagggaagaaaauuuuuuucaaaacaauauaacccguguuuacucuggaugcuaaugauucagagaucagauuuuuuuaaaauuuugaaauaaugguauuaaucacuaugaguauuuuggaaccuaaaauuaacaaaaauuugaaagcuaguacuauaaugaguacaauuaauguaugucccuucaugaauuccaguuuugucuaggagguucaggugcaagacuagucugcuaugccguuagggcagauguggcuuuaaaauuuuuuuuuauuuuauguuauuuuaaguuccgggauacaugugcaggaugugcagguuugucacauagggaaacgugugccaugauggcuuguugcaccugucaacccaucaccuagauauuaagcuccaugugaauuagcuauuuaucccaaugcucucccuccucccugucccccaagaggccccaguguguguuccucucccuguauccuuaguucucauuguucagcucccacuuauaagggagaacaugcaguauuugguuuucuguuccuguguuaguuugcugaggauaauagcuuccagcuccaucauguccccacaaaggacaugaucuuguuacuuuuuauggcugcauaguaucccaugguguauauauaccacauuuucuuuauccagucuaauaucgaugggcauuugaguugauuccaugucuuuguuauugugaauagugcugcagugaacauaugugugcauguaucuuuguaauagaaugauuucuguuccuuuguguauauacucaguaauuacauugcugggucaaaugguguuucugguucuaggucuuugaagaaucaccgucuuccacaaugguugagcuaauuuacauucacaccaacagaguaaaaguguuccuauuucuccacagccuuagcaccaucuauuguuucuugacuguuuaauaaucgccauucugacuggugugagaugguaucucaaugugguuuugauuugcauuucucuagugaucagugauguugagcuuuuuaaaauauguuucucagcugcauaaaugucuucuuuugagaauugucugcuuauguccuuugcccaccuuuuaaugggguuauuucuugugaauuuguuuaaguuccuuguagauucuggauauuagaccuuugucagauggacagauugcaaaaaauuuucucccauucuguagguugccugaucauucugaugacaguuucuuuugcugugaggaagcucuucaguuuaauuagaucccauuugccaauuuuugccuuuuugcaauugcuuuugacauuuucauaauugaaucuuugccuguaccuguguccugaaugguauugccuagauuuucuucuaggguuuuuauaguuuuggguuuuacauuuaagucuuuaauccaucuugaguuaauuuuuguauaagguguaaggaagggguccagcuucaauuuucugcauguggccagccaguuuucccagcaucauuuauuaaauagggaaucuggccaggugugguggcucauuccuguaauccuagcacuaugggaggccaaggugggcagauugugugagcucaggaguccgagaccagucuggccaauauggugagacccuguaucuacuaaaaauacaaaaauuaaccaggugugguggugugugccuguaguccuagcuacuugggaggcuuaggcaagagaauugcuugaacccaggaggugaagguugcagugagccaagauugugccacugcacgucagucugggagacagagcaagacucugucucagaaaaaauacaaacaaacaaauaaauaggaaauccucuccccauugcuuguuuuugucagguuugucaaagaucaaauggacauagauauguggucuuacuucugagaucucuauucuauucccuuggucuaugugucuguuuuuguacuaguggccaugauguuuugguuacuguagccuuguaguauagcuugaagugggauuagcaugaugccuccagcuuuguuuuuauggcuuagcauugucuuggcuauaugggcucuuuuuugguuccauaugaauucuaaaguaguuuuuuucuaauucugugaagaaugucaaugguaguuuauugggaauagcauugaaucuauaaauuaccuugagcagugauauaguuuggcuguguccccacucagaucucaucuugaauuccuacauguugugggagggaccuggugggagguaauugaaucaugggggcaggucuuucccgugcuguucucgugauagugagucuaaugacuucugaugguuucaugugucuggcauuucaccuccuuccacucacucuauccugccacccugugaagaaggugccugcuucuccuuuggcuucugccaugauuguuaaguuuccugggacuuccucagcaauguggaacugugagucaguuaaaucucuuuccuuuauaaauugcuuagucucagguauuucuucauagcagugugagaacggacuaauacaguaaagugguaccaguagagugggaugcugcugaaaagauaccugaaaauguggaagcaacuuugaaacuggguaacaggcagagguuggaacaguuuggagggcucagaagcagauaggaaaauguaagaaaguuuggaacuucuuagagacuuguagaauggcuuugaccaaaaugcugaugaugacacaggcaaugaaauccaggcugagguggucucagauggagaugaggaacuuguugggaacuggagcaaaggugacucuucuuauguuuuagcaaagagacugguggcauuuucccucagcccuggagauuuguggaacuuugaacuugagggagaugauuuaggguaucuaguagaagaaauuucuaagcaacaaauuauucuugaggugacuuugguguuguuuaaaguauucaguuuuuaaagggaaccagagcauaaaaguucaggaaauuugcagccugacugugacagaaaagaauaucucauuuucugaggugaaauucaagccagcugcagaaguuugcauaaauaaugaggagcugaauguuaauucccaaaacaauggggaaagugucuccagggcaugucagaagucuucacggcagccccucccaucacaggccuggaggccuaggaggaaaagaugguuuugugggccaggccacgggccccucuacucugugcagccuagggacuugguacccugcauuccagcagcuccauccauagcuaaaaggggccaaaguacagcuuggacuguugcuucagaucagaagccucaagccuuggcagcuuccaugugguguugagccugcaggugcacagaagucaagaauugagguuugggaaccuccaccuagauuucagaggauguauggaaaugccuggaugcccaggcagaaguuugcugcagaggcagggaccucaugaagaaccucugcuagggcagugcaaaagggaaaugugggguuggagcccccauacagagucccuacuggggcaccgccuaguggaguuaugagaagagggcaaccauccuucagaccccagaaugguagaacaacugacagcuugcaccaugugccuggaaaagccacaggcacugaaugccagccugugaaagcagccaggaagggggcuauacucugcaaaaccacaggggcagagcugcccaagaccaugggaacccaccucuugcaucaguguggccuggaugugaggcauggagucaaaggagaucacuggaacuuuaagaucugacuguccugcuggauuuuggacuugaauggggccuguaaccccuugguuuuggccaguuuccccuauuugggacagcuguauuauccaaugccuguacccccauuguaucuaggaaguaaguaacuugcuuuugauuuuacaagcucauagguggaagggacuugccuugucccagaugagauguuagacuguggacuuuugaguuaaugcugaaaugaguuaagacuuugguggacuguugggaaggcacgauuggguuugaaaugugaggacaugaaauuugggaagugccagggucagaaugaugugguuuaacuguguccccacccaaaucucaucucgaauucacauguguugugggagggacuuggugggagguaauugaaucaugggggcgggucuuuccugugcuguucucgugauagugagucucacgacaucugaugguuuuaugugucugggauuucaccuguuuguacucacuccauccugcugcccugugaagaaggugccugcuucuccuuugccuucugcuaugauuguaaguuucaugaggccuccucagaaauacagaacugugagucaauuaaaucucuuuccuuuauaaauuaccaagucucaggguuuuuauuguuguuguuguuguuguuuuugagaugaagucucacccuuuuagcccagccugaagugcaguggcacaaucugagcucacugcaaccuccaccuccuggguucaagugauucuccugccucagccuccugaguagcugagauuacagacaugcgcuaccaugccuggcuaauuuuuguacuuuuaguagagacaagguuucacuauguuggccaggcuggucuugaacuccugauauuaagugauccgcccaccucagccuuccaaaaugcugggauuacaggugucagccaccacacccagccagguauuucuucauagcagugugagaacagacuaauaacaggcaguauggccauuucacaauauuuauucuuccuauguaugagcauggaauuauuucauuuguuucuguccucuuuuauuuccuugagcagugguuuguaguuuuugaagagguccuucacuucccuuguuaacuauauuccuagguauuuuauucucuucauagcaauugugaacaggaauucauucaugauuuggcucucuguuuucuguuguugguauauaggaaugcuuguaauuuuugcacauugauuuuguauccuuugacuuugcugaaguugcauaucagcuuaagaagcuuuugggcugagauaaugggguuuucuagacauacuaucauaucaucugcaaacagaaaacaguuuuacuuccucucuuccuauuggaauacacuuuauuucuuucucuugucugauggcccuggccagaacuuccaauacuauguugaauaggaguggugagagaaggcauccuugucuugugcugguuuucaaggggaaugcuuccagcuucugcccauucaguaugauacucacuguggguuuaucauuauuauuuugagguauguuccaucaauaccuaguuuauugagaauuuuuaacgugaugggauguugaauuuuaucaaaggccuuuucugcauauacugagauaaucauauggucuuugucuuuagaucuguuuaugugaugaauuauguuuauugauuuguguguguugaacaagccuagcauccuggggaugaagacagcuugaucgugguggauaaucuuugaugugcugcuggauucaguuugccaguauuuuauugaggacuuuugcaucaauauucuucagucauauuggccuggaguuuucuuuuuuuuguugcaucucugccagguuuugguaucaagaucaugcuggccucaaaaaaugaguuagggaggagucccuuuuuuucagcuguuuggaauaguuucagaagaaaugguaccagcuccucuuuguaccucugguagaauucagcuguaaaucugucugguccugggcucuuuuugguugguagacuauuuauuacugccuaaauuucagaacuguuauuggucuauucagggauucaacuucuuccugguuccgucuuuggagaguguauguguccaggaauuuauccauuucuuccagauuuucuauuuuauuugcauagagguguuuauaguauucucugaugguuguuuguauuucugugggaucaguggugauguccccuuuaucauuuuuuauugugucgauuugauucuucucucuuuucuugucuagcuaaugaucuauuuuauuaauuuuuuucaaaaaccggccccuggauucauuaauauuuuuugacgcgcuuuucgugucucuaucuccuucaguucugcucugaucuugguuauuucuugucuucugcuagcuucgggguuuguuugcucuugguucucuaguucuuuuaguugugauauuagggugucaauuugagaucuuucuagcuuuuugaugugggcauuuagggcuauacauuucccucuuaaaacugcuuuagcugugucccagagauucugguaucuugucuccauguucuuauugguuucaaaggacuucuugaucucugccuuaauuucauuauuuacccaggagucauuuaggagcagguuguucaauuucuguguaguuaugugguuuuaaaugauuuucuuaaucuuggguucuaauuugauagugcuguggucugagagacuguuaugauuucaguucuuuuguacuugcugaggaguguuuuacuuucaauuaugugaucgauuuuaggguacgugcuauguggugccaagaagaaaguauauucuauuguuuuugguuggagaguucuguagauaucuaucagguccgcuugauccggagcugaguucaaguccugaauaucuuuguuaauuuucugucuuuaugaucuaauguugacaguaggguguuaaagucucccacuauuauuaugugggaguuuaaguugucucuucguaggucucuaagaacuuguuuuaugaaucugggugcuccugaacugggugcauguauauuuaggauaguuagcuuuacuuguugaauugaucccauuuccauuauacaaugcccaucuuugucuuuuuugaucuuuuuugguuuaaaaucuguuuuguuagaaacuaggauugcacucccugcuuuuuccugcuuuccauuugcuugguaaauuuuccuccaucccuuuauuuugagccuguaugugucuuuacacaugagauagaucucuugaauauagcacaccaguggguugugacucuuuaucagcaugccauucucugucuuuuaauuuggggcauuuagccaauuuacauuuaagguuaauauuguuaugugugaauuugauccugucaucgugaugcuagcugguuauguugcacacuuaauguaguugcuucguaguaucauugauuuucguacuucaguguguuuuugcaguggcugguaacacuuuuuccuuuccauauuuagugcuuccuucgggagcucuugcaaggcaggccugguggugaccaauucccucagcauuugcuugucuaaaaaggaguuuauuucuccuucacuuaugaggcuuaguuuggcuggauaugaaauucugaguuggaaauucuuuaagaauguugaauauuggccccuagugucuccugacuuguagggcuucugcugagaggucugcuguuagucugaugggcuccccuuuguaggugaccugacuuuaucucugacugcccuuaacauuuuuuuccuucauuuugaccuuggagaaucugaugauuauguaucaugggguugaucuucucauggaguaucuuacugggguucucuggauugccugaauuugaauuuuggccugucuuguuagguuggggaaguucuccuggaugauauccugaaguacguuuuacaacuuuguucuguucagguaccccagucagucauagguucagucuuucuacauaaucccauaguucucagagguuuugcucauuccuuuucauccuuuuuuuuuuucucuaaucuuguaguguaucuuauuucagcaagauagucuucaagcucugaaauucuucccugugcuuggucuauucaguuauugauacuugugguugcauuguaacauucuugguuguguuuuucagcuccuucaggucauuuguguucuucucuaaacugguuauucugguuaacagcuccuguaauguuuuaucauggcucuuagcuucuuugcauuggguuagaacuuguuccuuuagcucagcaaaauucauuauuacccaccuucugaagccuacuucugucaauucauccaucucagccuuugcccaguucugugcccuugcuggagagguguuguguuaauuuggaggagaagaggcacucuggcuuuuugaguuugcagcauuuuuuuucuuugauucugucucaucuuugugaguuuaucuagcuucagucuuugaggcugcugaacuuuggaugggguuuuugcagggacuuuuuuuguugaugcuuuuguuguugguguuuguuuuucuuuuuucuccuuuuuuuuuuuuuuuuugagauggaguccugcucuaucacccaggcuggagugcaguggcaugaucuuggcccacugcaaccuccacuuccuggguucaagcaauucucugccucagccucccaaguagcugggauuacaggcaccugcuaccacacccagcuaauuuuuuuuguuuuuuuuuuaguagagaugggguuucaccaucuuggucaggcuggucuugaaccccugaccacaugauccaccugccucggccucccaaaagugcugggauuacaggcaugagccacuaugccuggccuguuuuucuuuuaacagucagaccccucuuccucuuccagcugagguuugcuggagguccacuccagaccuucuuugccugggucccucccacaccucgagguaucaccaguggaggcugcaaaacaguaaagguagcugccugcuccuuucccugggaucucugucccagagggucacugaacugauaccaguggaaacgccccuguauaaggugucuagcaaccccuguugggguggucucacccagucaggagguacaggauccaggacccacuuaaugaagcacucugacuaccccuuggcagagggggugcauuacacugggggaaaucccacuuguccugacugcccagauuccucagagcugguagagggaaagacuaagucugcugauccauggagaccacggaugccccuccccucuaggagcucagucccugggagaucagaguucuguccacaaaccucuggcuggaguugcugaaauuccugcagggaggccccgcacagugagggguuauggucaggguccgaccuaaagaggcagucuggccaccaucugccacagccucugugcugcacuguggugaauuccuccugggucuaaacugucuauuuucccaggcaccaucagaggagaaauggcagacuggagcugcagugaugucugcugccccucgcccagggagcucagucaucugaggcagcagacagccaaagugaugacagccgucccuucccccaggaacuugguagucuucggcagucuguagcuaaguggccacugagaaucugugcagcucuaugcuugggacucaaggaacugguggcaugggcucacggaggggaucuccugauccaccaguugcacagauccauggaaaaagugugguuucccgggcaggauagcacaaucacucacugccucucuuggcugggaguaggagcuccccuuguccugugcagcucccaggugggcugucacuccacccugcuuuuccucacucuccaugggucaugccaaccaccuugucagucccaaugagagaaccuggauaccucaguugcuggugcaggauucacuugccguuuucggucuucuuggugggagccucugaccacagcuguuucuaguuggcuuucuuggccccuccccuuccaaauguggcuuuuuugcucuggguuucugcuccccuuuuaauuuugauaacuagaaaauguuucuaauuuuucaaugaucucagcuaugaauuuuaaaggauacuuacuauauuaaucuucccuuaaacucaacuuucuaccugcuuuaugccugcacccaaccagcagaauaagcauugaguaaaacagggaacugugauaauugaccucacuacuauucuguuucucuucccucuuuuguagcagaacuccucaaaauaguugaggcgcccuucucuguguguucacaugacaguagcuccauaacccacuccaauuaggcuuuuuucccuacuuguccauuuaaccugcugccaaucuguugaucacuuccugguucucaguguauucaccucacagcaguuugugacacaauuuaucauucccuuuuuuuuuucugaaauacuuuauucacuugucucuggaacccgugcgugucuguuucuucucucuacuucacugacucccuuuuucuguuuccuuugcuagugcuaucucuucuuccugcacucugcauuuaggacugcuccagcgcuucuccccggacuuuucuuuucauauguacacucacacuuuagauucagucggucacuguccagucagaagaugagacuacaaggcuuauuugaacagugggaauuuaauaaaaagaauugcuaacuagcaaaaagugauuaccuacugaaaaagccuuagagguagccaccauagaaagcagcaacccuaguacuaagggagagugaacaaguuaaaggugauucagaccuguuuggaaaugguguggcugccaccagaacauucagugagcuuguggcgaaaaagcuugccagagggugcagcccucaguggaacagugagaguagucacuuggugaaggagaagcuugccagaggcagcaggccagagcugaauggucagaaccacugcuugaagagcuuaaccuagggcaaaaucauugaacugugaggacuccugccagagaaucuuccugaaguccgcaaauugcagcuaaauuguuagagccauuacagugaugguggagaaacuugcugaaagaggcaguuggggcugccacucuggugaaugccaucaggcccccuucaugccagugcccgggcucuguuaguaaaacagcacacuggaggaagggagucacuucuguuuuggccuuguagugucucuccagcucccucuacuggcaagcuagcaaaaaagucugugaggcccaaaguggcagauuuggaacugagaggcaauaaauuaauaaccagcacagucuuccccucuggcuagucaggauccacaugaaccuuuauacacacauuugaacuucaguacaaucacagaacuaaccuuauguuucuacccaaagagaugcagcuacccuugguacaagugaaguaguucucaccccuaaagagagaagaccuacgcuauucucaaauuuagucacggucuuauauucuuuuaacacaaggaauauucuuuuaacacaaaauuguaaaguuaaccuccaacaaacuuguauaaaauaugaaggagaaaaaggagagaaaagucaaauaguuaauauacacaaauaaagauauacauauaacaaacauuauaugcagcuccugaaaaggauucauauauuaaauugucuccuucaugucuucacuugaacuucucauaggcaucuuuaacuuaauuuguacagaacuaagcacuggugguuccuccucuaguuuaucccaucucaguaaauggcaucaccacucaagcaaaaccaugcccuugacgccuuucaccccacauccaguuggucaaaguucugccagcucuaucuuugaaauauauccaaauccuuccucuuaucaccuccacugcugccacccagcuccaggucaucaucaucucuugacucucaaaucugagaaaucacaucuuagauuucuucauuuccaauguaugcuugauaauuaaaugacuacuuguucucaacuuaugcuauaacuuuucauucuguauauacccuguccuuuccucaucagauuucauacaagauaccaaaauccuuagggcuuuugaauauguuugcugcaacccuugcuguuaggguaagcccuuuuuuguguuuaucaaugcagcacuaacccuuauuuuuacgaauguuaacaucauuaaugacauuaaugaacgauauuaauuuaucauuaauaauaaaaauaucauuucauauaugguucugaaacguauauauacagauguaucuuccuaccuuuaauaauggccuauuagauuuuuaaaaauauuuuaguuucauaggccaggugcuguggcucaugccuguaaucccagcacuuugagagucugaggcaggugguucaccugaggucaggaguucaggaccagccugaccaacauggugaaaccccaucucuacuaaaaauacaaaaguagccaggccugguggcacaugccuguaaucccagcuacuugggagccugaggcaggagaaucacuugaacccaggaggcggagguugcagugagcugagaucaugccauugcacuccacccugggcaacaagagagaaauuccaucucaaaaaaaauuacuuuuauaaagaugacuuauuucuuaaauuucuguuuuuuuggaaagaagcuacaaagguaaaaccuacucugcaaaacuuccacauauaucauuggcuuuuuauguuaauuaaaaucucucauucuuuuucaucaacuuaauuucuuuuaagguaaauauccauacuugcuuuuguuguauucagaagugaguuucauuccugcuuagaauuccauaccauugacuucuauagaaaacuuaaucuguaucucgacuccuuuuuaauauugauuugaagccauaauaaagaggcaaccuuuuuagcaaauauuuuuuuuuuuuuugaggcaaggucucacucuguaacccaggcuggagugcaguggugcaaucauagcucacugcacccucaaccuccugggcucaaacaguccucccgccucagcuuccuaaguaaaugggacuacaggugugugccaccaugccugucuauuuauuuacuuacuuaccugucuucccuucccucuucucucuucccccucgccccuucuccuuugccccuugccccuuccccuacucugccuacuggcagagauggggucuugcuauguugcccgggcuggucuuaaccuccuggccgcgggcaguccuccugccucagcuccccagagugcuuggauuauaggcaugagccaccacaccuggcccauacuuuaaauuagaaaaaagggaaaauugccuaauaugcucuuucucuuucaggugggagguguugcuguuuuucuccugaugguaaagcuuuagccguaggucucaacgauggaagcuucuuaauggcaaaugcggauacucuagaggaucuugugucuuuucaucacagaaaagauaugauuucagauauucgauuuucaccugguaagauccauugaaauuguauuugaguauuaacuugggucuggcaguguauaaauguaucaauguauaauuuuuauuaacuguuauguuaucucagaacuuaacuuuuuuacuagaagaggcaguguagcaagagguaaaagcccuguuguuagauuggugcaaauaucugucuuagcgccaauucuguuacuaaauuuucugugugacuugagccaggaugcuucucugagcuuuuguuuccucauuugugauauaaaagggguuggauaacuguuuucguuauauucuuaaugcuuuugaaauugcacucauuuuacuccauuaauuuccauguauucauuaucuacuacaaaccuacuguaauguagcaauuacuaauguuaaggcaaaauuuacuuauguugguuuaguuccauuuuuuucuaaauuuagagggaguuuuguuaaauacaaaguaucaaaacuacaucauacauagcuuuugacauuugcuucccacugaacuaauuuguuacacuaaaaaauuauuuuguuaaguauaauauacuugaaaaauguuaucauuuguuauuuaacacaucuguuuuauuauaauuuaugaaacagcuaagauuucuccauaaagaaaaggaaaauuaacucuaguugcagaguguaaaaaaguauuuccaaagauagaaaaugucaagcaaauauguuucuauuauagguucugggaaauaucuugcuguagcaucccaugacagcuuuauagauauauacaauguaaugaguaguaaacgaguaggaauaugcaaaggagcuaccaguuacauaacccauauugauugggauauuagagguaagacuuuaaauaacuuaauacuugauaaaaguuucauuugauuuaguauagcuauauuagagaaacggaaaagugauucaacagaugaguuaaaaagaauugggaaaaacaaccauuauucucaaaauuauuuuuuacuauuuuacaucugaagaugaauacuauagaguugagacuuuucuuuuuccuuuuucuuuucuuuuuuuuuuuuuuugagacaggucucacucugucacccaggcuggaaugcugugguacaaucacaguucacuacaaccuuaaccuccugggcuuaagucauccucccaacucagccuccugagugcugggacuacaggcaugcaccaccaugccuggcuaauuuuuaaauguuuuguacagacagguucucacuauauugcccaggcuggucccgaacuccuggacucaagcaguccucccaccuuggcaucccaaagugcugugauuauaggcaugagccacugcacccaaccuacacuuuucaauacuucaccuaauaucguucaaauaauaguacaguaagugauuaguuguuuaauuuguaaagugauuuaaauauugugcaaaaaaauuguugugaagaugucuugaucuuugucauauaaauuugacauaaauagaauauagaaauguuggccagguaugguggcucaugccuguaaucucaguacuuugggaggccaaggcuggaggacugcuugagcccaggaguuugagaccagccugggcaacacagugagaccccauuccuaaaaaaaaaaaaugaaauacauuuuuaaaaagaaauguuaaugaagauuuuaaagucauuuuucucauuguuugauaugaaauauaucuucaaaaagagucauaaucauauaacauaaagaacuuaaugaguauguuuguauuuuagcagaaugcauggcauaugacugaguuuaauauguuugauaaauguuaaguauuuuaaauccucucuuuuuaaggauguuauuguuucauguauucaacuauauuguauucaacuauauaaauugagcaucauaaaguuuuucuaaauauaguuaaacagauacacuuuaaaaaauauuuuaacauuuguuucuaggaauuuuuuacauaugcauaaccaaagaaaucauuuuuauguauauacauauacaaaaaucaaaccacuuaugaauuuaguuacuuaguaauauggaauuauaaaaauaaaauguucuuacuauaaguugacugcagcagaaaaugguuuuuauauuuaagcugauuuuuucccauaaaacuuaaacaucauacugaugguauauauauuuguauguauuuuauauguguaaauauuuuuaaaaauuuuuuugaaggaaagcuuuuacaggucaacacuggugcuaaggaacaauuauucuuugaagcucccagagggaaaaaacaaaccauccccagcguggagguaggacaacaguggugcuugcaguguuguucaugugaauaaaaguggcuagaaaacugauaccuacuuucuaucguuuaguuacacgugaagucuguucucaaauuauuaaaauauuggauauuauugaguuuauugagucagaauacaugggugaaggaagaaacacuauauuaauaaaaggagucagugggcaugguggcucacgccuguaaucccaacacuuuggaagcagaggcaggcagauugcuugugcucaggaguucaagaccagacuggauaacaugcugaaaccccaucucuacaaaaaaauacaaaaaauuagcugggcaugguggcaugugccuauagucccaguuacuugggaggcugaggugggaggauugcuugaaccuaggaggcggaggcugcagugagccauguucaugccacuacacuccagccugggugacaaagugagacccuguauuaaaaaaaaaaaaaaaaaaggaauaaaucacuugcacggcuagcugugcuccaguugcuuuccuuaaaagacaagaagcgugaaauagcaaauagaagacaugccaucuaagauuggaguauugcauaucugccacguccuuaggaauccauaugccuaagaaguuuguuggcagauuacuguuuuugcuucuuuaaaaaaaaaaaaaaaaaaaaaaaaaaacaagaaaaauuguguugcauuuugugccugacaauauuagccuuuuuuuuuuuauuuuuuaucuuggccuaggaagagaggcuuaacaaauuuaacaugaaagugucuuaaugaagggagagaccauaaguaaaaguucuaaauuucuaguaaggguuaguuggaaaacauaaugcauuauuagaaauuuaaacaugaacuguaagaaucuuacuugauuauccuaaagucagaaacgguuuuauuauuaacacuguaugcuuagcaucuagaacacacaguggauauauaauuauauucugaauaauacuauguuaaaauuuuucugcagcaauuaguaggcucuggggaguuacaaaaccaagacaacuaauaauuuaacuauuuuuucauuaaaacuuucauuuuacuugugacacacauaacuacaaagaaaaauguuuacauuuugguuguuaauacuuuagguuuggauaauccaaacuuacagcauuguuuuucauuuuuagguagaaaaaauugcuugggcaucauggacaaguguacuugguuuaugcugugaaggaauuuggccaguaauuggagaaguuacagauguaacugcuucuugccucaccagugacaaaaugguucuagcuaccggggacgauuugggauuugugaaguuauuuagauauccuacuaaaguauguguuuuucuuuaacuuuccuaaugaucaucaauuaugaaaugguuaagguaauguccugucauagcacuucauuguuauuaauuguacauauguaauauguaauguuguaauaugaaagguucagaauuauguuucauaucuauagcuuuuaaguauuguaauuuauaaucccauacauuaaguuauauaucauauccuauaguguuuuucaauauugacuaauaugaauaucccuuuuacaagaaacaucuuggcuggggacaguggcucaugccuauaaucccaguauaguacuuugggagccugaggugggaggaucacuugaggccaggcguuucaggccagccugggcagcauagcaagacuuccucucuacaaaacagagaaaaaaauuagccaggcauuguggcacaugccuguaguccuagcuacucaggaggcugaggugggaagauugcuugagcccaggaguuggaggcuacagugagcuguggucaugucauugcacaccagucugggugacagcgcaaaacccugugucagagagagagacacauuccuuuuauccccaauauuaacuucaauaauuuuucaauuuuuaauuaaauauauacuauuaacaauaaauauaaacucuuuauaguuacagcuucaaacuugaaguuguuuuaaccaauuaaauagaaaauacuuacacuuauaaaauuaagcaccauugauuuaauguaaugaaugacuuuuuuugaaaccaaaucauacaaauucuuuuuuucugcuuucguagcagaauauaugugcauuuuaaaucaucagcaucauuuguugaugauuuucugcuuaaaauugguauuuacuuccugcuuauguauauuaaguuuuuuuuuucuuuuuucuuuuuuuuucccugagauggagucucacucugucgccaggcuggagugcaguggcaugaucuaggcucacugcaaccuccaccucccggguucaagcuauucuccugccucagcccccugaguagcugggauuacaggcgcgcaccaccaugcccagcuaauuuuuuuguauuuuuaguagagauaggguuuuaccauguuggucaggcuggucucaaacuccugaccuugugauccgcccacuucgaccucccaaaguacuaggauuacaggcgugagccacugggccucgccaacagauucuuuggcauucuacguaccuaugcuaaugugugcugugcaaguacuuaauucuuuuaucacuucccucuguucaaacuacuguaaaauauuaggcuuuuccuuaacacggaaauaaaauuuauauaucaaguccagauacaaugcauuccuuucuuuuuuuuuuuuuuuuaagacagcgucucucucugugacccaggcuggaaugcaauggcgcaaucauggcucacugcagcaucgaccuuccagacccaaguuauccucccaccucagccucuugaguaacugggaccacaggcacaugccaccaugccuggcuaauguaaaaaaaaauuuuuuuuuguagagauggggucuccagauguugccuaugcuggucucaaacuccugaacccaggugauccuccugccucggcauccuaaaguggugggauuacaggcgcgagucacuguuaucuggcagcauuuauuucuuaauucacaaauuaaguuauauauuauacucuggcaccaacaugaacauaaagauaaauuugaaauauggcacugaaaugauauugugguauucaguuccuggugaucuugaguaacugcucauauuaauauuuuuagaucagcauugaaaugaaaacacagguuuaaaaauucucauugaaaacucagacacccaagaaaauauuccacugauuccuguuuuagauacauguaaaugguagagucuuaguuguuaacaauguguuccacuaaaauauuugccagaaacuucacuuccagcguuccagaugguguagaucccuuaggaauagguucuggaauauugaucugcagauuauguuuucaccuuaguguagcaagaaccacacagucuuagagaaacuaccuucuugccaugcuuugaugacagaucccucacccugacuuaauuauuaagagucaucauuccugcugggcgcaguggcuuacgccuauaaucccagcacuuugggaggccgaggcagguggaucaccugaggucaggaguucgagaccagccuagucaacauggugaaaccccgucucuauuaaaaacagaaaaaauuagcugggcacgguggcgggucccuguauucccagcuacuugggaggcugagguagaagaaucgcuugaaccaggaggcggagguuacagugggccaagaucgugccacugcauuccaguaucaaaaaaaaaaaagagagucgucauuccuagggaauucacaaauuuugcuaucacuguguuuuguauaagacaucucucauuuuaacaccuuugaaaagauguuaacggaaaaccugcuuuaugaugcuuugaucugaaauuuauguaacuugguaaugcuaauaccauaauaacaauaacuuaaacuuuauuguuauuuaaaaggaaaauacauuucuauguguauugcuuacaaaaaaaagcacuaaugaauugagaugaaagauauuuacauggguauauaaauauauguguaccaaagcaaucaaucgauaguuacuuuuuguuaacauacucaugcuguacauaggcauguguauccuuucucaauuauuguaucuauuuccaacaguacaucugcauaaccauugucuuuaauauauauacacuauuccauauacauuguaauuaacuauuacuuugaacauuuaagguauuuaauuuuuuucacuacuauaaguaaauaccaugguaaguauuuuuuuacacagauagcauuucuuagcauagaucccuaaaagggagaugggugagucaaauacaagaacauuuuuaugcuuuuaaugcagaauaccaaguugguuuuuuaaagaguuuugccugggguaccagcauuuugugaaacuacugguuuuagaucuuguccuuaacagguuuaggaauugguaucuuuuauucugcugaguuucaguauuuucucauuuuuuuuaacacauugcacuugaaaugauuaauuuuuaauuauuaauaaaauucaaaaucauaauggaaauauuuaaauaaugaaauuucucagaaagauuguuugaauuuucuuccucuuuaggggaaauuuggaaaguuuaagagguauguggcccauaguacacaugucacaaauguucgcuggacuuaugaugacagcauguugguuacccuaggcgguacagauaugucuuuaaugguguggacaaaugagauggaaggcuaucgagaaaaaaggccuugugauagugaagaauccgacauugauucugaagaagauggggguacgucauuuuauaauacuugaacaaaaauauagggaaaauuuagcacaacuuguuuaagcuguggaaguuaaagcaaguaauaauaauguuugaauaauuguagugguacuguuuuuagucuguuuaacaucaaaauccauuuugugacucaagaacaacagguugccaugaauuuaugacuuugauauuauuuaucuacaaaugaaaaauaucugaauuuuaaauaaguacuguuaagguaaauuuuauauuauuaaaccucauauuuuaaaauaauuuugauuuucuucuaauauaccaguaauaucagcucguuauagaaaauguauuuugccauaaaaauuaaacacagccuccauaauuugaccacacagagguaacaccucuucuaauauuugggguauauccuaagauguauguagcuaauauuuuuuuaagaaaaguauggucauauugaacuuauuuuuuaaccugcuauuauuacuuaguaauacuuugaaaacaucauuacauauaauuaaauauucuucuacaucguuuuuucugguuguauauuacuucauaauuugcuuauaacaacuuaauuuauuucauauuguugaacaucuuuguauccaauuuauaagaucauaauugaucucaguuauugcuuaaagaauuacucguauauuuuuauuguaggcuaugacagugauguuacaagggagaaugaaaucaguuacaccaucagagccuuaucaacaaauauucgcccaauguuaggaaucaagccucauuuacaacaaaaagaacccucaauugaugaaagguaauaauuuaguuuaguauuagaugaagaaaaagauauugucauuaaaaauggaauuuauuauuuaaguggcuuuuuuacacaaacuaaguaacagugauauucuugcuauagacaauucacagcaccucuuagaaaguaugucugucuuuaaauaccuuuugguaucagccugggugauguagugagaccuugucucuauggaaauauaaaaauaauccagguuuagugguguguguuuguagccccagcuacuucaaaggcugaggcaggagcauugcuugagcccaggaaguugagauugcagugaguuaugauuggugccacugcacuccuaccugagugucagaaugaggcccugucucaaaaaaaaauacccacaaaaacaaaacccuauugaugguaacacuauguguuaacacuauugguuuagggauuuauacauguuuauaagguugauaugauucaucuuauuugcuaacuuuuauaaaugugugugaugagguuggaggagauaauaaaaauugaauccaauaccgaguacuuuuuaagaaguaugugagcaguauugugauucaauuuugaaaaggccugccuauccaugugccuuucuuuaagcauagucaguccucauuucaaaaauuuucuaaaaaggcagguugucuuuaaugggaauuauuggucuuagucuagaaucagcaaauaaaaaaguaaggacauaugcaaggccauuuuaugaggagagaucacuuuuuuuuaauuauacuuuaaguucugggauacaugugcagaacgugcagguuuguuacauagguauacaugugccauggugguuugcugcauccaucagcccaucaucuacauuagguauuucuucuaaugcuaucccuccccuagcuccccacucccugacaggccccagugugugauauuccccucccuguguccauauguucucauuguucaacucccacuuaugagugagaacaugugguguuugguuuucuguuccuguguuaguuugcugagaaugaugguuuccagcuucauccaugucccugcaaaggacaugaacucauccuuuuuuauggcugcauaguauuccgugguguuuaugugccacauuuucuuuauccagucuauuauugauggacauuugaguugguuccaagucuuugcuauugugaacagugcuguaauaaauauacaugugcaugugucuuuauaguagaaugauuuauaauccuuuggguauauacccaguaaugggauuccugagucaaaugguauuucuaguucuagauccuugaggaauugccacacugucuuccacaaugguugaacuaauuuacacucccaccaacaguguaaaagcauugcuguuucuccacaucuucuccagcaucuguuguuuccugacuuuuuaaugaucaccauucuaacugaugugagaugguaucucauugugguuucgauuugcauuucucuaaugaccagugaugaugagcuuuuuuucauguuuuuuggccacauaaauaucuucuuuugagaagugucuguucauauccuuagcuuuuugaugggguuguuucuuucuuguaaauuuguuuaaauucuuuguagauucuggauauuagcccuuugucagauggauagauugcaaaaauuuucucccauucuguagguugccuauucacucugaugaugguuucucuugcugugcagaagcucuuuaguuuaauuagaucccauuugucaauuuuugcuuuuguugcaauugcugucaguguuuuagucaugaaguguuugcccaugccaaguccugaaugguauuagcuagguuuucuuuuaggguuuuuaugguuuuaggucuuauguuuaagucuuuaauucaccuugaguuaauuuuuguauaagguauaaggaagggguccaguuucaguuuucuacauacggguagcuaguuuccccaacaccauuuauuaaagagggaauccuuucucauugcuuguuuuuaccagguuugucaaagaucagauuguuguagauauguggcauuauuccugaggccucuguucuguuccauuggucuauauaucuguuuugguaccaguaccaugcuguuuugguuacuguagcauuguaguauaguuugaagucagcuagcaugaugccuccagcuuuguucuuuuuacuuaggauugucuuggcuauaugggcucuuuuuuuaguuucauaugaaauuuacaguaguucaauucugugaggaaagucauugguagcuugauggggauagcauugaaucuacuuuaaaccaacaaagaucaaaaaagacaaagaagggcauuacauaaugguaaagggaucaaugcaacaagaagaccuaacuuuccuaaauauauaugcacccaauacaggagcacccagauucauaaaccaaguucuuagagaccuacaaagagacuuagacucccacacaaaaauagugggagacuuuaacaccccacugucaauauuagaucaacgagacagaaaauuaacaaggauaaucaggaguugaacucagcucuggacaaacggaccuaauagacaucuacagaacuguccaccccaaaucaacagaauauacauucuucucagcaccacaucacauuuauucuaaauuugaccacauaauuggaaguaaaacacuccucagcaaaugcaaaagaacagaaaucauaacaaacagucucucaaaccauagugcaauugaauuggaacugaggauggagagacucacucugaaccauacaacuacauggaaacugaacaaccugcuccugaauuacuacuggguaaauaacagaauuaaggcagaaauaaauaaguucuuugaaaccaaugagaacaaagaauacagcauaccagaaucucugggacacagcuaaagcagucuuuagagggaaauguauagcacuaaaugcccacaggagaaagugggaaagaucuaaaaucaacauccuaacaucacaauuaaaagaacuagagaagcaagagcaaacaaauucaaaagcuaguagaagacaagaaauaaagaucagagcacaacugaaggagagagagacacaaaaaacccuucaaaaaaucagugaauccaggagcugguuuuuugaaaagauugacaaaauagauagacugcuagccagacuaauaaagaagaaaagagagaaaaaucaaaaagacacaauaaaaaauguuaaagaggauaucaccacugauugcacagaaauacaaacuaccaucagagaaugcuauaaagaccucuacgcaaauaaacuagaaaaucuagaaguggauaaauuccuggacacauacacccucccaagacuaaaccagaaguggaaucccugaauagaccaauaacaaagucuggaauugaggcaguaauuaauagccuaccaaccaaaaaaaagcccagauggauucgcauccgaauucuaccagaaguacaaagaggagcugguaccauucuucuggcuauuccaaacaauagaaaaagagagacuccucccuaacucauuuuaugaggucugcaucaucuugauaccaaaaccuggcagagacacaacaaaaaaagaaaauuucaggccaauaugccugguaaacaucgaugugaaaguccucaguaaaauacuggcaaacuaaauccagcagcacaucaaaaagcuuauccaccacaaucaagucggcuucaucccugggaugcaaagcucauucaacauaccaaaaucaauaaauguaauccaucacaugaacagaaccaaugacaaaaaccacaugauuaucucaauagaugcagaaaaggccuucgauaaaauucagcaccccuucaugcuaaaaacucucaauaaacuagguuuugauggaacauaucucaaaguaauaagagcuauuuaugacaaacccacagccaauaucauacucaaugggcaaaaacugggagcauucccuuugaaaaccggcacaagacaaggaugcugucucucacuacuuugauucaacauauuguuggaaguucuggccagggcaauuaggcaagagaaagaaauaaaugguauucaaauaggaaaagaggaagucaaauugucucuguuugcagaugacaugauuuuauauuuagaaaacucuauugucucagcccaaaaucuucuuaagcugauaagcaaguucagcaaagucucaggauacaagauaaaugugcaaaaaucacaagcauuccucuacaccaauaauagacaaacagccaaaucaugagugaacucccauucacaacugcuacacagagaauaaaauaccuaggaauacaacuuacaagggaugugaaggaccucuucaaagagagguacaaaccacugcucaaggaaauaggagaggacacaaacaaauggaaaaacauuccaugcucauggauaggaaaaaaucaauaucgugaaaauggccauacugcccaaaguaauuuagagaucacuuuuuaauaaagucucugagcuagaugacagauuaagaaauaaauugugaaacuaguguuucaaaaucaaaggugguaaacaauaaaaagggauauggagcauugaauggcauggacuucagaagcaaagagguuuaaagaacaaaaaaggaaaagauccagaaacaguaagaaggaacagagggagugggaggugagaacaagguuguggugaggaaaacuuuauuaugagaaguuaguggacaauuugagggagaaauuaaaagggaauucauucacaguugaacaggauuuguagaaaauucaagcgaauuuguggccauuuaggauagugcugaagaauuuuggaacucagagagauagaaaugacuacaggaaagcuucgucagagggauuugaguuugcaccuauggauuuuauauucggggaaagggaugaaguuaaggugaaaaacacguuaguaauggggaagggagaacugagagaucuuguaaauugacugacccccgcguugccagggaagucuagauggaguguuaagggcgcagugccuccucagcuccuuuuccaggugucguuugcugaugguauaccucauguaccucagaucauagcaaugggaggucaccuaaggaaaggggauggagagugaucauccaguuuuucauuauguauaaagaggcaaaguauuaaauuagggauauuuuuaagaaagcacaguauaccauaaucuaaguacuuguacagaauuccauguuucaaguaacuugcuagaaugcagcaucguauagugcaaaggacaugaauucuggagucagacaaauggguaaaauacucauuuuuuucauuaccaguugugugaguuugaaaaauuauucauucuuucugaaccucaguuuccucaguggcaaaaugaacauuauaaucccuaacuuaugguauauuucaaguuuuaaaugaaauaauguaaaucaagaauuuagauaguaggucuucauuaaugacaccuuaucccuuggaaugaaaugaaaguuaacugaggagauaccugguaaauacuuaaacauuauuucugaaauuaaauauucacaaagcaauaagcgcuacauauguauuuauuagauaaauacagauaaauaugaaaauauaauauuauuuaaauauucuaauuagaauauuugaaguguaguguuuaauaugacuuaaggaaaauuaugucuccuaaguaaugaaaagugaaaaguguucuauggggaagaaggggcucuagacauucccauaaauuucuuucauuuguuauauugauuuuuuaaaaaaauuauuuauuggauaaauuugguaugucagaaaaugugaccuaauuuuaaucuguagucugcuucauucacgguaaaacacuuaaauguaaauuuccacccauugcugaagugaggcauguucugacagauggaaauauuuuacuacucaugaagaaugauuaacacugucauaacugaaaucuuugauguuagcuuguauauucugcagcuaacuuuuucaaaguaauuuuucaaauugcuuugcauuuuguucucaauuuacuuuacaauuucaacccugcuaaauauuuugaaaaugacaagguguggggagggagagagagggucuguuggcccccguggcagaguccaagcucuacucuuugccuuaaaaaaaaaaaaaaaaaaaaaaagaaaaugacaaggcagaagucaucaaugugauuucauuuucacaaaaugaaaaaaaaucaaaggagauuacaaaugaagagguucauaucucuuuuaccaacuuagaauauuugugaggagauaauaugguucaugguuuauuuaaauaauugcuuuuuaguaacauauauuacugucauaaauaugaaauaaagcacuuuauauggaaaacaggccaggugcugugccucaugccugcaaucucagugcuuugggaggcugaagugggaggacugcuugagacuagguguuuagcaccagccuggguaacacagcaagaccccauuucuacaaaaaauagaaaaauuagccaagaaugguaguacaugccuguaccaggagguuccuacucaggaggcugagcaggaggauugcuucagcccaggaguuggaggcugcagugagcuaugaucgcacccuugcacuccagcuauggcagcagagugggauccugucucugggagaauaaauaaaugaaaaaaaaauuaaaaacaauuaaauacuuaucaaauauccacuuaaaaggaaaaaugcuucugaugacaauaaccauucuauuugguugauacuuucguggauguuuuuccuaagugauaauuuuaccuuuuucuuuuuuaauaaauguuuuuguuuuuauuuuuuuguuuuguuuuguucuuuugagacagagucuugcugugucgcccaggcuggagugcaguggcacgauuuuggcucacuacaaccuccaacuccuggguucaaaugauucuccugccucagccuccugaguaacugggauuacaggcaggcaccaccacgcccaguuauuuuuuguuauuuuuaguagagacgggguuucaccauguuggcuaggcuggucucgaacuccugaccucaagugauucacccaccucagccucccgaagugcugggauuacaggcaugagccaccuugcccagccaauaaauguuuuuauaacaaauauuauguauuuaaaguaguuaauuuuugucaaauuuccaguauuugugaauaaaaauauuuaaaucaauguuuaaaccaaugugacauaaguuagacauuuuuguauuuccuuaaaauucuguugacauguugccuuucuucuguuugcuaaaaugcuguauucuauucaucaucaauuuuuauauguuuuccuacuuuuuucccccuugcuccuuuugaaggcagggaguaguaagguaaguguuuuauaaaagaaaauauuuuauucaaaaauuuacccuuuauuuuauucuuuaugguauuuuaagguauuuuuucccuauaaaacauuuaacuacauuugucaacaaagcauuauaaaaugaaguaggacaaauucuauaaaagaguugcauuuuuagauagcauauaugguuguuauuauaagggucuucauuaugauaaauuguuuuacauaugacuguacaaacuacuacaaugcaaaugaauaguuuugguuuucuuuaaguuucagaggcucguaaaaacaaaccuaaccacacauauauuuaagugaaagacuauucaauuuuaaaccuguuaacaugauuuaaugcauguuuaauccauucauuuaaaaagaugaaaagaggguaacuaugguauuuguauguuuaauaaaaugacauguagguaaagacucuuuggguuacuuuuauaucuaccuuuggugaugugaaaaugucuugaaagaguuucugaaacgacaguguggaaauggcuagucuguuuuauaaauuaaaaaagguaucauggcugggcacgguggcucaggccuguaauuguggcucaggccuguaaucucagcacuugggaaggccgaagugagaggauugcuagagccugggaguucaagaccagccuagacaacaugaugagacccugucucuacaaaaaauaaaaguaaaaauaaauuagcugggugugguggcagcccuguggucccagcuacucaggaggcugaggugagagggucucuugagccugggaguuugaggcugcagugagcugugauggcaucacuacacuccagcuugggcaacacagcaagacccuguuucgggggugggggguggcgggaggaagguaucacuaggaaaaugcugggagauaaggaugaaaacaguagacuugagaccagauggugcagaaacucaaauaauaggcaccuguuaauauuauaucuacagcaggaauccaucaucuguuuuaagcagagugguguguacaaagauaugaguucagaguaugaagcaaccucuaaaaugggccauaaaaucuuauacuauuuuaccagaaauaaagcacccggaucuagccucacaucuagaauagcuuacucaguacugaucucuacauuuuaaaggagacuuggauaguuuauaaugggcuagaagaaagcacaggaggaagggagguugggaggccacuucauauaaagaauaguuaauugaccgggugcagugguuuaugccuguaaucccagcacuuugggauguuaaguuugaaggaucaguugaggccaggaguuaaagaucagccuagccaaucugaugaggcaccgucucuacaaaaaaaauuuuaaaaauuagcagggugugguggugugcaccuguggucccagcuacgugggaugcuguggcaggaagaugucuggagcgugggaggucaaagcucaaguaagccaugaucacaccacugcacucuagcuugggugacagagcaagacccugucucaaaaaaauauaauaauuauuauucugggaaucuuguuucaaaacaagaaaacuaaauggagauaucauuguuaucuuggauaugaauggcuuuuuauguagaagagaccugucacaagcaguauuuauacagaguuuagaugauuaguugucaucaaagcuguacaaugauuguucuagacauguaaagaagguuccuggucucagugggaaaauggaugaaaugacuuucaugauuccuuccaauuuuguuuugaucauuaugcuauuaagagagaaaaaaaacuuuuuaaagauuacuuuuuuuacuagcaaaauucuaaauucagcauagucccgagugacuaauucugccugcuuggauucacugacuggggaacccucuuaggucagaacagguggaacuuaggcucuuuagacaauuuccuuugaaguaucuccagugcuaccagcuuuuuaaauuaacauuuuagugccagugcccauucuuaaaaacaaaaauaagcuuaaauguuuuguuuaaaauucagauuauauugcagaaaaauaagaauggcaagcuuuaaaguucacaacaugaaauauauugaauucucauuuauuuguuuuuuucuuuuuucaccuuucuugugauucccuguuauuaauuaauggaguaacccuuuuuuuuuuuuuuuuuuuuuuugagacggucucacucuguuaccuaggcugagugcagugaugugaucacagcucacugcagccuugaccuuccaggucaagugauucucccacaucacccucccauguagcugggacuauaggugccacaggccuggcuaauuguuguguuuuuuauagagauggggucucacaguguugcccaggcuggucucaaacucccaggcucaagcaauccucuugcuuuggccucucaaagugcuaggauuacaggugugagccacugugcccagccuuaugccuuuucuuuauucuuuuuucuuucuuuuuuuucuuuuuuuugagauggagucgugcucugucgcccaggcugcagugcaguggcgcaugcagucuuggcucacugcaaccuccguuuccuggguucaagcaguucuccugccucagccuccugaguagaugggauuacaggugcgugccaccaugccuggcuaauguuuuuuguauuuuuaguagagacgggauuucaccauguuggccaggcuggucucgaacuccugaccucgugauccuccugccuugggcucccaaagugcugggauuauaaacuaaaaacaacaggccuuuaauauuaugcaauauagcugucugcauuaaacuuguuaaaauauuuuauuacaggagguauuucacuaguguuuucaauucaaauuuauguuguaaucuuuuucccucuuuaucugcugcugaaaagagguuccagguaauccucucuuugcuguguuuacaaagccuaacuuuguauuuuugucaucuuccauauuuagcauuaaugggauacuguuacuuaguguucuuuaccucucuucacaguuuugcacauuuuuuuccuuuggaauugguaucacugaaaugaauaacaucuuaauuauuggacuuacucuguauaaguaacugcuuuacuaaaacuuauccauucaacuuguauaauuuuauaaguuguauaauuuuauuuucagcaaugauauaccuuauauaaaugauauuuauaaaaauuaaaauaugcuuaaaugaucuuuauaaaaauuaaaaugugguuaauuguuauauaggauuauauagauaaaaauuaccuguuuauuguuuggguuacauuuaaagcugucagacaguaacauagaauaauauucaccaacaaaauugacuuggggaaaaaagcaaggcuucuaucauucuuugaaaugguccugucagaaauauuuuuaaauguuaaauaugauaaauucaguuuuauuuuuacuugugggcauccaaaaaaguauaugaagaagguuugaaaacauuguuuauauauucuugaaaaggauguuuacuuuuuaugacaccagucaugcuuauauauuuuacaugcugccucauauugcguaucaacaucccauucauuucuuauuggauguuuaagauauagcacauuuacuuuuauugauguuuaacuugacaaccauuuugaaaaugcaaguauauuuuaugccuuuaauuuuaugagacuuguucauaaauguuggagucuuuuauaugggaagguuaauuuguauuauuuccugauuuagguguuacaaauugaauauuaacuuaaaauuuggaaagggauuggugcaugauugauuuaaauucaauguuccgguuauucaguauuugaauaaugguugagauaaaaauaauaaacuaaauugcauuuuuuaaaaaaauuaaagguucuagagaagagcuucuacauuuaaguaauucaaaaugugaacucaauauaccuguugggacacggcacauuauaaauagauccugaacagagaagaggggcuagauuugagauuugacagcuacuguguagguaaaguugauacauuuuuaguaaauagugagaauaagggaagagaaagaguuggaagcaauaauaauaguuauuuccuuuuauaguguguuguaugguuuacagugcuuugugacuauaaaaugucuuccuugaguaaccaucugauggcaaugccauuaaccaguacuagggacuucagcaaguagagaaggugaagggcauggagaaacagauaaauacaaauuugaacucggaugugauuuauguugcuaacaguguggaacguucauagaaauauuacgaaaauucacuuucaagaaggauguauucaauaccugccaugugaagauacucuguuagauacuuuagaacaguaauccaggcuuuguuguuaauguaccuaucaagaaauauuugaguauguuaaauuaacauuuucacauuuguuuauaaacaaucuacucuugugcuguuauuuacauuaugacacguacaccaaagaaauuaaaaguaaggcugugcacaguggcucacuccucuaaucccagcacuuugggaggccgagguaggcggaucacuugaggccaggaauuccaaaccagccuggccaacauggcgaaaccccaucucuacuaaaaauacacacauuagcugagugugguggugcacgcuuguuguuccaguuacugggaaggcugaggcacaagaguugcuugaacccgggagguggaguugcagugaggcgagaaugugccacggcacuccagccugggugacaaagugaaacuuggucuaaaaaagaaagaaagaaagaagagaaaaggcugggugugguggcucacuccugaucccguaaucccagcacucugggaggcccaggcgggccgaucaccugaggucaggagaucgagaccagccuggccaacauggugaaaccccgucucuacuaaaaaaauacaaaaauuaucuggugugguggcacacaccuguaaucccagcuacucgggaggcugaggcaggagaaucgcuugaauccaggaggcagagguugcagugagccaagauugcaccacugcacuccagcaugggcgacagagugagacuccgucucaaaaaaaauaaaauaaaaugaauaaaaguuguaauauuuucuuucuaccuuccugcuuuagaagcucucaagaugaagagggcagucuaguggaccacagaaugggucaucuuugggaaggugugacaagacaccucucugggagggauggugugagaggcucagugaaggcacugagugcugcaugccuuuccuccuccccacuucucuguugcaggccuccagugagcagggccccaccacagccagagaaacuccagacaaacaauguaggcaagaaaaagagaccuauagagguaaggaaaacucacucuccaguguuacugaaauguauccagaguucuuuuuuauaaaacacccaaguuuugucauuaguuuucaugaaaaucaguguauuugaguacuguuuuuuguuugacuuaauucuuauguaagucugaguuuuggauggauauucucuguuucucuuaauuuuuuaaauuagucuuccuuuuacuuuucugugaauaauacccuaauugaacuguaucucagaggaguccuaaaccuaaguaugugugaaugaucuuuugcuuauagaagcacagacaccuuggcaguaucuaaaauuuaguggcuuaaauuuguaaauuaaagaguaaguacuuauaccaaauaggaauuuugacccugugcgauauauucacuguacaggguucaugaagccuguuucuccuucugucucugcuuccagccaaaguaaccuuacguaauaauugaggaagaaggaaggcucuuuaggcauuucauaaucccgguagcaguagcgaacaaccaaacucugcuaaaucaaacguaaacaaggcguaaagcugugcgauggugauugcugucguucccuccccaaccuaguccuacaaagucaaugaaauguacauuuucaguugcagaauuaucugccagaacuuuagcaugaauugucagagacaguauacuuaguuuuuauccaccgaugaugaauguacuguuugaguucuucgaaguaugugacuuggacauaauuuauccugacucuuguauguaggucagauacuuugauuaacaaugaacauaaaauuuucuucuuuuggacacaaaaaauacagucccucuauguccaugggggauagauucccccuggggaugccaaaauccacaggugcucaagugccuuauauaaaauggcauaguaauuugcauauaaccuaugcacauucuccugcauacuuuaaaccaucuguagauuacuuaugauaccuaauacaguguaaaugcuguauacauauuuguuauacaauauuguguuuuaaauguuauuuuuuauuguuuuuuuccccaauauuuucuaucuggaauugguugaauucuuggauauguaaggccaacuguaccucaguguuuacaugugaaaucuuaagaacuaaaguucuuggaaucagacuaccuugugauuccauuuuccuuuucauaacuuuauauagaaaaguauagaauguauguuuaagcugcccaaaacagguuauauaaagaaguaugaguagcuuaauuuuguauauuaaguuuguaaaacaucaaaaaugcauacuccauuuugacugcagacacuacuaguauuacguauacaacaaaacaguggugaacauuuauacaugaggaagaauauaaugguuuuauuauuaucauuauaggaccuuguguuggagcucauuuuugguuaucgaggcagagacuguaggaauaauguucacuauuuaaaugauggugaugauauaauuuaucacacugcaucuguuggaauucugcacaauguugcuacagguaggaaacccugauucuccaucccucuaucaauuuuuuuaacuuagaaauuuugaucuagcagcuuaaaaucuuuguuaaagcuauaaauaguaauugaaauguaggagaaacacuccagaauaaaaauauuucauauuucagaacuuucuaguaauauuucaaguaaacaaauuucaguuuuaagagaguauaauacagcagaaaaggaauucauaaugcaaagugcucauaagucucuauuagaaguagagguuuuacuguauguuaaaaccauguuuuauguugaaaccguuuguaacuuuaauucuauuuucccauaaccucaugaugagaauagaugguuuggauggugguuucugauagugauugaauguagcauguugggugagugauugcuggggcuggaaguguucuuacugaggccuuggaaagccaaggaagaaaggcuaagaaagcuguuuaucuguggcucuaugaugauaccuuguuugauccaagaaggugagaaaauuauuucuugauguucauuuaacugauuggguuauucaguuggauuauucaagagcaaauaauguucuguuagcaucauuucaugaacaaugugauaaugcuacuaguaacauuaaguauuuaauuuugaauuguuuuauuacaauuuaauggcaaacuucauaaaagucugaaaguuagaaguaaaaauaaagguuaucuaguucauucugguuuuccucugauagcuucauccugaauggguaaagaguagauugaugaugugaauuauaauccaccaccucuugucgguauuaaccaucaauaugaucuuucuauuuugguuucauaaagaaaaggauucaccaggaucacacagaaaucaguggcaauuuucuauuuaauaauuugggccauuuaaaacauacugauuagagagaaaaauccuucuuaaucgaggucugucuguccuucagagagaaugaggaagaguaagauaaacaagaaaggaauguauguguaaacucucauguuuauacuuauaauuuuauuuuuacuuuucugauuuguaauuaaucacuuuucuagugguggggugucuagagagagggcagauggagacuaggccaccugcuuuaguuuuuauuauauuugguuucucaccaguuugaggauacauugugcauaguguaggaaguggguuugccauaaaugcuucauuauuuugagguguguuccuucaauuccuaguuuguugaagguuuuuaacaugaaagggauguuggauuuuaucgaaagcauuuuccauaucuguugagauaaucauaugguuuuuguuuuuaauucuguuuauaugguaaaucacauucguuaauuugcauauguugaaccaaccuugcaugccaggaaugaugaaaccugcuugaucauggugaauuaauuuuuugauguccugcuggauuuuguuugcuaguauuuuguugaggcuuuucgcaucuauguucaucauagggaugauguuuuguaugggaaugauguuuugugugggauguuuuguaguuuucuaugggaauauuggccuguaguuuucuuuuuucaaaugucuuuggcagguuuuuguaugagggugaugcuggcuucacagaaugaguuagagaggagugcccacuccucuauuuuuuagaauaguuucaguaggauuggcaccagcuuuucuuuguaugucugggagaauucagcucugaauccaucugguccagggcuuuuugauagguuuuuuauuacugauucaauuuuggaacucauuauuggucuguuuaagauuucaguuucuuccugauucaaucuugagagguuguguguuucuaggaauuuauccaucuccucuagauuuuucuucuucuucuucuucuuuuuuuagaggcccacaacuaacaucauagccucuagaucuucuaguuuguguauuuagagguguucauaauagucucugagggccuuuuguguucuugugggauugguuguaaugugaucuuugucauuuuuuauuguguuuauugggaucuucuuuuuuuuguuaagcuaacuacuaguggucuauugaucuuguuuaucuuuucaaaaaaccgauuuuuuuauuuuguugauucuuuguauagauguuuggguuucaguauuguucauuucugcucugauuuuguuauuuauuuucuucugcuagcuuugggguuacuuuguucuuguauuuauauuuccuccaggugugauguuagauuguuaauuugggaucuuucuaacauuuugagauaggcauuuagcacuguaagcuuuccucuuaacauuuaacaugcuuuugcuacaugccaaagauuuugguauguugugucucuguuuuaaucuacuuugaagauuuuuuuuaaauuuuugccuuaauuucauuguuuacccaaaagucauucaggagcaaguuauuuaauuuuuacguaauugugugguuuugggagcucuucuugguauugauuucuauuuugcacuguggguagagaguauggcagagaugauuucaauuuucuugaauuuauugagacuugcuuuauggcugaacauguggucaaucuuagaguauguuucaugugcagaugagaagaauguauauucuaugguugaugggcagaguguucuuucuguuauguccaauuggucaaguauugaauucaaguccagaauuucuuuguuaguuuucuaccuugaugaucuaacacuaucaguggguuguugaagugccccacuuguuugauuuuuguuuugcuuuuuggggggccuaguaguauucaugguuucucuauccucuggauccaaccuacugcucugaacucauuuuccaccucuucauuuuacuuccacaagucuaucuuuuuucccuucugcauggacuacugucauagccuuacaaggucucuucacuguuacuacuaccagaugaaucacauuauacuuauuugaucaaaaaacuucaauuccugcugggcacgguggcucaugcccguaaucccagcauuuugggaggcuaagaugggcggaucacuugaggccaggaguuugagaccagccuggccaacacagcaaaaccccguaucuacuaaaaauacaaaaaauauauagcugggcaugauggcacacaccuguaaucccagcuacuugggaggcugaggcaugagaauugcuugaaccagggaaguggagguugcaaugagccaggauuacaccauugcacuccacccugggcaacagagugagacugucucaaaaaaacaaaaacagauugcaguucuuccuccacugacauaagaacaaauauaaaaugugacucaauauggcccaaauuauuaaauggaaaauuacuacugguuucugugugacucuggcaaauccuuuucuuugagaaaccaaaacagaaggaucgugggcugacacucaaaauccucccuaacucuagucccaagcugccuuuccaaccauguuacucaucuuucuucuucaugacccuacacuucagccaaaugagccuguuauauggauacacaacacuuuccugccuuuaggccucugcuuaaaguguuccucugucuagaaggcccuuccccacugacuuuuacauuuguaaaaucuaucugggucaguccaggaguaccauauucccaugaugagauuaaucuuuucugcucugaauucccauagcauuuugaucccaacucucuuguggcacuuggaaucuucagccuuguacuguauuguuuaucccuuuuacggcucuaucccauuacauaauucugaaucauuuuucuauccuuaugaugcuguauacauaguaagugcucaaaaacauguuuugaauaagcaaauaaguuaaagaguaguuuauuguucuggguaagugcuuuuggcuguuacaucuuaaaauuuucaaacuuaauucucaaauucuuuuuuguagguucucagaguuuuuaucaggaacauaaugaugauauucugugccucacaguaaaccagcaccccaaauuuaucaacauaguggcaacuggccaaguagguauguuucuguauuuuaaaaagaaacaauuuaaagcauuugcuuuguucaaauaaauucaauauccaaggaaaaaaucaaaauuuuauugauuuaucgauuguucaaaaucuauguauacauaaagcccuacccaauuauaccauauuauuugcuuucagguaccuuucucucacucacucugguuaucugaguuggucuugacaauccaaaauuuaaaggaaacuauuguaugguaguugaaauaguuggauuuaguccuuuagcaggaauuucuggucagcaaaaagguuuaagucaauagcauauaaagcagaaaagaggaguuugaagaggaaguaguaaacaaagggaagcuaagaaauaacuagacugggcgggguagaacccugcuuccguggggguucaggcuggaaagaagagaggacccaagucuguuuguuguugguaaaucccuucugccuuuuucuuuucuuugucauugaccuaauucaccaacugucuugagcuguuuugaaauauaccuguauucuuuuaccucugugaaaaacuguuaaacaaaggccauaacucuacagccaaacugaugagaggauggcaggucuguuuaggacauaucugccaaccugugauuacuaaauaugaauauggcagaaguuucauaaacuucaauacguuuguaaaauuuauugaaaucauugaguuuguuggaauuuauugggccuugauggcuaagcuagcuuuccaggucccuuuucuucuugacuaagauaauuuauacuuuuaauaucuuuauuuuucaugcgaguacuaaguugauagucaggaauuuguugucuggguugccugguucugaagcuaugccacauagacccuuguguuuuuccuuuuuguacaguuuucuacuuuuaaaaguaaauggaacauuacccauuauacagaaaauauucuaaucuuugcauauaaauacauaggucuagcuucuguuugugcuaagauuuuggaaagugaagucuuauuuucacugugcacaaggaacaaggcccaucuccuugaggaaugaagaaacuauguuaccuaaguaccuagcucaaugccucuugguacauaguuacuguuuaguuaauuuuuauugaguaaauucacuuacucaacaaauuuacugaacaccugccaugugcgagguauuguuuuaggugcuggggauaugggcuacuuacaaaaaggcaaaaucccuguauuaaugggauuuacguucugcaaauagaauucuagaauaugguucuuucauuucccaccuuggcuucuccuuuucuuuccuuugcucucccucuguuaggcaacuuauuuaucauuuuagugcugugguuuucuuucuuaguuaagaaaugucauggucacaaauuaaucuuuuaggaauuuggcccuuuucuccccuuuauuuugaaagacaacacuauagaaaauaugaaauguuuaauuauaucccuccucuuucuuuccaagucaaaaucuggggaguacagagguaaauuuuagauuauauauguagcuccauucuuuacaccauuuguacccuuccagaagacagauaacaaaaauuacuggugacuaauuaagauagacucaagggaagacuaaagaauaagaaaggauuuuauuuuucuccucacacauaaagagaauuguuuuguuacuuugcugucaggcuuguuuaauacccacaaaacacaaaacagcauuuacaauguuuauuguuccuucuguuaaaaaucauauagaucauagaguaauugaaauguuugauuuuguacuauuuuagccaguuacauucaaacuuuuuuccuggauagaaucuuggaauuuuagggccaaguauaucauuuuguccucucuguuacaguguguuugaacccugcugccacuuaauaccuaaugaaguaaacguuucccugggaagcuuaguuauaaagugguucuucauauacaacagaaaucugucugugauugcuacucuuuggcccucauucuugguguaucuagaacaucuaaucacauucccauggcauuaucuuccaguuuuggagacagcuagcauauucucccugagucuuaucuaguucuuaucuuuuauuuguuucuuuguuugugacagagucucguucuguugcccaggcuguagugcaguggcacaaucucggcucacugcagcccccaccucccggguucacgccauucuccugucucagccuccugaguagcugggacuacaggugcacgccaccaugccuggcuaauuuuuguauuuuuaguagagacgggguuucaccauguuggccaggauggucuugaucucuugaccuuguuaucugcccgccuuggcuucccaaagugcugggauuacaggcaugagccaccgugcccagccuuuugcuucucuuuuaaaaggucuccuuuggcacccuccaacuacauuccauggaacaagguguacaugagagcaaggggauugcuuuccaugggggagccuacuucuccacuggaccauguuuuggguauaugaaaucccagaauucucuaccagaugguccugaaccuacuaauggcccugcaugagccuuuucucugcgucuguccucccagugacagacuguacaaccaauguguauacucuugagggguggccaagcuguucuuuguguagggguggauggaguucuaaugcaguagcuaggauaaccacaugucuuaagaaauuugagcugccaugacagauaccacagaguuuguagcuuaaacaacagaaauguuauuuuucacagcucuggagguuggaaguccaaaaucagggugccagcauggucaaguuguggugagggccuucucuguauuugcagauggcugucuucucauuauauccucacauggugaaaaaagauuaucuuucuccugucucuuauaagaacacuaaucucauugugagggcuccauccucauaaccuucacaccuccuaauaccaucacacuggugauuaggguuucaguauaugaauuuugggggaagacagacauccaguucauagcaccacacaugagcuuccaugguucuuuguggugugggauggaagagaaugagacagguugucucaugcugcccaaacucuaaggaguucuaaauugguaucugccuuccagaucauuauaggaguguacucaucaagguaagaggcuagaauauauuuuauuugauaaguuuuaucuugauggauagcuuuaaaauauuuaggccgaugacauucaagcuuucauuuguacuucugucccagacccuguuaauauucagagacaaaccuagucucuccagaccaaacacucccagucuuucacccaggcuucagguggcaaaguuccaagcccucucaccauuugguuguuaauagagcauauucauaacuaaaaaugauauuuccuauguggucugcucagcagaguuaaguacuuuauucuguuuuuccucauguuccaggucaaggcacuaugguccuauguuaucaauauguuuuuuaaaucauuauuucauauggauauaaagcuuuaccaaagcaaaaaacaaucaccugucuucaauggauuccuauauuuuuauuuucuuucuuguucuaaagacugcuacuuugaaaaguuugguuauuagguauuucuaccacaaauauaaugagcaugagcuuucacauuuucuuucuuggcaaacuuguacucauauggaaaaucuuuaguugaaagaaagaacuuuuuuccuuucuugaguuauacaguaagcuuugccaucaugucucucagcucagaagguuuagaucuaauucuucccuggagacagagaugcauuaaaagaugcauacggaaaaucuuuaguugaaagaaagaacuuguuuccuuucuugaguuauauaguaaccuuugcugucauuaaaacuccagagagucuauuauuagcaguacauuuuuauaaaccaaaaugaggguaauauaauuuuaaaucauaucaguaucauuuuaaaaguuauuauaauuaaaaguuuauguaacucauuaaaugcaaagaaaacaaaauuuuuauccaaaggaagauugaaagaucauacauagcauguuaauaaguauguaugauugaaaugagugccuucucuuacaguuuacucaaucaaauguaauaaaaccaauuuuguauauaauaguuuaaauuauaauuaauaugauauuuggguuuuuacagauuuuacagauuuauguuauuuauagauaauuauuuuccauuauaggugauucagcagacaugucagguaaggaaaacuaaacauuuucugcuuuauuuauauuguuugguaaugauagugcauauuaaacuuaaguucaaguauauuaguccguucuugcauuacuauuaaagaacuggguaauuuacaaagaaaauguguuuaauuggcucacagcuccacaggcuguacaggaaauggggcuggggaggccucaggaaauuuacaaucaugguggaaggcaaagggcuugagcagguauguccuguaugguggaagcaggaggaagagagagaaaggggagguacuacacguuuaaacgagcagaucucaugagaacucacaaucacaagaacagcaagggggaaaucugcccccaugauccaaucaccucccaccaggccccuucuccaacacuggggguuacaauucaaugugcgauuugggcagggacauauauccaaaccauaucaucaaguaucuuguuacucuauaaaaaacuugcggauuuuuuuuaaugaagaauacauuauuuuaaugucaugauucugaacucaaucugugguaauaguaaugguuuuuuuuggacaagcaugguagcucacaccuguaaucccagugcuuuggaaggccaaggucugaggaucacuugagcccaggaguucaagaccagccugggcaacauagugagacccuguucucagcacuguuuuaagcacuuuaauaaaaguauaagcauuuuaaauaaaagcuuuauuugacacgaccaugcuuaugaaguuauauauguucuguggcagcuuuugugcuacaauggcagagguguguaguagcuacagaggcuauagaugacacucaucuguuugcacugcuuuuugguacucugcaaguuccaguaacacaauuauaauucacagacuuugagcacuaucuguuaucucuuguuauuuuauuuuguuuuuuaaccaguaaaucuccaucaugucaagacaaggguacaaaaaacaaaaauaguuuuugaauaucacacuuuuaaggcacagugaagcauggauuguauuguaaucaaaugagaugacaggugggguauaguggcucacaccuguaauccgagcacucugggaggcugagacaggaguuccgaggccaggaguucaaguccagccugggcaacagcaagacccugucucuacaaaauaaauaaauaaauaaauaaaaacuaaaauaccuugaugauuugagaugagauggcaagaaauguguuaaaaacaauaaaugagaugauggcaauaaaacaaaguauuuguuuuuucagaggugguaacauucagcuaugccaggaguagauagcugaggcaugaucugggggcugcaggcucagaccaguuucaggggucccaagacuucccacacauucagcaguucacuaggagaaaucacaggacucagagguacuuaaggcuuuaguuuauuacauugaacagaaaagggaaaagacauaugagguggaauccggagcaucuaguuacaggguuucuaugucucuccaacacccucaugccagggauuacacagaaccugcuucuuccuccagcagucaaauccagcaacacacaugagguguuucugccuaggcaagccuacugaagucucagaguccagaguuuuuauuggggguuggucacauagggauaaagaccagccuuaacuaccaaaauaccaaacgcccugaagaaagcaaguguucagcgccccagguggacaaaagagcuuugucaacauggagaacacuucagaaguucuuacacacuggccaagagcuagcccagcaagcaggcccuucugaugacaguaaccuugggccuuugcacugcuuuuugguacccugcaaguacccugcuuauauuaaaucuuuccugcauaaacccugaggcuggaucaagaaacuggaaggucagugugacuggaggaaggccucugagaugaauguagagagggauaguggucaucucaugcaggaugcuguagcucagggagaagaguuuggauucaugcuaagugcagaggcugucacuggagaauuuuagacaagggagugauaugaccgaauuuauacuuugagaaaaccacucucacuauauuauugagaauguagagggggaagagagaaaauuggaaaauuagguggccguuauaguaguccaagcaaaaaacaguuaagcaggguggcaggagugaauguggagagaacgagacaaauaugggguguauucuggaguaaagccaguuauccuuucugauuaauuggguaugggcguaugacauagugaggaaucaaggccaguugaacuuuuugcuugaacagugagccaaaugggauggggaauacuuugagagaaaucaguuugacaggaagaaauuauccacagauauaaggagugaaauuuauuggacauucuuucuuguacaaauauaagaagacugguagauuuggggauggaaaaauaaggaaguacugucugaugacuuccauuuucccuguaucaucaacugagauugaggagguggggaaugaguauuagguuggaacaaggauaaagauuuuaaauugucacuuugcaaugugggagaauaaauacauuagaagagauaugagcugggcgcaguagcucacaccuguaaucauagcacuuuggguuuuucuguuuuguuuuuuucuuuuuuugagauggaguuucacucuuguugcccaggcuggagugcaauggcacaaucucagcucacugcaaccucugccucccggguucaagcaauucuccugccucagccucccaaguagcugagauuacaggcgacugccaccacgcccagcuaacuuuuuguauuuuuaguagagaugggguuucaccauguuggcuaggcuggucucgaacuccugaccucagguuauccacccgccucagcuucucaaagugcugggauuacaggcgugagccaccgugcccggcaaucuuagcacuuugggaggcugaaguggguggauugcuugaacucaggaguucaagaccagugugggcaacauggcaaaccccaucucuacaaaaauauacaaaacuuagaugggugugguggcaugugccuguagauccagcuacucggaagguugagguagguagauuaauugagcccaggaauucgaggcugcggugugucaugaucacaucauggcacuccagccuggaugacagagugagaccuugucucaaaaagaaaaaagaaaaguuagcauugaauacauuagauauguuuucaguggacacuaugggaauaucuuuugucucugauaaaguaauuucagcccuccuaagacugcaccucagaauuugauauuuuugauccuuaaggcaauuaagcagagaaaacucacucucugguaguauuuguagugacaggcaguugcccaucaaauaacuucagugggugucugcauuuuacagcagaggauaaggaaauuccuuagcacacaagaaugaagagggaggguagccuccggagugugcuacuucaggaguuucaugaugucauccagaacccagggacuuuccgucucuucugcucugcuauccacaguguuggcuucaccgauaaggcugguugcauuuguggucaugaaaauggcugcaguagcaauuggaguuaugugcuuccuugcuguuauccagugggaaagaagcaaaaaaauccuuuucagagccaugaccuaaaaauccuuccguuuagccugacugagucauuuuagccugacuuugcgugaggacacaaagcaaacugcgaacugagaagauacuaggggaauaccaugugcugauugguuuaagucuggguuauuaaacuaaucacugaggucuggguugggaguggaggcaguauuaucacagugggcucagacuuauuaguugagcaugcaguuuguuuccccugaaucacuuacgcucuaggaaggaguagauuccugaauaaaacuggagccuugguaggaagaaaggauguaauggaugcugaguaugcaguaaggaguuacucacuacagagacuaaaggacaaaauacacuuggcauaccuaaugacccauguuaaaauuuucuuuuaaaauaaaguuuuuauuaggccaggcaugguggcucaugccuguaauccuagcacuuugggaggccaaggcaggcagaucaccugaggccgggaguucaagaccagccugaccaacauggagaaaccccaucucuacuaaaaauacagaauuagcuaggcaugguggcaggugccuguaaucccagcuacucuggaggcugaggcaggauaaucacuugaaccccagaggcagagguugcagugagccgagaucaugccauugcacuccagccugggcaacaagagcgaaacuccaucucaaaaaaaaaaaaaaaaaaaaaaaauacaguuuuuauuauacugcaucaaaggcaaacuaggggauaaagaauauccuuuaaaacuuugauucuuguaagacccaauuaaaaauuuaaagagacacuuauggcaucucuauacuggaaacuaagagugaaaaacgguagugaaaaguuacugggauugauuuucuggagggagcuacauguggggaaaagagcaagaguggaaccuggauacugagaacagcauaccugugcugccucucccagcucugaguuguauuagggcaagucaguuaucuucucugaggcugaauucaggaaaaaacguaccuaccuagaagguaagcauuagaaaauaugcgauguccccaguaacaugccugccaugauagguacuuaauaccucauggccuccuggaacagguggaggaagaauuguuuauguguuacccaagcaucaggaaugaccauuuccaaaugauaggagaaaauauaauauacuuaauaaacauaguuucaucuuuaguaacuucgagagguccugaaaauuugcaguaauuuuaguuuuaaauacuguuacugauguaaguuuagaacagucuaagugugugacaauuccauuaccuuacguaccuauacguuuuaaaacauaaauucugguuucaccuucuugccaucuccuuuaauuuuuuauaaaaauaugagaagcucagucauugaauuuaagauuacuugcuauuuaaauuuagauaaauaaaacuuuaaaacuuguggcauauuaaauuuggaggcaaaguuagugauauuucuugaaaaucuauugucuaccucaucaugauuuggcaaauauaacaugugaauugccuagaggugcauuuuguaaacauauaaaaauauuuauauaauauuuaucacuggcaaaauguauagagugaucugguauauauuuacauuuuaaauuuaagccaccuaacauucuuuauugagguuaaguuuaccuaugccuugggguacuuugacuuuuaaugaaugaauaauauauuaauuuuaguucaauacugacauuauugucauaaauuuuacaaacauaaauaaccuauuuuauuauaugauaaacuuuuauguauguuuccguguaguuuugauauuuuacaguugcauaaaucuuugaacaauuucuacuuaaugauacucuaagucucugguuuaauauauuuuaacugcuuugaagaacugccagauuuaauuuaucauuguguauuacaaauagcagaugguauaaaauauaaucuaaacuuaucagaauauuuucuuuagagaccaacauuuauuucugcauugaaugauuuaaggcagcuugucuuaauguuucucuauuuuuaaaacauuuauaacauuuauaauuugaagcaaaugcacuuuaguauuuuuauugcuucauuaaaaguacuuauguucugagauugaauuaacugcugaauugaccuauccauuuuuauagggugcaguucauaaaaaagaaaauauaaaacuauaauuuuuuuaauuuagaaaauauggagaacugggauaauuuuuuaagcagcagaaacaagcuacacaagauuaauaauaaccacauuuuuuuaaagauuagcaguuuuaucuuucucaugaaauccuuuuuaaguaaaugucuuauaaagugauaugaacuuagcuuuuuaccagaugucuaucuguaugguugaaaauuucuuuugagaucuauucaggugguuuccuaucuacugccuuugucuauuugugucugcuuuucacuucucuuucagauaacaucaguacugaauguauacuugguguuuaauauuuauuguuuaauauuuguauaguucuccauauaauuguauaaagauuaaaaguauacauaaaacaugcauuuguuuugaauuguuuaaaguugagauugccugauuugcuugucuaaaugcuguuuuuccaaaagugcaauuuggaauauggccugaagaaguguucuauauauuuuccuuuucuuuccuccccacccccaaaacuccuuuuccuuucuuaaauuuagccuuaguuuugagcuguucuuuguuaaguacaguuuuuguuugguacacauuuguccauguuucacagaugaauaugcauaagcuuuagaaacagaaauauuuauaacagguagauuacaacuuuuugauacuaucuuuauuuagcuacagcuccuucuauucacaucugggaugcaaugaacaagcagacuuuaucuauccuaagaugcuaccauucaaagggaguauguucagucagcuucagugcuacuggcaaacuauugcugucugugggacuagacccagaacauacuauuaccauuuggagauggcaggaagguaggauucuuuuguguguuugauuuuuaaaaaaacaagaauacaaagguaguaggaauucuguauuuaauauuugucuuaaaguuggugguugaaacaaucauucaguggaggccuaugcaauauacuguacacagugguacuguagguauauuucacuuuaaaagcccaguggaacuguaaccucacaaaacagauaaauuaaugaaaccauuauuagcauuauaaaugauucacugcuauuuucuuccagcaagaaacuauguauuuauuauuaaugauuugauugguuuuggagauucuuaugaaaauuauguauauuucuaaugauaauggcagaucagcaggauaauauuaccuaccacacuuuagacaaaacauuuacguuauauaaagaaaaguuaauggagcgaagauaagugaaaaggacucaauacacaaauaauuguaaaucauguauugcuagguaguagagcaggggccauuggccucucuucuaagccuuuguuuuuugaacuauguauuuuacauauuuguuugaugcuguugauuagcuugguucuuguaauaaccuagauaauuuuguuguaucuugucaggugccaaaauugccagcagagcuggucacaaucaacguauuuuuguggcagaauuccgaccagauucagauacccaguuugucucagugggaguaaaacaugugaaguucuggacccuggcaggaagagcucuucuuagcaaaaaagggcuacugagcacacuggaagaugcccggaugcagaccaugcucgcuauugcauuuggugcaguaugucucuuaaaaugcacauagugugacuuugacuacuuuacauucucuugccuuagaucaucagccacaugaauguuguugagaugauacugugaucugcuaaucauuacaugcccuggucaagcauauauuucaucuuucaaaaaucuaguucuuucagaaauuagggagugaaaagaauguuaaugagagggggaaaaggauuuuuuuuuuuuuuugacacaguaucucacucugucgccugggcuggggugcaauggugcgauuauagcucacuguagccuccaucucccagguucaagugauccucagccuccuuaguagcugggacuacagggcaggaaccaccaugcuaggcuaauuuuucuuucauuuuuaguagagacaggguuucgcuauguugccuagguggucucaagcuccuaagcuaugugauccucccaucuugaccucccaaagugcuggguuuacaggcaugagccaccauaauaaggauucugaugaacauuugauuccuuggacuacuguuauacucaaaagccuuccuuaaucuucuaauugucacccuaaauauccuaaaauuucugucuuccuaguaguucuucauaguccuaaaaauuugucagagagaaagguaaaucaagaaacaugauuuucaaaugauuuaaggugguacuaggguuuaggauuuccuuugcuuuuuaucauuuaacacacugcuuaucauacagcuggaagugcucugggccagugucucuacuucgagggaagaaggagguagugagacagaaggaaauagcacaauuccuggcccugacagaaggguguucaggagaccugcucuccucucacuuuauuccaucucaucuggaccuguggcuuccaauccacaucucuuuccuuuaauauccugcauuggcuaggcuguauaaauccuuuggugcaucgaaaaacuaagugcauuuuuuguuuuugugauuaugcaauacuuauaggaaaaguuauaauuuuagaauauuuaaguacacuuacauuuuugagaaaaagacuauugaaauguuugugccaugucaaauuucaguugaacauuuuggguauucuuaauauaagaccaggccaggcaccguggcucaggccgggcacaguggcucacaccuauaaucccagcacuuagggaggccaaggcgggaagaucaccugaagucaggaguucaagaccagccuggcuaacaaggugaaacucugucucuacuaaaaauacaaaaauuagccgggcgugguggcuggcgcuuguaaucccagcuacuugggaggcugagacaggagaaucacuugaaccugggaagcagagguuguggugagcugagaucgcaccauugcacuccagccugggcaacaaagagcgaaacuccgucucaaaaaaauaaaaaauaaacccuagaauuauaguauguuagaauuggaagggaagaauugucuaagguuauucuagcuaauaagcaacagacuuggaaaggaaaagguccugacaaagcuaagccucccguucagguuuccugacucgugaauucagugcugcugccacuacacgaugcaugcucuuuguaucaagggugagacagcauuacacauacauagaaaauuaucuauuuaaacucuauuugaacuuuugaugaguuugucucccccucccccacuccuuuucagaauaacuugacguuuacagguaccaucaguggugaugucuguguguggaaagaucacauauuguguagaaucguggcgagagcucacaacgggccuguguuugccauguacaccacccugcgagauggacuuaucgugacugggggaaaggaaaggccgugaguccucuuucuuuucacagaauauuuaugcauuugugaccuaccugagguuugcaguuaauuauucuaguuguuucuaggcuacacagaguguccucuccgaccuuccuccucauaugcuucuccuuuauuaccuuuuaugugccuucuauuugauucucauuucuggucuuaauucacuuccaauuuuuuucauguuggggugauacuuuuucugagguguggauagguaguuguccuacaaguugaguuacuuuucuuaaugucuguaugccuguguaugauuugcugaguaggaggcccaugggggaaucuggagccaggguuguauuuugacugccugcucucuuuuuguucagaauggauucuaaggaguagaaugcacauuguugcuuuagaaaaggaugagggaacuagagagaacugccuuguuuccuuuugcuugaggcaaauuuaaacuguuuuauacaagaccucaaaauuugagaagaggucucuucugagugauuuucaaaucucccaacaguaaccagauacuuaugauuugauuugucaccaacauagucauaugcauguugaaacaugacauguaggccaggcacaguggcucacaccuguaaucuuaucacuuugggaggcugaggcagguggaucgcuugagcccaggaguucaagaccagccugggcaacauggugaaaccccaucgcuauaaaaaacaacaauuagccgggugugguggcacaugccuguagucccugcuacucaggaggcugaggugggaggaucacuugagccuggggaggucaaggcuuuagugagcugugauggugccacugcacuccagccugggugacagagugagaccccauuuaaaaaacaaaaacaaaaacaaaaaaaaaugugacauauaguugacuaagaaguacauuucaauacaggauugaaagaacccacauauguuaauuaaacacaagcgcagaauuugugccuuuuacauaaaggaagaaugcacauaggcaugcuuucagacaagcaauucaucuagcagaaaaggaaggaauacauuuuucagcccuuccaggaauaaaauccauaaaugggcucuauuucguccuccaacacuuguauuucccacgucauuuacuccugcacacccccacucacuagaagccugcuaaacuguuccagugagauauuuuaacaccugauagggaauaaauaugcuucuguuuuggccuucaaaaauaagcucugggccaguugcaguggcucacgccuguaaucccaacacuuugggaggccgaggugggcggaucacgaggucaggaguuugggaucagccuggccaauauggugaaacuccaucucuacuaaaaauacaaaaauuagccaggcauggugccuguaaucccagcuacuugggaggcugaaggagaagaaucgcuugaaccugggaggcacagguugcagugagccgagaucacaccacugcacuccaggccaggugacagagcgacacucugucucaaaaaaauaaauaaaucaacucuguagcauagcauuuguaauucuauuauuuugccuuacauuuccauuauccuuuuaauaaaauuguuuuuuuacaucuuccuaaucaagaaguauuaugaggccaggcacaguggcucauaccuggaaucccagcacuuugggaggccgaggcaggcagaucaccugaggucaagguauuugagaccagccuggccaacauggugaaaccccaucucuacuaaaaauacagaaauuagcugggugugguggugcacaccuguaaugcuagcuacucgggaggcugagguaggagaaucgcuugaaccugggaggcagagguugcaauaagccuagaucaugccacugcacucaagccugggagacagagcgagacuacaucuuaaaaaaaaaaaaaaaaguauuaugagagaggauaauguauuguaauguauuguagaggcuaaauaaaauuaugcucaugucagaaaaaaagaguauuucucaaaauaaaauucacugaaacuggauguuuauuuugacugagauauaguauauccucaaauugccauagaaaguuuacaagaauauuagagguaaauuauaaauaucagggccuuuuuaaaaaaaaaagauucugcuuauaacuugguauuuguuuauaauaaaaauuauaguagccaauaaugaacacuuacucuggcuugguuauuuacuuaggucaaaagaaggaggagcgguuaaacugugggaucaggaacugaggcggugccgugccuucaggcuugagacaggacaagccacagauuguguucguucugugugcagaggcaaaguaagauguuccaugagcugauacagugcagcagaaaacagaaagugguuauuacugugauucccucacccuuugcagccuaaugaacaauacuuaauaaugcauaacgauggauuugcuugccaacauuacucugucuuugcugcuuucuuugccaaaguuagcaccaguguggugcauaagcuaggaagcuauucugucuaaauacuguauguaaaccuccaauauuuucuagaaucugccaauuuaacaacucuaguagacauaauugaaagcccuuggcaguugacucauauuaggacagcugucuccauuuuuuaaaaaaacacacauucccuagauaaaacgugcaguaaacaaacaaugaaauacuacucagccauaaaaaauaaugaaauucugucauucuugguggcaacauggaugagacuggaggacaugaugugaagugaaauaagccaggcacagaaagauaaauacauguucucacuccugugcagaaacuaaaaaaguugaucccacagagguggagaguagaauagugguuacuggaggcggacaagggggagggggagggggauagggaaggacugguuaaaggauacaaguuuacacagccagauaggaauaguauguuuuaguauucuguaguacuguaggaugacuauaguuaagaaucacguauuuauguauuuucagguauuuacaagagaggauuuugaaaguuuccaucacaaagaaaugauaaaugucugaggugaugguuaugcguauuacccuaugcccuauagauauguauaauuaugugucaauuucaaaauaaaaauucaaaacuacaacuccuaugaaaauuuuugagcguguuuguacuuauuaaguguauuuauaaaucauacggauauuaucuucagccugcauauuaaauuguaguuaagcuuuuacuuuuuaacuaaaaaauaaauucuauuauuuuuuccuauaucccacugcacugaccccaguuuggaaauccuaagauuaucaaauaaaaacuuugauuauugaagaauccagguguacugccacagaaaaguucuauucuguagcauggacucuaauauguaaucuagcccauugugcuuacagauagaugugugccuguagucauagaaaaauuugcaugagcuaaugacugccuugcuacuagauuagcucaaagcaaaaaguucucugaaagcaggucaauagggucauuuuuauauuaugaagaagaaaagcagcuguuguauuacauucacuguauugguccugcuuguguuucagggcaagauccuuguugggacaaggaaugcugaaauaaucgaaguuggagagaaaaaugcagcuuguaauauuuuaguuaacggucauguggaugggccaaucuggggacuagcaacacauccuuccagggauuuuuuccuuucugcugcagaagaugggacagugagacuuugggauauugcugauaaaguaaguacagauaauuuuuuuaaaagagguuacaacuucuaaaaagaaaaguuggaaguucuaaauugcuaguacuuaaagaacugccagaauucuguugagcauuuugaggggaaacugguauaauuuagaaguacuucacuuaauguuuccuaugacucuuuuuuuuuuuuuuuuuaaaugcagaagauguuaaacaaagugaauuugggacaugcugcucguacuguguguuacagcccugaaggggacaugguggcuauuggaaugaaaaauggagaauuuaucauuuuacuagugaguucucuaaaaauauggggaaagaagagagacaggagaugugcaauccaugauaucagguuagugaacaaauggaauagaguuucuaguauauacuugauuuaacuuccauuuguaaaauuuuccauagccuugccuucaaaaagagguccccagggccuguagcauuucccguauuauaaauuguaugcuaaaauauggcuguuuguauacuacuuaauucuucuugcuaaauuauaaacccacugggcaccaacuauaauagcaaguacuaguagguaauguuugaugaauucauguuaacacuuagccauguccauuaaguucaucccaccaagagguaucucccacuguaauacaagagagcuaucugcccuucaaaaguugucacccuggaaaacuaaaguugugauuucaaacauaucuucucuuaguaaccucaguuugggaauauguaguucauuaauuuaaucaauaccuauugauuaaauguuccagaauccaaauuaauuuaaauguuucuuaaaccuuuguuuuucagugcuuaagcauuuuucaacaguggcuaccauuuacggaguacuuccgugugaucaguagauaagauuauugaaucuaggucugucaaaagcuuguacacuuuucaucaguaaaauccuuuuacaaaugaaaccuuccucagaacuucaauauauaaaauaguaacaguggcuucccuuagcuuuuacaugucucuaucguaccucaguaagacucaugggccauuucaagagacugaauugucccauaugacuccaaagauugcuaggcaaauagcauuucacuuugucuuuuaaauaaguucuucaggccgggcgcgguggcucaugccuguaaucccagcacuuugggaggccgaggcaggcagaucaccugaagucaggaguacucgaccagccuggccaacauagugaaaccccaucucaacuaaaaauacaaaaaucagccgggcgugguggcaggcgccuguaaucccagcuacucagggggcugaaacaggagaaucgcuugaacccgggaggcggagguugcgccaucgcacuccagccugggagacaagagcgagacuucgucucaaaaaaaaaaaauucuucuuccaagauucaaguugugucauuucaccuuaauaacuggagguuaguuaagcugggcuguguucuuugcuuaauauuaagacaacguuuuuuccagauggaagaaaacuaucuuaaugaauuguuagcuuauuaauuauguaaugcuaauggcuuuuaaaagcugagauguucugacuggguguuguggcucacaccuguaaucccaguaccuugggaggccaagggggaaggauugcuugaggccaggaguuugggaccauagugagaccccgccucuauuuaaaaaauuaaauuuuguuuuguuuuguuuugaguuggaguuuugcucuuguugcccaugcugaagugcaauggugcaaucucagcucaccacaaccugugccuccuggguucaagcgauucuccugcuucagccucccgaguagaugggauuacaggcgugcaccaccaugccuggcuaauuuuguauuuuuaguagagacaggguuucucuauguuggucaggcuggucucaaacucucgaccucaggugaucugcccgccuccgcuucccaaaguucugggauuauaggugugagccacugggccuggccuaagaaaguuuuuuuaagccauuagacguuuuuaaaggaauugggagaugacaauuggggaaauauuuaaaauuuaaguaaaauauaaagcuuccuuauuucauguaacccagacaaucucaguauacaugaucaguugugucugacagguaaaucuauuugaggccuuaucacacguuacuuuuaagaacuagaaaggaaaagucacugaucuuaaguauuuauaauacuucauguggucuaauacuuuuuacguuuuguuuugauucagauuuaguccggauucccgguaucuggcaguagguucuagugagaacucaguggauuuuuaugaccuaacgcugggccccacucuuaacagaaucagcuacugcaaagacauuccaagcuuugucauucaaauggacuucucugcagauagcaguuaucuccagguacaguaccaauacuguauacccagguggcaaguucuucugcuuuuacauuucguguuagugaaugcauuuaaaguuccugagcuccagagcuccagcuucucaacuccucccuuuguaccuucugaccuacagcuccccuuuccucccccacuuaucagagcuuuucuccuauuaaguuuuuguagugaucuuuugcauacuuaauaauguuagacauguaaaucaaguagcaauaugcuaguauucuguaaacccccuguggauuuugucucucaccuaauggaauucuugucccauuuuaaucugaugaaaaaggucucuaguggcugcuauaaacggcaugucuaugaagugccuucaggaaaacaucuuauggaucaugccgcuauugacagaauuacuugggcuacauggacuagguaaauacuuauauauucacaaggcaagaacugacuuugaaggccaguuagaaaauccuauuucugaacuguuagagccauuccaauaaggaauaguaauugaguuucaaguuuuuguuaccauauuuugaaaugguauguucauguugggaccccuuuuuauugaauauauuuccauguuuuaucaguuuccaugauuuaucaaguuuuuuuuuuaaggaaaucaaaguuuuaacuuuaaagauacccugauauuuuucuuaaugcuaaauuuaaugacuggcaaaaagguauugggugcuguuaagcaacuguuauuaauucucuaucuaaaggaaugcuaucuugaaucuauuagaagucaaagcuuccaaauuuguucaaauuuccuggcuguaugacagguaaccaugacuauccauuuuuuuggccaaugaaaaaugccaucaaauuccuguaucagccaggcauauaguggcucaugccuguaaucucugauguagcaggccgaggugggaggaucacuugagccuagaaguuuugauaccagccugggcaacauagcaagaccccaucucugaaauuuuuuuaauuccuaugucauaagucauuuuuauuuuuguagagauagggaucucacaauauugcccaggcuggucucaaacucuuggccucaagcaguccuccugccucagccucccaaaauguugggauuacugguaugugcugcuggacccagccaaguagcacuuuuaauuugaaaaauaguucuaucaguuuucagucaggcgcgguggcucagccuguaaucccagcacuuugggaggccgagcgggggugaucaccugaggucgggaguucgagacuagccugaccaacauggagaaacccugucucuacuaaaaauacaaaauaagccgggcauguuagcgcaugccugugaucccagcuacucgggaggcugaggcaggagaauugcuugaacccaggaggcagagguugcggugagccgagaucaugccauugcacuccagccuggguaacaagagcgaaaacuccgucucaaaaaaaaaaaaagaaaaaauaguucuaucaguuuucauaaaguacuacuuuaaucuuaaaaagauuaaucuagaaacccuucaaauuauaaaaugucauuuuuaaaaggcaggaguugauauccugaugaaauucaggucuccaaacaacuuaccauaauuuacuuccuguauuuuaaguaacaugauaggguacuuagagauuaauugccaagaaacuuuuugaauauagucaaccugcccgcacuugccaugaugaguuuucuuuuguuccuucccucuaguauucuaggagaugagguuuugggaaucugguccagacaugcugagaaagcugaugucaacugugccuguguaucucauucaggaaucagucuuguuacaggagaugacuuuggcaugguuaaguuauuugacuucccauguccagaaaaauuuguaaguuuguguuuuguuuacuauuaucaguuuacuccuaauuuugaugucuuaucaucagcacuuuuccccauauauuuaaaauguuuuguccuaauuucuaaauuuuuccccaaacuuucuaaaucuauuuacuuugaaauaaaagcuauuagaaacaaauccucucccucgaguaauaccaucuuuggaaccauccuacaaaagcuguaauuagcuuuucaccaaaccuauaaucaguuaucaaauuucaaaugcuuuuccuuagagaaaaauggucagaguaccuggagacaucugacugcccacacagccugguuuugcagauccacuacucaugcugaaaagcauucuaaucacuggcugcggugcuaacucccuacucucuccacagcucuugucauagagauuauaguuccuaauaagagccuuugacuucugugugcaccaaaugcccugagcuugucugucauuguuuuuuaggcaaaacacaaaagguucuugggucauucgccccaugugacaaauauucgauuuaccaguggugaucgacauguuguuagugcuggaggugaugacugcagguuaguaacuuucucagcccaugaagagcagacuauguuacuaguuaagagacuuaauacaacaacuccuacagcuuugguuuaugaaaucagcuagucaacauuaguagaagguaguauaaccagauggcucuucagaaucucauauuuaugcaaauacagaauaaaaggaguuaaagaggaaaaauauuacacauguaaccugaaagcacaacugaaaaauauuaaacuguuaugaaaaucuaaaaacauaauuaacucccugcaauuuucuucucugauugcagcuuauuugucuggaaauguguacauacaccucacugagagaugcugagaugacuacagaaauuaacuuugagaccagaauuacagagaagaaaaaccaaaacccaacccugcauggucaaguggugcuaacccaagacuguaacagggagaaaugcccagaaucaucaaaauagugaaagacugaucuguucaaaauauuugcuauaugcacuggguauaauccguaauccauacacugccagauaaugccauuucaaggaaggaucgaauacuugaugguaaaggccaagucccccuguauugggaagugugugauuucggcagaccugcugggaaaauuuaggguagagcacucuuuacagaagaacucaaaaacccaauuuggauaauuuucauuaucuuuuuagcaaaaugguuucuuaauguuuauauuuuauuuucaagguucauuguuuaaugaaauauuuuauucuugcauuuccauaaggaaagggaaagucaugaucauccuaaaggaucacaguuuuuaaaaggcaaacauuuucccuaaggaaacagacacaagcuuuccuagagaauaugauguuuuuuaggcauuaauaagguccuuuuuuauaaaggacacuuuucuccuaguaguuuugaauucaggaacagauccaaaguuagcaguauauggcugcuacauuuccauuuucauuuucgagccaucaguuuauguucagaugccaucucuguaaucgcacauuuaaaacauaacuguagccucacuaauggaaaaguaguaugaugaacaaucauucccaaugguguacaauguaaggguuuuagggagcaacaguauuuaacuggaagaaagaauugcauauuuaauguagucuaauauauacacauuuguuuaacauguaaacaaaaguguuaaauucacauauacaacauuauacaauuuaaucacucuuggaauaaaauuuuuauagccuuuuuucuauugggaaaauuuguuuagaugugugccacuccauag

SEQ ID NO: 192382 - RNA, 42246 nt, Homo sapiens
aauuuauaaaguaaacacguuuaauugacucacagucccacaggcuggggaggccucaugaaacuuacaaucaugguggaaggggaagcaaacacauccuucuucacauggcagcaggaagaagugccaagcaaagggggaaaauucccuuacaaaaccaucagaucuugggccaggagcaguggcucacgccuguaaucccagcacuuugggaggcccaggcgggcggaucaccugaggucgggaguuugaggccagccuaaccaacauggagaaaccccgucucuacuaaaaauacaaaauuagcugggcgugguggugcaugccuguaaucccagcuacucgagaugcugaggcaggagaaucgcuugaacccaggaggcagagguugcggugagccgagaucgugugccauugcacuccagucugggcaacaagagcaaaacuccaucucaaaaaacaaaaaacaaaacaaaaaaaaacacccaucagaucucaugagaacucaccaucacaagaacagcaugaggguaaccaccaccaugauuaaauuacugcccacugggucccucccacaacacguagggauuaugggaacuauuaacacaauucaauuugguggggacacagccaaacuguaucaguauuacaauacaauaugcaaaccagaugcuuuaaaucauaaaacaaauucagauuuucguuccccuggaauauaaauagcauuauagggcuuaaucuauacaguaauaagaguuuaagugaaauuuuuccaaagcacuaaaaagaaaacauacucuuuauauuugccuuuuguaacauuguuuuaucugguuuuccauaucaaaagucuguaaacuuugcauuaacacuauaaucuacaauaguagcuuuauaagcauuugaaauagaaugaaauaguaauucgagucugauauuacuggguuguuccacacauaguuaaauaagaucgauccuuccaaaaaucuaaggguaggcuaguuguggugauucaugccuguaaucccagcacuuugggaggccuagguggguggaucgcuugaggucaggaguuugagaccagccuggccaacauggugaaacccugucucuaccaaaaauauaaaaauuagccaggugcaguggcaugugcccguagucccagcuacuugggaggcugaggugggagaaucacuugaacccuggaggaagagguuauagugagccaaaaucucaccacugcacuccagccugggugacucugucucaaaaaaaaauuaagaguaaagaagagggcuuaaccauuugagaaauaaacaucaaggucugccauucuaaaaaagcauuaauggauuacaauaguuucaauaguuuacaugguuuucacucuuuaaguucaaugaaaauugcauauauuguuuuuacucuugaacacagugguuaauacuauaucagggugguuagucacaagaaagacgcaaauacagaaaggauaaccuuauccaacuucaguauuauuuuaguaguaauguguauaaaauccaaccacugcuugggugaccuuaggagacagcaagccuaagagaugaaaacauuuacaccuuuuaauuaaauuacacugucaccacauaaaagugugagguucaacauuuguuuucuuaaaaacagagcacuaaacaguuuaacacaggaccuaacuuacggcuaagauguuucuaaaauguaugcagaacccuuaagacuauacugcaucaaguaguucuuuugaauuauguauacucaaaugaugguguuauaauuuacauugaaaugccacaacaaaaucuugauaaaacaagauauaggagaaauaaaaauuaauuucugaaccaaauguguacuaccuuacccuagaguaaaucacugggaaauacaggcagaaaacagacauccugccugugaaaacaauugcauauucaaacuggagagagucauagcacguaugcuuuuaaaaguaaguuucgaaaaacuguuuuaucaguuuuguuuuuuuuuuggagcaugucuuuucuaaauaauucucacuuaucauuccagaaaauauaacaaacaguuuguaagaacucaugcaaaaauguuucucuaaggccauaaauugguuugcuaaguugcauuguuuuauucaaguaaaaagcccuucuagagaacaaggagucuguaaagaaaaccaaucaccuucaacucuugggccuguacaccuguuaggagcucuaucacucugaaagccaaaagauagaaugcucauuugagcauuugcaaaauguucucuauuuauauuuuuaaaaaucugauacauguaaguuuuucuggcagauucuuuuuguauguuacaaaacaaaacaucaaaagcucagaguaagauaagaaucccuuuuucuuagaaaggucaagcagauacuucuugacaucauguccuuuauacaauggcauauuguucauauaaaaggucucuuauccuauaaaaaucuugacaaaggcagccuucuaauccaaugcguccaguuuccgucuagaaaccaaauaaaaaaaauucuuuaguacauuuucuauucauuaauaugcagacauaauaaccgaaauauaugaaauagauuacuuuaugauuggucaggacauggguugcucugauucacagcauauggauauaauauugaagucaugaauuuuacauagacauaaaugucagaagauucaaauaauuaaaauuuacaauaaaauuauauaucauuucuucaagagucuuucauaagccuucaagucaauaagacuucuguaagccuuugaggucaugaucaugaauauaaauuacugaucuucaguuuugugaaaauaccaaacaagaauuacagaauuucaaaaugacaaaacaucagacguauguguucaauucagcccuuauugaaaacacacuuacucugcggacugcuacuugauuguugcaaacaaguacaccuccuacaaauucagcuugaauccccucccguaagagaacuugcuugaagucugacagccuugguucauucauaaaaacugacugauguccaggaaccuuagauaaggucaaaggggaaagaauaacuucaaguaaaacaccagacauacaacuguacugaauaaaguaaaauacuacauuaucucuaagagauuuucuauuauucccugaaguccuuugacagaucauuucaagacuguaaaucacauuccaaguuguuauucuaaauuuuaccccauuauuuaacauuauuuaacaaagcccuucacauuuucuguuucacaaucaguuuuguuagucaugccucaucauaacagagacguuugguaauguuaggcucuucacucacccacuugcauaauggggucaacuagcgugccaugggcaggacugaaccaaaaauucauuuucuagaucccagucauuugcuuacuucaaaagacguuuccuccccaaucccauuuucccugucccuccuuccucagagcaaauguaauggaugccauagguucuacaaucaguaacgaaagugguucuugccuaaugcugcugcuuucugcuuugacauuacuuugaagagcauuagcuuuagcacagaagaaaaaaauauucuuauuccuccucccaauuuugaggguuguacuagaagggaauccaacaacagaggcugucucucuauucuuaauuucauaguagggcugaagacaucacuugacaugcauguaggauucauaguuuuaauauuuuuccaaguuuaauuaccuagaaucuugcuaguuaacuagauaccucucaagaauauguaaaugcuagacuaaauuauaucuauacuuaaagauuucuaacuauaucaaaaccaaaaguuauuugaacugaauaacauaaaaaaauggagguaugacuauuggcugggugcauuggcucacgccuguaaucccagcacuuugggaggcugagauggguggaucaccugaggucaggaguucaagaccagccuggccaacauggcaaaaccccguuucuacuaaaaguacaaaaacuagccgggcccaguggcucaugccuguaaucccagcuacuugggaggcugaggcaggagaaucgcuugaacccgggaggcggagguugcagugagacaagaucacaccacugcacucaauccugggcaacagagcgagacuccaucucaaaaaacaaaacaaaacaaaaaaaaaacaguaugacuuucuuagaaaacuauaaaucuccugacuggaagcaggcaggugauccucacaaucaucaaacuuaaaauuuaaaaauccagaccaaaaaaaaaaaaucaugaaacaauuauguaccuuaaaagauuugcuaaagauaugucauuccuuagcuauauagaauuaauauauacacagagacauacacacagaagcaugucacaaguucucuuuuuuaaaaacuccaaaaucagcccaaaugugagacauauuuuauguucaagacagggucucacucuaucauauaggcuagaugcaguggcacaauuguggcucacuguagucucgaacuccugagcucaagcaauccuccugccucagccuucuaagcugagauuacaggugcaugccaccaugccgacuagguuucugacagggugucccuauaaucaggcugauguagagcuccuggccucaagcaauucucccaccucagccucccaaagugcugggauuacaggcgugagucacugcccccagcugacauauauuuuaaaugguuaaaaauauaaaagguuccacagacccacuuaguuuuagaaggggggaaaaaaaccaaaagacaugaaaacuagaaggaugacaaauucaggaagaaaucaaaaaagcacaugcuuuuuuuaccucaugagguggcaaggguuccaaaguaggaaugaucucacuuucuucaccuguuucuuuuucaucaucuccgaacagacuuuucauggccuuuuguugugcuauaacgcuagaaucugagggagcuuccacuugcaucucugagucuucuccaucauccuuuaguucuccuucuucuaaaauaaccccuguguccacuuuggaaacucucauaucuaagacaccaucuauccaagcuaauucagcaucuuuugccuuacaaaacugaagagagcugacaagugagucuuuuaaccucaccuagacaugcaaaggagggggagagaaauaaaacccacagaauacauauuaacaaauuaaauauaaccuauuaucauuuucuaccucugguaauauguuaaaauuggaaaaucuuucacucaucugagucccacaaugaccugcaaugaccucauuaccugcagaucauugggccccugccuacuuuccaaaauagagauucuuaacccugacuacaaaauggaaucacauggcaauuaaaacaaaaaguauaucagagcgucauauccaguguuucuaacauaacugguaagauuaagaccagaaaaacugagucccucugacccucacgaagcuccccagaugauucuuaugugcagucaagguugagaaccacugaucacucccauccucuaguacuuggcauacuucaguagguacugaacugcuuguccuuuccugaauauaccacagaauuucacaucuccauauucuuggaagguugcuucuucuuacucugcccagaauaaauuuccugccugguaugugcacauccauuucuuccagauauagacaucacucuggccuuaaacugacaccaucucccauuaccagacaaaauuuaucucucuacugugcuaguccuauauuugguauccaucuccauuuguuccaauuaggaguagaaccuugauauccgggaauucuucuaaaacuuuugaauucuuaaucauuuuccucaccucuguacuuuugcaaauaugguucccucugccuagaacgcucuucccccccuuuccuacucugucuguccugacaacccaucuaaacaucaguuaggauuaguuaucacuuccuguaggaaaccuuuucuaaaccucuaaaugugggugguuuccccucuugauacucucauagcauccuguacuucuucucucaguggcacaacaacaugauaaaugguauuuccuuguucuaagccccauacccuaugaggucugcuagggcaggagaccauccaugucugucucacacaucucgguauuucuaauguuaucuguccuaaccugcaacaaaaaguacuuauuucuacucaauggcaacuccuggcauguuuaccugguagaugugaguuucacuaguggcaucaacuguuucauguagcuuuggcauguacacuuuaauaucuuucccaccaaaggcgcgacagcacucugccagaucuugacuggccucuggugggccauggacgaugaucaacugucgugguuucaucugauuaaugauuuuuuuaauggaauccccaucagagcguccuucauagucuauguagguaacccgggcucuguaauuagauaugauuauucaagauuacuuuucucauaauucuaaaaaaaaauggcuuuuaucauguauacaauauauaacacuaggauuugagaaauacacauguuauaguaucuguaugauuuauuuuauuuuuguuuuuauuuuucugagauugggucucgcucuuuugcccaggcuagagugcaguagcaugaucuucgcucauugcaaccucuaccucccagguucaagugauucuccugacucagccucccaaguaacugggauuauaggcaugcaccaccacgcagggauaauuuugcauuuucaguagagaugagauuucaccauguuggccaggcuggucucaaacuccugaucucgagugaucagccuaucucggccuaccaaagugcugggauuacaggcaucagccaccgugcccggcccuaucuguauuauuuagauuuuaucuacacccaaaaauauauacuaaaugauauuacuggacaaauaaaaaacuuuguucucugaugacuuaaaagaaauuccaaaaugaucacuuacugguauuauuuaacuaaguagaaagcgggagaaaaaagguuucuaacuacuucagaucacaacaguauuuuccagacauuagggucuuagagauguuuaaguuaaggaguauauuuuaugaaacaagcaguuacucagaaaaauuaaacugugagucacauuauucccuuucaccugcuuacagaauaaaaaggccaaaaauaauuuuucuucauauaaauguacaauuuaauguuacaauuuaagcaccccccaccaccaccaauucaauuacuuuggcauucaaauaccauuaaugaagagaaaauaucaugccaccauacuucacaagucucuucauacaaaaauaaauuuuaaaagcacaaacuuacuaaagaauauucagaaauuuugcuugacauaauguaaauuauauaauucaaaugcuugaaauuuuaucuuauaaucuauuuucaaaaugucacaaaagcacuuacuuuauuucaauagacucuguuguagaaauacauuuaguaggaacaucagauaaauccugauccauagguucaucuccauuugucaaaccagauucuaauuugcuuuuuucuucuucaguagcuugaagcucuggcacuaagaaauccucuggucuaaauaauaagucucuaauuagaagcaguaaaaagcaagcuaauacuacauaacauauaugacuaguagguggcauaauuuuuggaguccucacauaucucaagauuuaaauauacauuucauccaaagcugaugcaauuucauaucaauuaccagauggcuguauguauugcguuuuuugguuuuuuuugagguagagucucccucugucacccaggcuggagugugguggcgccaucucggcucacugcaaccuccgccucccuguucaagcaauucucugccucagcccccagaguagcuaggauuacaggugccugccaucacgcccggcuaauuuuuuuguauuuuuaguggagaugugguuucaccaucuuggccaggcugguccugaacuccugaccucaugauccaccugccucggccucccaaagugcugggauuacaggcgugagccaccacaccuggccuguaucauguuuuucuuuuuuuauuuuccacacaggauaguaguguuuucaaauuugcaauuacaacaugugauugcaguuguuuuucuaauagucaguauagauuuuguagauuuuuccaugauuucacucaugcuaucucacauuccucuuaaucucauaaaacuuguauaauacuuaagacauaauccauuggaaaugcaaucaccagccauccaaaguucuuuuuuuuuuuuuaaagauagagaugggggucucacuauauugccugggcuggucucaaacuccugagcucaagugauccucccaucucggccucccaaaguguugggauuacaggcaugagccaccacacacagccccaaaguucuuccuauccuacaucuuccucucuuuuuaagugggggaaaaaagucuugaucacgugaucauguuuuuaaaccuuuacacaacuaagucauaaacugccaguuuucucucaauauucucuagauguuucucagcaucucuauuuuuauguuucaaguuacaagucuucugugucuucaggcugagguacucagaagcuaaccccauacaugugacuagaaagaucaagugaaagaucaaauucacugaaaugaaaugauaacacaguuaauaccuccaauuuguaagagagaaaaguuuguuuugcucacauacuugauaaucucuccauauucaucccauuuaauucuuucuucuggggcaggaaacauaggauaggacuuuuuugccuguuugaaaaaacuuccuuuacgacugccuucaccuuucaucaucaagucaugcuucgucuuaugagcugauggcuggucaauaucuuccucaauaucacucucaucacuggaaucuauaucugcccuaggaggauuuuagaauagaucaaggucauaaaguuucaaagauauuuuaaauuaauauuuaucaauuuauuacugaauccauacucaauauuauuaauucaauauuaaaugauaauauacaguuaugucggucaacaacaauagaccacauauacaacagaggucccauaagauuacuguaccuuuucuauguuuagauacauuuagauacacaaauacuuaacauuguguuacaauggccuacaguauucaguacaguaacaugcuguacagguuuguagccuaggaacaaugggccauaucauauacucuggauacacaguaggcuauaccaucaagguuuguguaaacauauauccuaauguuugcacaaugacuaaauccccuaacgacacuuuucucagaacuguccccaucauuaagugaugcaugacuggaauaacauucaacuuuauuggacugacauuuuauaaaacauaacaaauaaaugcauaauaauauuagcacugacaggaucugguauucuagacauuugaaagaugucuguaacaaaauuaagucuuacgaaaauuuaaaaauauuuucaaugaaacauuuaagucaaggacacauucuucucaaauugcauccauaaauuuauaaucugucugaaaaugacucacucuuuugacugcucaagcuuuuuggcagcuucuuucuuuaguuucucuuuuuccaaguauucuucaaguucuuucccuucaagcuucacacguuuccucaacuaaaaaaaaauaaaagacaaaaggaaauguuaauauguuaauauuaggggguuaaagcagugggauaugagauacaucacaucucuaaauugcucuaucaucuuuaaacugauuguuuccucugaaauuaaucaaguuuccauuacauacaauuauagguccuauuuagauuaguauuaaaauugagcugucacacaucaucuagaauggguuuaauuuaaaucaaacugguuggccaggcacaguagcucacaccuauaauccuagcacugugggaggacugcuugaggccaggaguucaagaccagccugggcaacauagguugacucugucucuaggaauaauuuaaaaauuagcugggaggcugggcacgguggcucacaccuauaauccuagcacuuugcaaggcaggaaaaucacuugaguuugagacuagccugggcaacauaaugagacuuugucuccacauaaaaaaaaaaaaaaaaaaaagccaggagugguggcaugugccuguuguccccgcuacucaggugguuaaaguggaagaucacuugagccugggaggucaaggcugcagugagcugugcucacaccacuguacuccagccugggugacaaagcaauacucugucucagaaaaaaaaaaaaaaaagccaguagugguagcaugcaccuguagucccagcuacucagagacugaguaucacuugagucugagacugaggaucacuucagucugacagagcaagacccugucucaaucaaccaaacaaucaaacugguuaaaaaucaccaaucaggaaaagaaaauacagauaagcauuuuuauaauuuggaguaggugaggcccaaaagccauaaugggaaacauaaauaaauacagcaacaugaauaaagaaaaacucccuuugacauuuuaaaucucaaaauaagaaacugaaaagaaaaacaaaaaagaaacagaaaaauauuuucagcacuacgaccaauaaaaaugauuuuuuccuaagagcucuuccaaauuaguuaagaaaaggaugaucaacacaugaaaaagcacaagauacuuaaaaaggcaauuuacaaaauaagaaagacaaauaacuacuggccaugaaaagauccuuaauuuuacuaauuuuugaaaagcacaaaauauaaaaaacauaauuguuuucaucuaugagauuggcaaugccauacauggggaaagaguaccuucuuccauuaucuguuggaaaauuagugcaacuauguuaaaaggcaauuugcuaacaucuaaaaauaaaauuugacauuugacacaguauuucuacuucuaggaauuuauccuacugaaacaaucacaaauguguaaaaaaaaaguacauucguacauugcagcaaugcuuauaguaguaaaaaacuggacaaaauuuuaaaauccaucaaaauggaaugauuaaaucaguaguucucauauauuuaucucaggacuaccuuagacuccuaaaaauuagagaaccccaaagagcuuuuuguuuuuguggguuauauuuaucaaugucuaccuuaucagaaauuaaaacugagcaauuuuuaaaauauuuaucuguucauuuaaaaaauaauaaaaccagcagggcaugguggcuuauaccuguaauccuaguacuuugggaggucgaggcaggcagaucaccuaaggucaggaguccgagaccagccuggccaacauggugaaaccccgucucuacuauaaauauaaaaaguagccaggcaugguggcacaugccuguaaucccaguuacccaggaagcugaggcaggagaaucgcuggaaccugggaggcggaaacugcagugagccauaaucgcaccauuacacuccagcuuggacaacagagugagacuccagcucaaaaauaaauaaauuaauaauaauaauaggccgggcgcgacggcucacaccuguaaucccagcacugugggaggucgaggcgggcagaucaccuaaggucgggaauucgagacaagccugaucaauauggagaaagcccaucucuacuaaaaauacaaaauuagccgggcgugauggcacaugccuguaaucucagcuacuagggaggcugaggcaggagaaucacuugaaccugggaggcggagguugcagugagccgagauggcaccauugcgcuccagccugggcaacaagagcgaaacuacaucucaaaaaugaaaaaauaauaauaaauaaauaauaaauaaaaccacauggcaacauuaacagauuuuuacaaaaaauaauuacauuuuccaaagcaaaaaaaagauagugggaagaacggcauuuuuuuuuuuuuuuuugagacagggucuugcuccauugcccaggcuggagugcaguggugcaauuauagcucacugcagcucaaucuuccagccucaagcgauccucccacuucagccauccaccacucccagcuaauuuuuguauuuuuuuuguagagaccgagucuugacaugcugcccaagcuggucucaaacuccuggagucaagcaaucugcccuccucagccucucaaagugcugggauuacagucaugagccaccgcaccuggccuauagcauuauucuauauuuuugcaaaucucuuuaaugucuagcucaacagaagacagcuggauucucacauuugcuucuccauucagucucuugcaauauguuguuuugguuaaaguauaugaagaaaauccaggcuuauacgcauguauaguugaaaagggaaaaauauguaaauaguccuuucauggauauuauucuuugauacuacauuaaaacucagaaagugguaguuucuucaagguuaguuuuaacgcagaaccugaaaccauacuaauagacuuuuuauacucuguuguguuaauuuuuuuuuuuuuuuauguaucuuacacucuuguuuuuuguuuuguuuuguuuuguuuuugagacagggucucacucuguugccuacgaugagugcaguggcaugaucacugcucacugcagccucgaacucccagguucaagcaacccuucuaccucccagccuccugaauagcugcgaccacagaugugcaccaccaugcccagcugauuuuuaauuuuuuguagagacaaggucucgcuauguuauccagacuagucuugaacuccugaacugaagccauccuccugccucugccucccaaagugcugggauuacaggugugagccacugugcccagccuguauuuuaaauuuugaauggaucuuuuaauuugugcauuauuuucuaacauaauuaauugguuauuuggaaaauacuaguucaccaaguuauccagaucuuacaaauguugacaauauuuuuaaaaucacauuuguaaauaucaccaccaaucuuaucagaagucuuuucaguuuaaguugucaaucucacagugcuggguauaaguuuuccaaaauucuaaauuuucauuugaaaauuagaauuuuaucagauuuaagccaacaaaugcugucaauuguuuucuuuagagugacaggcucaauguauuaauuuucaagaaaaugucugccaaauacccaaaucugaauaacccugucauuauuucacauaaaaaugguguuccagacugggcacagugauucaugccuguaauucuagcacuuugggagucggaggugagaggauugcuugaggccaguucgagaccauaugggcagcguagcaagacccagucucuacaaaaaagaauuaaaaauuacagguguggugaaacacacccguaguccuagcugguaggaaggcugaggcaggagggucacaugaacgcagaaguucaaggauguggugagccaugauugugccucugcacuccaaccugggcaacagagacccaaacucaaaaaaaaaaaacacacacacaaaacagggccuggugcggugacucgcgccuguaaucccaacacuuugggaggccgaggcagguggaucgccugaggucaggaguucgagaccagccuggccaacauagugaaaccccaucucuacuaaaaauaugaaaaaaaaaaauuagcugggcaacguggcacacaccuguagucccagcuacuugggaggcugaggcaggagaaucgcuugaacccgggaaguagagguugcagugagccgagcgcuccagccuggcgacagagcaaggcuccgucucaaacacaagaaaaaaaaaauaccaacaaaaaaaagguguucccagaaaaaaguggcuaguuuaacucacgacucaaauaaacauacaaguguuuuucuuggagauagccauuguacuuuaguacacaacgcaaauucuuuauuaauacuucccaucuugucacccaaauuauuuuaaaaaaucuuuuacuaggccaggcgcagugacucaugccugugaucccagcacuuugggaugcugaggcagacggaucacaaagucaggagaucaagaccauccugguuaacauggugaaacaaugucucuacuaaaacuacaaaaaaucagccaggcgugguggcacacaccuguagucccagcuacucaggaggcugaagcaggagaaucacuugaaccugggaggcggagguugcagugagccgagaucguaccacugcacuccagccuagacgacagagcaagacccaucucaaaaaaaaacaaaaaaacuuuuacugaaagaacuuaguaauauuaguaacuuuuacuauucccucaaggacuuuuuuuucuuuuuuguagagacagggucucgcuaugcugcccagacuggucucaaacuccuggccucaagcaauccucucaccucagccucccaaagugcugggauuacaagcaugagccaguaugucuggccccucaaagacauucucuuucaaauuucuuuuguuuaauauaccuuuauacuucguagaggcagaguguugcuguugcccaggcuggucugaaacuccuggccucaggugaaccucccaucuuagccucgcaaaguguuaggaauaggcaugggccaugacgcccagccucucaaggacauucuuaagugaaacuagcauuuuuuuuuuaaugacguguauguacgguggugaaaaaugcaguggcuacuaguggaguuuuaggccaagguguaagcacuuuaugcaccacugaucuuacucaucaguacaaauguaggcacagugaaaaggcaaauaucaucuuaccaguauuaugaaaaauaguuuuggcuuuguggacucccugaaagggucucagggacucccaggcguccucaaaccacacuuuugagaaccacgagauuaaauaaucacagcacacauauacaauguacuauuauaaaauuacuaaaaagcuuacauuuauuuauccaaaaacauuuaaauguuuguaauauaccagguacuauguaagguagacccauaucuucuuacauuguucaagaaggacucaagugaaaauacaagucucaggguauguggaauacaugauaauuuggucccaucucucucucucuacauauauauauauacauuucuuucuuuuuuuuuuuuuuuugagaagaggccuugcuauaucgcccaggcuugccuuaaacuccuaggcucaagcaauccucuugccucaauagcugggacuacagccacaugccaccacaccuugcucccaucucuuuaaaaaaauaaaauaaaaaccagguauuaguauaucaauaagaaaaaaaaaacccagaauauauaugcuucaaaaaugucaacaguuaugacaauuaaaugcaguauguagucauggaugcgaaccuggacaaaaaaggaaaggguaauuauaaaggacauuguggucaucgguaaaaggugaaugcugaauggggucaaugggugaaaugguaggaugguaucaauguugauuuccugauuucaauggauguaacacaguuuugcuggagauugcccuuguuuuuagguaacacacacuggcaauauuuagagauaaugauaaaauauuugcaauuuuucuucaaaugguucagaaaaaguaauauuguguuuauguguauauaagugauaaagcaaauccaguaaaauguugacaauuggggaaucuggguauaauauuuuuguaacuuuccuguuugaaauuuuuucaaaauuaaaaguaauggaaaagggggaaucucucugaaacuauucuaguucaggggcugcccagugggguaaggggaggggagacaaguaaaaacaaaaaaauuaaaccaaaaucagauuauuuucauguauaaaauaaaugggugauuuacauguuuaaggccaggagcaguggcucacaccuauaauacccacacuuugggaggccaaggugggagaauuguuugaggccaguaguucaagaccagcuugggcaacacagcaaguucccaucucuauaaauuuuuuuuuaaauuagcugggcauggcggcacaugccugcagugcgaacuaauugggaggcuuaagcaggaggcgcgcuugagcccaagaguucaagacugcagugagcuaugaucaugcaacugcacuccagccugggugacagggaaugacaugacccugucucaaaaaauaaaaaguuaaaauaaacaaauaaauacauguuuauauuuggcaucucacauuugccuaauaacuuauuugaaaauaaguuucauucagaaaauaguggguuuuuuuuaaaaacaguuagcaaccuacauagaugccuuuuacccaccaauaaucuuuaacaaaguauuuaccucugugauuuaguuuaugccuguugcuauaauaaauuuuuaucuccaucuuauuuuucauuuaaaauauguaagauuaauggcuuauucagaaacagauuucuagaauaaccaacucaaaaauauuuuucuuccuacuccuucaccguauuaccuccaacuuacuccuuuuucuaauccaaaucuacuccaaccuauuaauccuucguuguucauuuuugcuuuuucuaaaugaguaagacuugacuuagaagggcauuagauauagaugaaaaaauaccauacuugguaaacuuuucuuaucuaacauaaucagaaaucuaguuuauuccauauucacuuuuuugauuauucaugaauucaaccagugcacucacugaagcccuccaauaugucaggcacaguucugggugcuagggauaccaaaaaacaagggccuuuuucucauggaauucauauucuaguugauggugggaagaggaagacaacaaaaaagaaauacaucagauggugaugagugcuaggaaaaauacuucaaguaaggugaugggcagcuaaaccaggcagguauuuuaaaucuguagucaaaggccuaccugaggggguuaaaccugaggccugaaugaccaggagccagccaugcgcaaagccaggaaagaacacuauaggcagaagaacagcuaguacaaagauccugaugcaccguagggcauagagaaaguggaauaagcuaaggucagaagguagguggggauuagaucauaugggaucuaagaagccuguguaaguagcauggauuuuauugaaagagaagaaggaaggcuuuggagccauuuaagcaagugaaugacaugaaaugaugaauguuuaaaagcucucucugggagcuguuauccaauagguacagaguuucaguuuugcuacaugaaaaaguuuuagagaucugucauacaacaauguacauauaguuaacacuacuguacuguacacauaaaaaugguuaagagagugaacuguauguguuuuuguuuguuuuuugagauggagucucgcucugucacccagguuggagugcaguggcgcgauccuggcucacugcaaucuccaccucucagguucaagcgauucuccugccucagccucccgaguagcugggauuacaggcgcccaccaccacgccaggcuaauuuuuuguauuuuuaguagagacaggguuucacuuuguuggccaggcuggucucgaacuccugaccucgugauccgcccaccucugccucccaaagugcugggauuacaggcgugagccaccacgcccagcccucuauuucuuuuuuuaccauuucuauuuuuuaccuuaguuggaucugcccaacaugccacagaaauauucuauuucucgaucaggguacaggcuagacaggugcauucaauuuuuguaaaaguucaucaugcuauacacuuaacguagguuuugguacauauuacgauucagugaacauuuuuuaaacuuccaaauuuuuggcuugaauaugugggaagugcugucugagauaagacagaacaguauugggaguaggggaagaauaaaaauuguuuuggaugugaucaaguagagggaaaacugcuagauaaugaagauaggagggauaacugcaaaagaacuaucgcuaagaaggugagcaagaaaaggucccugagcaucagcauuaguuauuaaaaaggucaaaaacuuaacauuugauguuuuggcuguuucucauuucuuuagcaugcuucuaaacaucauugucuauuuuuuuccaaacuuaaaccauuuuucuuuuacuaauuccucaaaugguuuauuagaccuaauugaauuucuaguaauuaaaauuuucaaauucaguauuuccuaucugaugaaauuguuucaaguauuucuuaguucuuuuaaccuuguauuucugagcuacuaaauaaccccaaagacaccauuuuacuuugcuauacuugcucagaauccuugcucaacaauucuauaauuauaguacauauaucucagauuuuaguuacugauguuaugauuuucuuaaguagaguuggcagacagauaucucuaccacauagcuuuuaacaaacuaaacuuuccuuaaaaugacugcuaagggccaggugcagugguucauguauaaucccagcacuuuggaagguggaguggguuagggggugguguagggacagcuugagccuaagaguuugaggguacagugagcuaugauggugccacugcacuccaggcugggugacagagugagagucugucucuaauuaaauaauuauaugagugcuacaaagacaaaaugagaagcagcuuuaugauacugcuuuauguuaagguuuguuacaguucuauguuaagguuuagucagcuaaaccuuuguacaacucuggcaguuauuaaccaucccacuauaucaauugcuacaaacuuuaaugauauacuaauuuugaaaaaucgauagauuugaugggcugguuauuaagcaaaugaucuuuggguauacugguuagugagcuaauagucuuguuccuauaacaagagauaaggcagcaaaugcagaugcagaaucaaguuaguacauuuagugguggaaagauaaaggaauuccugacucacugcuuugacuucuacauuaaguuugagacaagaucaugugcuaugaaugaaggcugagagugagcuguaggauguuugaggagaaagaagauauacaauuaccuuaccgugagaaagggaacauccuaccaaaugcugaguacugguaugggguccccuuuugagaugugaaguuaugaaugugaaaacaaaucugucuacaccauaauguuuaacuucagaaacauaaagcugcuuaaguacaggcacaaaccaagcaaaugguuuaacuaaggucaaagccuuuccaggcaacuaaaacagaaguguaggagaguuaaauguauuugcaaaauuuugcuuaauuguggaccacugaguuuaaggcuggaaggaugacagacuguaaaaggugagguucacgaacugaaagucccaauggaacagaagaguuguugucaugggaauaauagggaaagucagcuguaaauucagaaugauaugcuugagguggagaacuggagaccguucagccauaagaagguuacaggcaaugaccacaggagcagauagcaugauagcaggaauggaugucugagguaagacgaaggaaaagauuaagaaauaaggugccaaguaacugagaagaaccagacagaucauacacauggaugcuaaagucaaugagaauaaaguccugaacacaaguggacaggaagacugugaaucagggucaaaugaugaaugaguaacagaaugaccaagagaucauuaaaugucagaaacaaggaggggucagcauaucagcaggucugaaggcaaaaacugcaaauggaagauaaguagcuaggaagcugcaauacagaacaaggaagacguguacuccauucaaaguacaugaaacacugaaagaaagaguaauuacuucagggggcuacaggauaaagaacgucuuuaggaaagagucugauuuaaauuaagcaagagacaggaaaggaaccuuucacagauugagaaaacccuguauaugcuuacccucuggguaaacuagaggguaccacggaaaaguuuaagaaugagaauuucuuuugagaccacccauggcaacauaaugagacaacgucuuuccaaaaaauaaaaauaaaaaaauagccaggcaugguggcacaugucuaugguuccagcuacuuaggaggcugagggaggaggauccuuuaagcccaggaguuugaggcugcacggaacuaugauagcaccacugcacucuagacuagguaacaaagcaagaccccaucucaaagaagaaugagaaccuccaguuaaggaacucugaaauuugugcuauuaaaggcucucuuccacaguaguuuuuuuuuaagagauggggggugggucuuggcauguugcccaggcugaccucaaauuccugggcucgagugguccuuccgccucagccucccgaguagcuggcacuacagcacacaccaccacuccuggcucucaagaguaauucugauaaaaauccuaaaacaauuucaaguuuuauuuuuggucacuauuuuuuuacaucaugcacaauguaucccccaaacaguuuuaagauaaaguucacauacaagugcuuaccucuauuucuguaauuuuuucagaaggauuaucaauuaggaaacgugcuaaagucccaggaguaguucuguagguuagaaugauugaguuuuuaggguccugacaccacugaauaaagagaucccuugaaaauccgcauuccaggucagguuggcuggcaaguacaacuuuagggcuagguacacgggccaagucagaaagaccaugacauaaagagagauggcgaaacugaaacggauuauuucuuuugucuucaaaacaucucaucaauuuaucacucauccauucuaccuaacauggggggaaagaugacaagaauuagaaauacuauauuauaacuucaauauauucucuaauagucaaggaauucaaguucuaucuuuuacccccacugguugcuuaaauuuguacuguuuugacaagcagcuuauuuucugcuuccauuucccauuagauuaucccacccucacuuucaucccaaagaaaaccaauuuugcauuauauuucacauauaaaucaccuuaaaucuuuuugaaaaggcaagguauauguucuaaaugaaaaucuuacucccaaagauugcuauuucaaggcaaaaagcuuauuuaaaagaaagaacaaugaauucuaacaugccaaugcuaugagguagguucuauuuuuguccccauuuuacagacugggauacuaagaguuagaagggaagcaauuugccuaaucuuuaaaacagggacacaauggaaacuacuuaauagaauaaauagggauuaaauuaaauaauacauuuaaagcacacaggacaguaaaugguuaaugccaaguuaucaucuuauuaacaaucucuucaagagaaaaauaaaauccaaaaaacauuuaagacgcccacuuccacagacccaaucacuguagcaaacuuauuacaagugacaacaugagaacaaaccugggacuuagaaaacuccaccacauuguaacugacauuauuuaggagugccaaugaguaaacacccaauccugcaucuuuaguccuccaaaucugaucaagaaguugagcaaguuccaaaacucugccugcuguguccacugcuauuaacacauuuccaucaccucgaaguguuuccaggacauuugcuagaaaacaagaauguaaaauccccauagaacguaacaauacuaugcuacaaaauuaaagauaauuuuaucucccuguuuuuauuagaaagacuauaauuuacaaauaagcaacuacuaggccaaguacaaaaugaaggaauuuuguucaggucauuacaacugcuuuugauucuguugaauaucucuucauauauucagugucauuaacucucaaucuuucuucauuaaaaaauuauaaaucaguaguccucaacacuuuauacaucauaauacacauagaaaaugguguguguaucacugagaaaauuguaugaccaggccaaauguaaccagccugguguuuccgggcuacccuggucucgccuauccaccccagugaacuccguuaugaugaauucccaaauuuauauacauacauauauacacucacauaauuauauauacagccaucccucaguacccauggguacuggccccgggacucccacgaauaccaaaaccaucagaugcccaggucccucaaauaaaaugguggccaggcgcaauggcucacaccuguaaucccagcaguuugggaagucaaggcaagaggauggcuugaguccaggaguucaagaccagccuggacaacauagggagaucccgucucuauaaaaauaaacaaauuagccgggcaugguggcacaugccuguggucuuagcuaugugggaagcuagagggagacugcuugagcccaggaguuugaggcugcagagagucgugauugugccacuacacuccagcauguacaacagagaaagacuuugccucaaaaaaacaauauaucugcauauaaccuacguacauccuccuauauacuuuaaaucaucucuagauugcuuauaauaccuaauacaguguacaugcuauguaaaugguuguuacacuguuuuuuuuuacuuauauuuuuuaaacuauugcauuaucuucuuuuauuguuuuuucaaauauuuucaauccacaguuaguugaauccucagauguggaacagcagcuacaaaggccaacuauguaugauacauaguuuguauguauguaugccuauagaauaaaauauagaucauauucccuuccaacaaguauaucuuuauggauuuccuuccucuagaugaaaguccccuuggaaauaugugguaaaacugaacucuagcaaaacuaagacuuaaagagccgcuacuuuuuuuguuuuucaguuuguuuguuuguugagacagggucucgcucugucacccaggcuggagugcaguggugugaucauagcucacugcagccucaaccuccuggccucaagcaauccucccaccccagccucccaagcagcuggaacuacgggccuguaccaccacgucuggcaaaaauuuucuuuuuuuuuguagagauggggauugcggccaggcaugguggcucacaccuauaaucccagcacuuugggaggccaaggcaggcagaucaugaggucaagagaucgagaccauccuggccaacauggugaaaccccgucucuacuaaaaauacaaaaaauuagccgggcaugguugcacacgccuguaaucccagcuacucgggaggcugaggcaggagaaccaccugaacccaggagguggagguugcaaugagccgagaucgcgccacugcacuccagccuggcgacagagcgagacuacaucucaaaaaaaaaaaaaaaaagagaugggggucucacuauguuacccaggcuggucuugaacugcuggcuucaagccaucaucuugccucagccucccaaaguguugaccauugaccacaaugucaggcgugaaccacagugucuggcuugagcuucuuaaaguuggugcaacacgguauauuauuaauaguuacacuuuuaguggcagggcgcgguggcucacgccuguaaucccagcacuuugggaggccgaggugggcggaucacaaggucaagagaucaagaccauccuggccaacauggugaaaccccgucucuauuaaaaguacaaaaauuagcugggcguaguggcgcacaccuguaaucccagcuaccugggaggcugaggcaggagaaucacuugaacccgggaggcagagguugcagugaaccgggauugugccacuacacuccagccuggcgacagagcaagacuccaucucaaaaaaaaaaaaaaaaaaaaaauaguuguacuuuuaaaguagaugaacuaaaaacaaugguugaaaacauguuuaaaaauggaauccaauuuucccugcugaaaucccuuauagcuuauuuaaaaagaauauaaggccaggugcagugguuuacgccuguaaucccaacacuuugggaggcugaggcaggaggaucaccugaggucaggaguucaacaccagccuggccaacauggcgaaaccccaucuccacuaaaaauauaaaaauuagcugggcaugguggcgcaugccuguaaucccagcuacuugggaggcugaggcagaagaaucacuucaacccgggaagugaagguugcagugagccgagacugugccacugcacuccagccugggcaacagagcaagacaccaucucaaaaaaaaaaaaaaaaagaauguaagaugaagcaagcagcaauggccuacuauauuaaaguguaaaacacccaaaauuaguggaauauuuacagccucauuuauccacuuagcucuuuguucauuuuucuuuuuuuuuuugagacggagucucacucuguagcccaggcuggagugcaguggccagaucucagcucacugcaagcuccgccuuccggguuuacgccauucuccugccucagccuccugaguagcugggauuacaugcacccgccaccacgcccggcuaauuuuuuguauauuuaguagagacgggguuucaccguguuagccaggauggucucaaucuccugaccucaugauccgccugccucagccucccaaaguggugggauuacaggcgugagccacugcaccuggccucauuuuucuuuuagaguauauuuuucuaauagauuuguacgaggucuuuacauacagacauaugccagugagugccagggauagcuagcuauguacugacuggcaaaaagaagccaaucuuuacacacuguuccacaaaaguuaaauucaaaccagcuaaguuucuucuuauacaaaaacugauggucacauaauauuuuuuucaaaaauacuaaaguuaaccaaucucuuaugaccaagaaaagugcuaaacagaauacagucauucccacuaccaugcauuuccacagcuccuugaaaaggacauuauacauuggguacaacauucacgauucuggagacggauacaguaaaaggccaaacuucaccacugugcaacguaugcauuaagaaaccuauacuuguggccgggcgugguggcucaugccuguaaucccagcacuuugggaggccaaggcagguggaucaccugaggucagaaauucaagaccagccuggccaacauggagaaacccugucuccacuaaaaauacaaaaauuagcugggcgugguggugcacaccuguaaucccagcuacucgggaggcugaggcacaagaaucacuugaacccaggaggcggaaguuacagugagccgagaucgcgccacuucacuccagccugggugaaagagcgaaaguccgucucaaaaaaaaaaagaaaccuguacuuuuauguacuuauauucccuaaauauacaaaaaguuacaaaauaauaauaauaauaaggacgugaaagaauacguacucagaagcugcucaucucucuguuuucuucuaggcuguacauauguagcauugaaugaaucugugauaaguagggaaggccugcuuagcauuuccagggaacauccauuuaaauggcuauaagaaaguuuaagaagaggaauauuuuauaucauuucaaguaaacaauaauagcuucucuuacuuaaaaaauaagcagcuucauuuauaagguguucccuccucuaacuauaaaaguagacaugcucauugauaagaaauccaguaacuucaaaaaaguauaaagaagaaaauaaaaaucuuccagaguaccauuacucagagauaacugacauaauauuuugguguacauccugcuaaccauauaaguuuuucuaugcacauauguauuuuuuuuauuuuucuuuuugcccugucuuaugguaaguacugauauacauauguauuuuacaaagcugauaucccauauacauuccuauacgcucaguucuauauccugguuuuuacccaggacauaaaaauuuuuuucuaaacuaaauguuuaacaguuauaaaaacauuuuauugugucuacacuguauuugauccuuucccuuuacugauauuucggucacuuauuuuugccauuauaaucuuccaaagaacauuuuuuacaaaagcuucaauugcauuucugauuguuucuuuaggucacauuccuaaaaauguauuuacuguuaauacauaguacugcuaaaaggcuuuccagcaagauuuaaccucauccagaaaaguucaaucaaaaagacugaccaauucuacauacuucccagaagaaaaucaccauuuaaaaauaauuuuggacuagugcaguggcucaugccuguaaucccaacacuuugggagacagaggugggcagaucacuggagcccaguaguucaagaccagccugggcagcauggcaaaaccucaucucuacuaaaauuacaaaaauagccaggcauguuagagcgcaccuguaguccuagcuacuugggaggcuaaaaugggaagauugcuugaagcugggaggucgacacuacagugagccgugauugugccuccagccucggugacagagugagacucuguuucaaaaaaauacauaaaaauauaaauaagaauaauaauaauuuuaaugguaucuaacaaaaaaagaucauuuaaauuuucucuuuugacuuuauaacuuuuguccaucuugcaacugguauauuuuuauuaauaaauuaauacuugaucuuauauauauguuguaaguuuuugggcaacuugcugcaaauauuuuccuacuuugauuuuuuuuuuuauuuguuguuucagacauuugaaccuguaugucaucaaaucuaucaaacuuuuacuuuguaacuugguucauuauuuuuaugcuuacaaagucuuuuccaaaucagagaucagacucaccaauauugcuucauuucuauuuaguucuaauccaucugaaauuucuuuuguuauauaauuaaaaggacacaaauugauuuuuuuccaaaaugguugaauccuucaauaccauuuacucaaauagccaugcugcaguuugccacgguuacuacgagacugaacgaaggaggacgaaugcagaaaugaaaacuuaaaacaaaaguaacuauuuuaaaggaaggggucaggagaagaagaagagagcucccugcuucuagugagcaaagggagcugccuucagcuucuacagcccuucauauuuauuggguagaaagagcagggaggacgagguaacaauuggucagcugcuuaauugaucacagguucacauuacugcuaacaggcuucagaugugucuaaucacaagaaacaccugcaccugaggccugacugcccucagcauuccuucuggguggcagacacaguuugucaguuugccaauuuucugcguuuaugcgaacaguuugcuguuuacucauauagccuccagugguauacugaguugaucacgacccucacucuuuugcccugcaacauagccauccuuuccucauuaaucuaugguuauaagugucuaaaauucagucuauuugucuuaaauauuucuuaauauaaagauccugagacuauuguaauguaacacaaaauagcuaugaacuuaauguacagauaaaacaaaacgagccuguaagagacuaaacaccaaaauauuauauaguaaugcucugagugccacaugaaguguguaaaaucauaacuagaauugaguucccuuucaaagggacuaacuuuaaacauacagggcaguuauauuagaugguaauuacauuaugugcaaggcaacuccuguuucuaaaacuaucagaucucgugaaacccauucacuaucacaagaacagcacgggaaagacccaaccucauaauucaaucaucucccaccgggucccacccacaacaugugggaauuaugggagcuauaagaugagauuuggguggggacacagagccaaaccauaucacguuacaaaacaaaagaacaacccauccacaaaguuguguuaaauagcaggucaagaacauguaauuugauacguaaaaaauucaucuccuuugcaacaucuccagggagauacccguuuuguagaguguauacuuaaccuauaaauuuuuaaaaucucuuaugucuuauaccauacuuucccccuuacuaugcaaauaauuaauuuugaaaacacucccuauuugacgguuuuaaguugcucuaaauuucugguaaccaaaacaaaaacuguguuucuuauuuuuucuccaaagaauaaaauaauaccaauugcauugccuuuagcuuuucucuugauauaccuacaucucccucuugugguugaagucaacugcauaaacaauuucuucuucuccaucuuugacuauuuuccauauuguuccaccuaucauaugaccagcuggcagaggugugauagacaggccauguccuuuaccuaugucaacaagauaacaauacucagauuucuuuuacaacccuaaagaaagguuauuuauuucucaacuauaauauuuuaauagguaauacuguauaugcaauaauacaaauuucaaaaguaaaaaugcauauagugaaagcaggcuucacucuccugucccccaccuacuccacucccucacuagaggcaaacauucuuguuacuauauuauguaaucuuguagaguuauuugugcuuauaaguacaaggcuagagauuagauuuaaaagcuaguacacuauuaaauuauuuaguaugaacuagcaaauuuuaauguguauuuuguauauacaguuaccaaauguuuccauuuuugcuaacgucuaaacuaacagaauaauuuaaaucucauugugcuaaagaauuuauccugcagaaaaauuaacuagaagcaaaacuguugagacuguuguuauuucugggcuaaaucuucagaguccauuauugcaccauuuuaucaaugccaggguucauaucuaugaaaauaucuaauacaauuaucucuguagaugauaaauauagacuuaguauaggacuuccuaauucaauaauaaacuuuuuaacguccaaugcuagaauucauuaucuacucugcugccauagcacuucauuuaccccaaucacuacauuuagccaucucagcuacuuuguugccucaaucuaacuguaagcucugaggaagaggaaauggccacauuaucuuuuguuuauuguacacaguaaacacuaaaugaguuuuucccaaguuaaauaugaaaaggccugagcuauuaacauucuguuagcauuuuuucugaaauauuuuaaaauucaaauggaaguuaagaguucuguaucaaggcagaaugugcuaacuuuuuuauucuucagccuauaaugccuauaauuuucucucugaauucuccucgguauuuuccagcaaguuaaaccccauucaucuaaauacuuacuacuggaaauucuuuuuaccuuucaaauucacaaucugagagaauuuuagcugcuguauuuuaucaaaggcugcauccacaucaucuaauguaaagaguguaaaaucuucuguauugugucgagacuaaaagaauaacacaaauaaaggugaaaaacaaucacugaaggagugcuaacaaaauuuuuuuaauugcuuaaauuaccugauaaagaucauacaugaacaucugucccauuuuauaaacaggaaugguugcauagauagcacaguucagacccaacuuuccgacagcauacgggagggcaccaagguggagaggaucagggugagacaacagcacugcaucaaucuggugaacaugccuacaagaacacaauccaaaggacuacuucuugaaucuuuuuaaggguaaagacagaauauucaaaauuauucaccaauucuggauugaagacuacacuggggcagaagagcaaaacuaagagcuaaaauuaugauuaccuaugaauuucaauuauuacuaccugugcucuccauagcuacaaaaaaugugguauaagguacacuuaaauauaugguguguacacacauuuuaaacagaaaagaaggccaugugugauggcacacaccuguaaucccagcacuuagggaggccaaggcaggcaaaucguuugagcucaggaguucaagaucagccugggcaacauggcaaaacaccguucucuauaaaaaauacaaaaaaaaaaaaaagccaggggugguggcaugagccuguagucccagcuacuugaggggugacaugggaggaucacuugggcacaggagguugaccuugaugagaucaugccacugcacuccagucugggugacagagugagacccugccuaaaaauaaaaacaagaacaaaaacaaaaaagaacaguagacacaaguaacuugauuuucuuuuuuuagauggaguuuugcucuuguugcccaggcuggagugcaaugacgcaaucuccggcucaccacaaccucugccucccagguucaagcgauucuccugccucagccucccgaguagcugggauuacaggcaugugccaccacucccagcuuauuuuguauuuuugguagagaugggguuucucuauguugguuaggguggucucgaacucccaaccucaggugauccgcccaccucggccucccaaagugcugagauuacaggggugagccaccacgcccggccauaaguugauuuuuaauagcuauccugcauacuauuuuuuuucuuuuggagauguagucucgcucuguugcccaggcuggagugcacuggcgcaaccucggcucacugcgaccuccaccgcccgguucaagcaacucuccugccucagccuccugaguagcugggauuacaggugucuaccaccacaccuggcuaauuuuuuuauuuuuaguagagacacacuuucaccauguuggccaggcuggucuuaaacuccugaccucaggugaucugcccuccuccaccucccaaagugcugggauugcaggcaugagccaccgcacccagccucacuuaacucuuuuuguuuuuuuuguuuuuuuuuugagacggaguuucacucuuguugcccaagcucuaaugcaauggugcgaucuuggcucacugcaaccuccgccucccagguucaagugauucuccugccucagccuccugaguagcugggauuacaggcaugcaccaccaugccuggcuaaucuuuguaauuuuaguagagaugggguuucaccaucuuggucaggcuggucucgaacuccugaccucaagugaucugcccgccucggccucccaaagugcugggauuaccggcauuagccacugugccuggucgcaaacuauuaauuuaaguucaagaacucagcuuagaauuucagaaauuauuauuggcugggcauggugguucaggccuguaaucccagcacuuugggaggccgagguagguggaucgccugaggucaggaguucgggaccagucuggcuaauauggugaaacccuguuucuacuaaaaauacaaaaacuuagccggccggguggugcaugccuguaaucucagcuacuugggaggcugaggaaggagaauaacuugaacccuggaggcggaaguugcagugagccaaaagcacgccauugcacuccagcuugggcaacagaagugaaacuccaucucaaaaaaaaauaauaauaaaagagaagaauuucagaaauuauuaaggagaggauauuuauauggccacauacuuauaauggauuuuugucccagcuuuuucgcauaguaaccacagacaguuuugcuaauugaauaguaaaacuucaguuaaucagggaagcauauguucucaucaacacaagaaauuaauaaaaugguuuggauuuuuuuucucaaguucuaaaguuuuuuaaauauuuaaguccucuuuucuugcaaaauuaguauaauacugcaaacaucauugacuuuuuauuuuaucuuauuuuuuuuuugaaacagagucuugcuuugcgcccaggcuggaguguagugguacgaucucggcucagugcaaucucugccuccuggguucaagcaauucuccugccucagccucccaaguagcugggauuauaggugcacaccaucacacccggcuaauuuuuguauuuuuaguagaguuggaguuucaccauguuggccaggcuggucucgaacuccugaacucaagugaucugcccaccucagccuccuaaaguacugggauugccagcgugagccacugugcccagcccauaauugauuuuuuuuuugaugaaucaguaucucauggucauucugagaaccagcugacaauguuaagcaucaaaagauguagaaaguaagcuaaugugaucugaccacagaacuuucacauggaaaauguuuccucuucucaaauucuuauguauucuuguucuuuccaaaaauuagcaugcaaaaguuucuacugaaauccauuagcuuaagauuuugcugaauuucaacaagcaaagcuuauaagucaaucaaaacuuuacaaguuaaaaugucacuauagguuuuuggcauaaguaaaauuaagccuuuugcuauaaacuaguguaaaaaggcaguauuuaucacaucgaaaugguauuacaguacagaaaagagaaguugauuuaauaaaaacauagaauuaugaaauguaacuuacuuccucagggaaucaauaauauccauagaaaagugcucaucccagccacaguccaauaaaaaucuaaacucaucaacuuggagaagauagcaaagggcagauucuucuuggaccccagaaaggguaguuaauuugauaauagacgucauuuuuuuugguccagaaacagcaagcuagaagagucuuucaaaugaaaugaaaacauaauuaaacauaaaagcacagucuggcauauauaauaaacaaauugauuaaaauuauuucaaaucuuuaagugcauagaaauuccauuaacacgaaaagcaguuuaaaggcccauuuccaucauugccaaguuuacuuuuuuuuuuuaagugaaagcaaguuuauuaagucacugccaaguuuaaaagcacaaagauaaucuuagacacaaugagcccuuuaguggcucccuagugggguagugaauguugcaaucaaauagacccauauaugaaucuacuucuaugugauuugaagcaaguuaauuaaacuuuccucaccuauguaucucagucuauaaaacauuaguauuaguauacauguaaaaacaauguugaaguauuucaaauaauguauaaauuaccuauaacagauacuacugcauccaaguuccucaauaaauaaauguuuaggaauuaaugaacucauccuucaaggugaaucucuuccucuuuuaucuugcuuugugauggcacugauuucacuguauuacaaugauuaguuuacaugucuuucucucccauuaauuagaccagugguccuuaaauagauccccuugagaaucugauaaaaaccuauggacccucccccucccccaccaacucucaacacacucaaacaaaaaacaagaguacauauacacguagaaauucacaaacuuuucagggaguuuaacauuaagaacccuugcauuggaaugugagcaacugaaaaacauagguggcauauguuugcaacucccuaaauagaaccugaugcacgcuucaacauauaucugaugaaaugcaaauugggaugccuacuacauauauuucaggaaaauauaacaugaacacaucuacaggccaggcacgguggcucacgccugugaucccagcacuuugggaagccgaggcaggaagacugcuagaguucaggaguuugagaccagccuaggcaauguagugagacccugucucuacaaaaaaaaaauauaagaaaacuggcugguggcauguaccuguaguccuagcuacucagaaggccaagaugagagaauugcuugagcccaggaguccgagguuacugugagcuaugagugcgccacuagacugggcacagagugagacccuagaguguacccuagacugggcaacaaagugagacuuuguaucuaaaaaauaaauaaaauaaaauauauacauuuuuuaaaaaugggauuuagaaccuggaacugugugcuauuaagcagaaguuaugaaaauauucauuagcaaaguucaacuccacagcaacauuucagauuuuagcucccuaaaauaaaugagcuuuuccuggcuaacuaugcaaguaggagagaaggccaccgaguuaccuaauaauuucuuaccacuacucaaggccaucaacaaacuaagguaaacugaauauccaccuuucauaagaggcugacaggggcugcuaaacccaccacaucucccagccuuguuuaucugagugacagccaaaaucacaagacugcuagguuaucaauuaucaacgauguguacgucucccaguaagaccuaauccccuaccucuucucccucucaaauccuuucaggaugcucucuggaacugugaucauacucaccuguaacugcaacugcuucucugaaaauucucuucaccugcuugucuucccagguaccuggcuguucccucaucauacucuuccucuuacggccuucucaagguuuuuuguuguuguuguuuuaacuucuuguacccccuguacuugaaaagcaggagguauguguuccuugcuccucacugcagcuucuaaaccaugucuucucuuuccucuuucaaauagucuagucccauuaaagcucuugccacccagcaguucacuauuagucuuccacauuuccucuucacuauggcaucuauucaccuggccucauucacugaggacuuuuacaugacccguuguuccucucaguaacuucaauacugaccuguugguuccuugacuuccucaacuccaauaaucauuucacuucagccacccaccacuacgauuacacccuagaccuuaucacuaccaguaacuguucuacuuucaaaauuucacuucaagcaucucauucucuaacaccuuacuuacucuaguauucccauugcaaaaauccucuggggucagugguaucucucuaauucgcugacuacuuuuucccuauccaugacccccuccuguuuuuacucagguccucaccuucaauucaugaucuguuaacauuauuugcaaacacucaaaugucuugcuccucuagguacuucucucuacuaggcuggcaaaaccccaguccugauuaacuccaaucaugcagggccggcggggggaugggauauggaggagaauuacagcugugcuauuugcuuuuuuuugagacggagucucacucuguugccaggcuggagugcagugucacgaucuuggcucacugccaccuccaucucccggguucaagugauucuccugccucagccaccugaguagcugggacuacaggcaugcaccaccacgcccagcuaauucuuuuugguagagacggaguuucaccauguuggccacaauagucucgaucucuugaccucaugauccaccuggcccauuuuuuuucuuuuuuuuuugagacagaguuucacucuugucacccaggcugguauacaguggcaagaucucagcucacugcaaccuccaccuccuggguucaaguauuucuccugccucagccucccgaguagcugggauuacaggcaccugccaccacaccuggcuaacgcuauuugcucuuuaaauucauggccaaaggccucaaacaggccguaaguauuacccuucaaucugacuuuucuuaguagguugacuuucaguuucugagacuacuacuccacaccuccuccucuuuguucaaagaucacccaucccucccuccacccuagucucagcugauaaucucauuucauucuucaaucagaaaauaaaauuagacaauaauuucucauuuuccagauacuacaucuauuaaccuaucugcauguacacuguugggucuccuguuguauagaauaguccugcucccauccaaggccaaucccucuaugugugccguugaucccauucuuauucaccuucugaaagacuugacaucuucagucauucgcucuuuccccugcaucaacguaucacugauguaccauucccacaagcuuauaaaaauacucuagaauuucccaacuuauaagaacccucucuuaacccuucaacccccaacaaccacuacaucauuuuuggguuucccuuucacagcaaaaguucucagaauauuuguccacagauauaucuccacuuccucaccucccauuugcacuaagucugagaagccagagaaauguccauuggcuuaaguuguauagagguuuaucaaugaccuuuauaaaacacuuccagugauauacuuucauaacaacucauuauauuucucaaauuuucuucucucuucacugugaccaaaaccucuaacuuuuauauauauuuucccugucucuaauuuauucugagucauucucagagguagucauucucugaccacccuaaaguccuucuucacauccauuacaacaucauucuauuucccucaaaauacuuagugcucucuaauugcuacuuauuuauuuacuugcuuugucugucaccuucuccccuccugugcccacacuggaaugcagacuccaugaagguaaagaccuucucuguuuucaucacaguuacauuccagcgccuccacagugccuaauauacagugguagccgauaaauguuucuuaaaggaaggaauggggcauggcuaguauuaaauaagcucacuguccuuaccacaccauaaaccagaacccauccacauguauuugcccuugcuugggagagcucucugaguacaggaguuggcuugauccauuuuuuuauccuuaguacauuagcacaucccugcacauagugguuguucaauaaauaacuguugguaaguuaaaauuuaaaauauauugacuuguuuuuguuuccugaaacaggaucuugcucugguacccaggcuggagugcaguggugcaaucauggcucauuugcagcuucaaccuccugggcucaagugauccucccaccucagccuccuggguagcugggacuacgggcacgcaccaccacacucggcuaauuuuuuguagagacaggguuucacuauguugcccaggcuggucuuuaacuccugggcucaagugauccacccaccuuggccuccccaaaugcuggaauuacaggugugagacagcacgccuggccuucauguguucuuauuugggguacaaagacauuaauucucuauuugaugaaaaacguuuauaaauacaauuuuggaaaggaccuuggaaauuaucccugucaaaaagcuuacuguaccacaauuauauuaauggccuaagggaaacucuuuucuacuuaagucuuccuuaauucccacuuucuucauuuagauuaugaaguaacaugcaagguaucuugcagcuagaacugaguaaguucauauuaaaacuguuuugcagacagaccaagauuucaacagaugaaaagauauuuucacuacaauuauucauaauaaagcuauaucuuuaucaaacauucacuacuuacugauaucuuagucguauauaugaugaaacaccaggaauucugaagaguucuuuauuaaucuaaaaaauaaauaaaagccuuaugaaugugguauuaugauuucauucuguuuauaauuaugguguuuaauuuguaucuugcccuaaggcaucaggagcagcagcaaguaguauaauacgugguccuuuuuuaaaaaagagaucugucauuaauuuuaggaaucuuaagcuuacauaacagauaauaaaagacauaaaaauauuuaggaaguuuuuuuuuaaguugacauuaccuuauguuauugagaaucauagaagaggugggauuuaagauuacucacuaaggauugguaagacauggguagaaacaaagagaagguacucaaaacagaggaguaacaggaguaaaggaauaccagacaucucagaucucuacacuuuugaguaaguuuuaaaguaccagugaaaaaacuagccuggaaaacauucacaaaagcaaaaaauaaaagauaaggccuaaugaacagaaaggggccagauagugaaaggccuuggaaacugugaaccuaguccugcaggcaacagaaacauuuuaagacucauuaucaaguagaaagauggcaugauacagguaauucuguauuuuggggauauuagcugguguguaugauugaugagaugauacagaaagcagggagauaaaaagcgaaaguauuuaguggaccaccccuuccuaacguuacugauucuaucuugugaccaaauuucuucagucucaaauuguauuuuauagcucugcgacaugaauauauuaguuguuaucuaaguaaccaagguuugaaaugcuacaugcugauucuucacuucugggacagucuauuauuaccaguuccugauuauucuucccucaggaacgcuuugcacaucauucccuuucuaucccacugccaguacccuaauacaggaagggccucacuaccuuauguuuggguuucucaguuucucugccuccaguauuuccucccuucauccaaccuaaacauugcuaccagauucaucuucagaaauacccugcaccuauuaccccuugcucagaaaucucugaaggcuucuuacugcuugagaaaagacaaaccaaaugccuuaacuggcaauggagguugccaggaagccacccugacaucacugcucaaugucuucaggcccagcucauguuccaccuccuuacaaauucccacaucuagucuagacuagaacagcucugucaacagacauauaaugcgugccacaaauguacuuuuuaauuucuucauggccacauggaaaagugaaaaagaaacgggugaauuuuaaugaauuuuauuuaacccaauagaaccaaaauauuauuucaacauguaaucauguugaauauuuuacauuuucauauuaaaucuucaaaauccacuguguauuuuauauuuacagcacauuucaaauagacuaacgacaucugaagugcucaauagcuacauguggcuagugacuaccauaacagugcagaucuagacuccagaccauaaaaaccaaugcuuuacacuauagagcaucauguugucaccccuaaagugcagguuggcaccauccuauguuuauguacaugucucagacuaaguuuuaauaguauugccaaccauuuacucucccagacuaaaaacucaagucaccuucuuaccauuaacuuagcagucagcaggugaaucccauuugacauuuacuuagugucucucugaccuccuuuauguccugccuccauggaggcccucauugccuuaccugaaugauugcccauuuccuuucaucuaguuuuucuguucccaguugauccuccauauagcugucagagaccauccuaaaaaaacaaauauccuccugcucacuccuugcacaaaauauccacuggauuccugguaacuacugaaaaaaaucuaaacucccuauuggaaaccaagauccuucacaagcugaucuuaaccuaccucuugcuucaccaaucacucgugcacuaaaugcucaggcagguugauuaucccacucucccuaaguaugcuaaagcuucucaaagcucuguauuccuguacugaaucccgaaauuaccuucuccuuuugagcucagcaaauuccuuuugaugcuauaugacccagcucacauauuuacuccuuuauaaagccuuuuuguugcccuaggcaaaguuaguuauuuuguuauaaaggaggcacauaaaguauuuguugaauggauguucaauguauagaggaguaaaagugaucaucuuuguauauccaauaccaacuucaguggucaaggcagcauaaauggguacugcaagaaggaaugaagccucaucauaucauaaauuccuucagagcacugguuuugacagauacuacuucaucgcaaauaucucacaguuacuugcccucuuaauaauaaucgugcauguugccgggcgcaguggcuugcgccuuuaaucucaacacuuugggaggccgaggagggcagaucacuugagcucaggaguuccagaccagccugggcaauaugacaaaaccccuucucuacuaaaaacacaaaaaaguagccgggcgcgguggcugcgcuggugaccccagcuacuugggaggcugaggugggaggauuacuugagcccaggaggcggaaguugcagugagcugagauggcaccacugcacuccagccuggguggacagagcgagacccggucucaaauaauaaaucggccaggcgcgguggcucacgccuguaaucccagaacuuugggaggccgaggcaggcggauaauccuggccaacaaggugaaacccugucucuacuaaagcuacaaaaauaggugggcgugguggugcgcgccuguagucccagcuacucgggagucugaggcaggagaaucacuugaacccgggaggcagagguugcagugagccgagaaucgugccacugcacuccagccugggcgacagagcgagauuccuucucaaaaauaaaaaauaauuaccgugcauguugaugacaacuaaggugaacuaagcaaaauccaagggaaaacagaggaguuuggguuagcccuggagcucacugaguggggaaggcucuucucggucaguugagggagagccccaguuucauacugggguugcaaggccgggcaugguggcucacgccuggaaucccagcacaggccaaaaugggaggaucucuugagcccaggaguucgacaccggccugggcaacauagugaaaccccgucuuuauuaaaaaaaaaaaaaaagaaagaaaaaagaaagggguuaaagggguuguaaaauuaaaaauuaggggauggguauaaaugauagcucagguucgccuggucacaggaagccagacuugccgggguucaaucugaccucuucuuuucuaaagagcacguaaaauaguacgaagucaaaaaagaauuagaacuucgcagugauaguggaagcgcuggagggcgauggcgggagggcgcgaaggcccaagacccuuuuaguacagugugguacaaacaaccgaaaggucucuggagucgaagaacuaaaaggacgccuaagcgguguccagagcuuagcaaccucguggucucucaacccaaaacgacgggaagagcccgagcaggggaggcuaagaacgccguagccacgaagccaaggagcuaaagcuggcgucgguuuaacucuuccagcgccaagagaugaaaggggaagcagagggaagcagaaaggagggaagaagaucccgggagggaaccguacgggcugccgcaaaacagcugggagcuugaaacccauggagaagucacuucucuuucccucgcugaccacuucugccgggaacgaccgggacagucgcagccgaagcggcgggggcgaguccucgggggagaccgggucggagucggggccccgugcucccggagggccaaugacgccgccuuccccagcccgaggcucgcuccuuucucccgcccucacuugccucgucaggccucccccaacgccguccacagcccuucccaaccccuaggcgaauccagguucaagacguagaaaagccgaugcugggucagcagcgccagggacuaccggccggcagaagccccacaguggcagccgccauuuuggagcuggagacuagcggcggagacgaggag

SEQ ID NO: 192383 - RNA, 44896 nt, Homo sapiens
agaugccacgccccauagcuccaccagucaccgcggcacaguggcccuuaagcgaggagcggcggcgcccgcagcaaucacagcagugccgacgucguggguguuuggugugaggcugcgagccgccgcgaguucucacggucccgccggcgccaccaccgcggucacucaccgccgccgccgccaccacugccaccacggucgccugccacagguaaccgcgagccccagcacagaaccggguucaguccccacgcccgaggccagggccucccgucugcucucucaggcucucgaccucagggcugggauuuucauuuuucccgucccuuucugaguaaucaguuucucaccgugcgagggggaauuucaggaaacagugaaucccgagggaagggaaacccuguggccucugcuugguggggcuggggguggagguuucucguuucucacgcguguuguggcuggaagggcucagugcucuggagggggaaacugaggcgcgggaggagacgggauuugcugagaucccgcagccaagggccccuacugggacuggggcuugguuccagccuuuacgaccuaggaacaguucagacuuuugauguucuuaauguggaggauugcacccgugggaaagggcuauuaacgacgacaacagaaauacccaagcuuauaaagacaucuauuuagagaagucagggaagcucugguucugggagguuugagcuggugagaguuucaggaccacccgcuucaaucuuggaagugaaaguuaacugguuuccuuucccgucccuauuugauuugagguuauaccuacguggaguguucuaugccaagcauuauaguaucugggggcuggaagaagaaacuuugugucgcgugcuuuguuuuauagaugaaaaggagugcccaggguaguugacuagcccugugguauguggugaauggaguagcccagcuuucuuuacucugggacuugcauagcaaacauuuucgagccuuacuaagcuuuuugagcagagauuguuucauaaaggggagagacaaucucuagugaacaguuccaguguuaaagggcuggaguauacacguguguacaggggcagcaucuaacccuaacuugugggagagguugagacuucgcagagguggggaggcuugaguggaguuuauguguuuuucuguuuguuuguuuuguuuuguuuuugagacggagucucgcuccgucgcccaggcuggagugcaguggugcgaucucggcucacugcaaccuccaccuuuccgguucaagugauucuucugucucagccucccgaguucugggauuacaggcaccugccaccaugcccggcuaauuuuuguguuuuuaguagagacgagguuucaccauguuggccagacuggucucgaacuccugacaagugauccgcccgccucagccucccaaagugcugggauuacaggcaugagucaccacgucucgccuuggaguuugagggcugggcagaaccuagugagaugaaggaagagaaaaguguuucaucuggaaaacagcaugaugaaggcagagaaagagcaaugcuuuuugcacuggagucguggagucuggugcaguaaagggauuucaugugggugguagauuuuuuuuuuuuuuuuuuuuugagacggagucucgcucugucgcccaggcuggagugcaguggcgcuaucucggcucacugcaagcuccgccucccagguccacgccauucuccugccucggccucccgaguagcuaggacuacaggcgcccgccaccacgcccggcuaauuuuuuguauuuuuagcagagacgggguuucaccguguuagccaggauggucucgaucugcugaccucaugauccaccccccucggccucccaaagugcugagauuacaggcgugagccaccgcgcccggcugguggugggauuuuaugagugugagaauagagggguacaucuuccagggcuuccugugcugcugugagagauuuggaguuuauccugaauguccaggaagccacauuuacuguagaucuguaucucagauacucuguaguguggaaaaguguuggagaaaggccacacuaaggauacggaggucauugcaguaauccccaggagaauuacaaggguuuuaaagacaguugcagugggacgggaggagaaaagauuugauagcucuaaggagguagaauacaccauaccacagcauuaaucaguaagaaauauguagaaguaaacucugucucuugagguuuccagccgaugacuaucuuuugaagaaauguccagcauauucuuuuuuuuuaacugcacaaguugcuuugcagaccauaauuggaaucccaguuuaucagggggaaguugucacauguacugaggguaucgaaaucugaaugguuaaauaaucauaugauaagacucaaauuuucuuguaauccaggaaaugcacauugaaacuauaauuagaucauuguauguucaucagauuaggaauugcaaaguuugacacuaucaagagaugauaagcguuugaagaaaaugagauucucgcugggcgcgguggcucgugccuguaaucgcagcacuuugggaggccgaggcgggcggaucaugacgucaggagaucaagaccauccuggccaacauggugaaaccccguaucuacuaaaaaauacagaaauuagcuaggugugguggcacgugccuguaaucccagcuacucgggaggcugaggcaggagaauugcuugaaccagggagccggagguugcagugagccgagauggcgccacugcacuccagccuggccagagagggacaugccaucucaaaaaaaaaaagaaaaugagauucuccuucacuauggguugcaaguguaucuuugagcaguguagccacuagcagauuggauauaucuuaagaucagugguuccacuucuagaaaauacuaagaagccagagacauuuguauacaaggggcaggauauuaggguuguuuguggcaacacuguuuauaaugguuuaaaaaauuggaaacagccuaaauguccauuacuaggggaaugcuuguagaguggguauguaucuuuuuauaauaaaucgauuggaaagaaaugcuaauuuaggauagugauaacuuugcaguguggggaggaugggaugggacagaaggaacaauuucgucuguaauguggaaaaaagaugaguggguuuauaaaauaacagagaauggucuggaugauagguaagugguguuuuauguuauucuuuguacauuucuauagguuaauguccacccuucaauuucuugaaguaaaaguuaaaguaaaaauuuaacuugaguuaacauguagcuauaaaaaguuaggcucagucauuuugggaaaaggcugcaaacugcacuggucccagguuucaaaaauaguaaguugggugaaagaaaacucaaaugccaaauaagcauuaaaaauuaaaauguggagaaguuauuaagcauugagcgacauuuuuggauuuuuaaauuuuuuuguuuuuuguagagacugggucucacuaucuugcccaggccagucucaaacuccugggcccaagugacccucuggcuucggccucccagaguacugggauuacaggcaggagacacugugcccaccguugacccaaauuuccuuuccuagaaaccuaaguucuaaccauuaauagauuaaaaacauuuuuugacugcuucuuuugaaauacguguuacuugcuuauacuuuccauaauacuaaaagauaggccaggcgcgguggcucacaccuguaaugccagcacuuugggaggcugagccgggcggaucaccugaggucaggaguucaagaccagccucaacauggagaaaccccgucucuacuaaaaauacaaaaaauuagccgggcgugguggugcaugccuguaaucccagcuacuugggaggcugaggcaggagaauugcuugaaccugggagguggagguuguggugagccaagaucgugccguugcacuccagccugggcaacaagagcgaaacuccgucucaaaaaaaaaaaaaaaaaacuaaaggauaauuuccuuaaaaaaaagauaaagucauuacucuguaaaauguaaaacugaacauguguuaaggauuuuauuuaacucauuaaugagguauuggagacugcaaaguacagccaauuuguagauuagaaauacugaauugaauuugcaaaugaaagacaaaacuggccucucuacagagggggaaggaagucaaaugaaccuacauuugguaacaugcauuugccugucuagacuagaauuauuugcauugcuguuacccauaguaugcagaauuauaaaauaacuccuauaaauuagaauuagauaaccgugaagaguaugcucuaaucuagaagcuaguuugccaaugaaucauauuuucucuguaggaaaaaacaacaauaaacgaagcugaguaaaauagauuuuucuuuuucuuuuuuuuuuucuuuuuggagacagagcuuacccugucaccaggcuggagugcaguggcgcgaucucggcucacugcaaccucuuccucccggguucaagcgauucuccuuccucagccucccgaguagcugggauuacaggcacaugccaccacacccagcugauuuuuguauuuuuaguagagacgggguuucaccauguucgccaggaugguauugaucucuugaccuuguaauccgcccaccucaaccuuuccaagugcugggauuacaggcaugagccacugcuccuggccuagauuuuucaucugaguuaagaucuaguuggaugaugaugaugauaacgauaauuuuuuuuuuuuuuuuuugagacagagucucccucugcugcccagcuuaggagugcugugguuugaucucggcucacugcaaccucugccuccaggacucaagcaguucucaugucucagccucccgaguagcugggauuacaggugcaugcuaccaugccuggcuaauuuuuguauuuuuaguagagaugggguuucgcauguuggccaggcuggucuugaacuccuggcuucaagugauccacccaccuuggccucucaaaguguucgaauuacaggcgcaagccaccacaccaggccuggauuuuuuuuuuuuugagacggagucucgcuuuguugcccaggcuggagugcaguggggcaauccuggcucacugcaagcuccgccucccgggugcacgccauucuccugccucagccucccgaguaggugggacuaucggugcccgccaccacgccuggcuaauuuuuuuuguauuuuuaguagagauggaguuucacuguguuagucaggauggucucgaucuccugaccucgugauccacccgccuuggccucccaaagugcugggauuacaggcgugagccacugcccggcccuggauuuuguuuuaaucccauucuuuagccagaaaaucaaaggauuuaaaggacugaaugacccuuuaauaagcucuaccaucucauuucacagauggacugugaaggcccagagagaggaagggucuccccugaguuaguagcuauaucuuuuguuaaagaaaaauugcaucagauguuuuuuuuuuuuuuuuuugagacagaggacagaggucucgcucucucacccaggccggaugguucacuauagccuugacuucccgggcucaagugauccuccccgcucagccccuugaguagcugggaccacagguaugcaccaucaugcuggcuguauuugcagagacagagucucccuauguugcccaggcuggucuggaacuacuggguuugagugauccuccuuccuuggccucccaaaguguugagauuacaggcacgagccaccacgcccagccuguauccaaugcuucuuaaauuuuuuucuguuugacacaggaucucauuguguugcccacguuggucccaaacuuccaggcucuagcaauccuucuaccucagccuccuaaguagcugggacugcaggcauaugccagugugccacgcauggguauuuuuuaaaaacagcaagacaggcugggugcaguggcucacaucuguaaucccagcacuuugggaggcuaaggcaggugcaucacuugaggccaggaacucgagaccagccuggccaacauggcaaaaccuaaaaauacaaaaauuagcuggcauggugguguaugccuguaaucucagcuacucuggaggcugacgcaugagaaucgcuugagccugggagguggagguugcagugagcugagaucacuccauugcacuccauucuggacgacagagugagacucugucucaaaaaaaaagaaaaaaaaaaaaagcaaaacaaaaaacagcaagacauuuucuuuuagcuacugcaauaggagagagagacuucaguauggaauggagcucagcucuaggauggcaaggucagcuggggauuuauagcccaugggcaaggugaggggggguuaguggaauuccuuaaaauauucaguauacuaaggugccauuuuuugagguaguggguccugaaccccaucaauagaauauuacuaagaggaacuucauuagauaucgagggugagagauucucuucuggauucuugcuaaaacuggaccuggcagaccaaggccuuguggagaagagggcucaguggagccugacuaagguuuggucaaggagacaguucuugucaccuguccuuauuucuucugcacauugucagccgaaaaaccuugcaggaugauuuuauucuuuuuauuagguggagucucacucuguugcccaggcuggagugcaguggcacaaucucagcucacugcaaccgcugcuucccagguucaagccauucuccugccucagccucccgaguagcugggauuacaggugcccaccaccacgcacagguagcaugcccagguaauuuuuguauuuuuaguagagacgggguuucaccauguuggccaggcugguuucaaacuccugaccuaaaugaucugcccgccucggccuccugaagugcuaagauuacaggugugagcccccgugccuggccuucaggaugauuuuauuuuaaaccccuagaaagcagagaguaggaucaaaaccuuuagguuuggaaggcucuuuacagauuucauugucuaacuagcugcuuugcuuggcuuugauggucuucugugucuaacccagagccaguagcuggcacugaggggucacuccugauggugguuaagguguaggcuuugguaucagaccuggaugugaacuugacucugcuacuuagauggcccugugaacuugaccuuauuacuugcauuguuggugauaauuuaucuggaaugggcacugcaucccaaacuucucaaauggauuaaaccugacuugaugguacauuucuuggauccaagugaagucuuuuuuuuuuuuuucuuuucuugacagggucuuacucuguugcccaggcuggagugcaguggcacaaucuuggcucacugcaaccucugccucccggguucaagcaauucuccugccucagccucccgaguagcugggauuacaggugugugccaccauacuuggcuaauuuuuguauuuuuaguagagaugggguuucaccauguuggccaggcuggucucgaacuccuggcgucaagugaucaacccgucucggccucccaaaaugcugggauuacaggcaugagccacugcacccggccccaagugaagucuuuuaagugaauuacugaccugguauagcccuguaaccugagcagggaugaaguccgagugggaacagcagaggacuugucauuggaggcuggugaagucuguaaaggcuuguucauugacuuugacuuuguguagcucagauacuccauugauaggcucuucuaagacaagagcuguuuaugcagcaagcccaccagugccuuaaaauaguagggcacgaaagagcaccguggguguccuacugccggaggaaacugugagggccugcucugugcucgggcccuggggugcagggugcagugccugugguuccggggccucccagacuuucacauaagcaacucuuucuuugugugacaagcaggugauguaguggaacaaacacagucuuugccgucagaucugcguggucccagcagugccacugaccaccaaguuucucuaccuuucugagccucaguuuucucaccugucugaagggaguggggauccuugcuuacagagaacuguugugaggauggugugaauaaagugucuugcacguugugugguccauaguagauaacccacaaaugugccacucugugccacuccgcaacacaucccagucucugggagucuuucuuucuuucuuucuuuuuuugagacggaguuuugcucuuguugcccaggcuggagugcaauggcgcgaucucgccucacugcaaccucugccucccggguucaagugauucucaugcuucagccucccgaguagcugggauuacaggcauguacaaccacgcccagcuaauuuuguauuuuuaguagagacggggguuucuccuuggucaggcuggucuugaacucccgaccucaggugauccuccgaacucggccuuccaaagugcugggauuacaggcgugagccaccgugcccagcugggagucuuucucucugaucuccccuggcuggggcaacgacugucuguguugucuucucccugcacgugguuagcagacgaugcaugugucccaacagcgccccugggggagaucuuuccagucuuggcacguuacgaucugccuuagguucuuuuuaaagccuucacaguaucccaccauaaggcuguacuguaauugauccagcuagacauuuauguugcuuccagugguuugcccuaauauauggucuggugcccucaccuccauaguuucuuccccuuuuacaaaugacaccucccacuccuagugggacucccucccucuccugccuuauuuuuguccaucacugucaucacuaucugacaaccuauguuuuuaaauggucugucucuucucucuggaaugccaccuccacgaagaguuuugucuguuugguucacuguucagugccugugagcagcuagcaggugcucaguccguguuuguuggauggauucggggugggggugaauguaggagagaguagauaggaggagaggaaguuaaaggagaggagguagaugaugaugaugccucugugagaugaggccuguguaauggggacccuggagagccacagccaaaaacagcagagucacaaagaaugaguaguuuagccggcgucguucacuuuuuugucaguuuuucacuuugauaaaccaggaaucauagggaugcugccagauuauuggugacuuuguuuugauaccuugacuuugucaaaaaucauacaauaaaugcccauaggaaauuagcauguaagguagcuacuuugaggcauguucauugccaaggguaauggaaugauuauuuuacuuuugugucucucuucaccccaggccuuucuauuuuuauguguuucccaaaauaguguuaguguaugugggguuuuuuuuguuuuuuuuuuuuuugagacagagucuugcucugucaccaggcuggagugcaguggugcgaucuuggcucacugcaaccucugccucccagguccaagcgauuccccugccucagccuccagaguagcugggacuacagguacauaccaccacgcccagcuaauuuuuguauuauuaguagagacaggguuucacccuguuggccaggauggucucaaucucuugaccucacgaucugcccaccucggccucccaaagugcugggauuacaggcaugagccacugugcccggccauguaugugguuuuuaaaguagcauuuucuauucggcaacguaaugugaggcuuuuaauauagcguuguagucagggaaucacgacucuguguuuauaagaaaaaagaacgauggagcaggaccaucaccaaguagagacuaugaaaaugucauuuuuuuuggcugggcgcgguggcucacgccuguaaucccagcacuuugggaggcugagacaggcagaucaugaggucaggagaucgagaccauccuggcuaacacggugaaaccccaucucuacuaaaaauacaaaaaaauuagccaggcauggugguggcgccuguagucccagcugcucgggaggcugaggcaggagaauggugugaaccugcgaggcagagcuugcagugagccgagauagcgccacugcacuccagccugggcaaccgagcaagacucugucucaaaaaaaaaaaaaagaaaaagaaaaugucauuuucuguaucaguagggcacuuuucucacagaggauuagaagaaugaaggauuaacucgauuuuguaaaaauaaccaaguggugcuuuuuuggugccugcuguguguuugcuaauuuagguggauaaguaggugguguccguucuguuguucacagucaggucaaccguuuguuucugguauuuuauuuauucauuuuucuccuaaauaugaggggguaaaagucacacaccauugcccccagaggaaugacgcucuuugagacuaugucauaugaacgaaacucagaauaaacaggugugcaaacuagggaacccauuuauugcugauaaaagaugacaguaacagccaggcugugccugccauguggucugggggcaucuucucacucccucagacagggucagcaaccuaugaccuaugggccaaacaaaccaccuauuuuauagauaaaguuuuauuggaacauaaccuauucuuuuguuuauauauugucucuggcuguaacuggcucauggguuaguaauucaucacuuccagaguccaauuaacaagagcaagaucugguacaaagaaagugauuuauuuccaaguugcuuaggggaagaaacacaggcaucccaccuuuagauguacugcuuugcuuuuggagcagaaagugggcacuuuuaaaaggcaggggaggaagcaagcaaggugggguguccacguguuagcuuggugucuuaucuacugugcugucugucgguugagcuggugacugcuggcaucuuugugggcaggacuaggccaaaaacuccccaggugggagggaguagcaggcaugcuuuuugacuaguaucucucaaggcaaccuccuggcaggugagaguucuguauugggcaugcuuuggucuguaaaucaacucuuaacucuugaggaguuaggugaacuugcccuguagggagugucuggugaaggaggggcggguaaaaggcuauauuuguguuucucaagggcuaagcaggaagcggggaaccagaggaaugauaaaaggagagacaaaaauaauucaaccaucucuuagaaaaaugcaaguacuuggugacuggcugcuuucaagauacaguggcagaguugaauaguugugagagagauggccuggccugcaaagccaaaaauauuuacuuucugguccuuugcagagaaaguuagccuaccccuacccuaggggaaggcuuuccagggaggcugcugggugagcuccgaguaggugagagccguugguuggaacaccuugguagugacugucacaccucucuuguggggucacugaagagcuugggggacauggauauuuuugcuccuugacucucucucgccuguccucacuguugcuucuucacaaguuuguauaauugcaucuuguauugguuccuuaccuucgagcugccaggggugcuugaaccagagugacuccaugaugaacaagggcuggguaaaauuuggcugagaccugcugggcugcagucccaggagguuagguauuccuagucacaggauguuuaugguuaagggaacagguuaauguuuaccaaacagacccaggaaagguccugaugucccuauaucuuaagaacaaaagcauuuuuaguuuaauaauaaguucacuuuauuuuauuuauuuauuuaagacagggucucgcucugucacccacgcuggagugcaguggcacaaucuuggcuaacugcagcuucugccucccggguucaagugauucucgugccucagccuccugaguagcugggauuacaggugugcgccaccacgcccagcuaaauuuuguauuuuuaguagagacaggguuucaccuuguugcccaggccggucuugaaguccagaccucaagugauccgccugccucagccucccaaaguacugggauuacaggugugagccaccgcaccuggccauaaguuucaccuuaaagauaauaacauagauucuugugaaagacagcaguucuacaaagauuaacgguccucuguccguuaaucuugccuuguagcaggcacaucucccugugacuuuguuuugcuuuguugucuuaugucuaaacaagcauugcaccuaagguagacaugguccuccucuugcuuuugggaacacccuguucugucuguagaguaauguguucuuucacuguuucacuugcugaauaagcuugcuugcacauuauucuguggacuugccccaaauucuuucuugcaugagguccaagaacccucuguugaggucuggaucaggaccccuuucuggaaacacagccccacagcgagcccuugucaggucgaguggacuuguggggagccuccucaggugcacaugaacagacccgugguucuagcacuggggguccccagcacuccacugaccuaucuguuaugugccauacuagccgcuacuccaagaaaaaaaaaaaccugaaaaaaacaaaucugggagcaucuuacuguaguuaccaguugcccguccauugaccuugcaguggagcuaaagaaaccuacauuuagcacgauuucaggcuuucggauuaagaauuaaguuccuguuaggaggcagugcuugaggguggagcaguguagucuguugaccaggaugcuggguugaggacaaguggaccagaggcugggggauuuaaugcaguucugccacaucaaagguaaucugaggcuagcagcauagugucaccugacacuuguuagaaaugcagucucauggccaggugcggugacucacaccuguaaucccaccacuuugggaggccgagaugggcagaucaccuaaagucaggcguuugagaccagccugggcaacauggcgaaacccugucuccacuaaaaauacaaaaauuagcugggcaugguggugggcaccuguaaucucagcuacucaggaggcugaggcaggagaaucgcuugaaccugggaggcggagguugcagugagcugagauugccccagugcacuccagccugagccacagagcaagacaccgucucaaaaaaagaaaugcagucucaggcccugccccaggccuacugaaucagaaucugccuccuagauccccaggugaccuaggugcauauucaagugggagaauuacuugucuaagacacuuuucaagacucagcacuuccuauuuaguuacuggaggaaauccaucgcuuugagggcuagacucagaacauugaagaugguuucuucagcuuagagguggaucagccuucaucugggugcguccuccaugaagacacaggcuuuguucugucccuguugaguucccagcacccagcaccuugucuggcaaaguagguguugcagagacucuggcugaguggcgagucaaggaaugaaugagcaccaccagcccugcuuguggcauugggacagaagucagccucacacaucugccgcccugaguccccacaucucagugacuauauauuuuucuucuuaucgcggaggcacaggcuuggugcuguuuuccguuuauacuuuaacaauguauuuaaggguuuggaauugaaguauaaaagagagcauguacuuccauaauaauaaaguuuuuuuuuuuuuucuuuuuugagacggagucuugcucuguugcccagacuggaguguagugcuaugaugcaggcucacuguauccuucaccucccggauucaagugauucuccugcuucagccuccugaguagcugggauuacaggcuccugccaccacgccuggcuaauuuuuguauuuuuaguagagacaggguuuugccauguuggccaggguuuugccauguuggacagggugaucuuggacuccugaccucaugugguccauccgccuccgcuuuccuaagugcugggauugcaggcgugagccaccacgcccggccucaguaauaauaaagucuugcgauggagagccauauagcagaaagagugccggaccagccguucagaaggcauggucccagcucuggccaacgcugacaguccauggcuauuaggcaggucauugcucucagacccuaaccucuccuuucuguaaaacaaggaugaaaauguuugcccugcauguuguacagaugguauguccaugcucuguaagugugaugcaaagacaacaugaauuaauguuugacuauagcucauccagauaguucaccuuauaaacuuaaauugcccaucaauguuuuuauuaaaccuauacugaauuuuuagaaacuuuauuaaguaauacacauuaacuguauuaaaaggagacaaaaaugaggaagaaaaucacccuugauccugccaaccaccuaccaauaacuacuguuaacauuuugucugucuuccauauuuuucuguguaguuuauuuuauuuauuuuuaaaauuuauuuuuucuuauguagcuuuuuuuauucuuauuuuuaguuuugagccagagucucacucugccaccuaggcuggagugcaguggccugaucuuggcucacugcaaccuccaccucccgguuucaggcaauucuccugccucagccucccaaguagcugagacuacagguaugugccaccaugcccagcuaauuuuguauuagcagagccaggguuuuaccuuguuggccagucuggucuugaacuccugaccucagguaauacaccugcuucggccucccaaagugcuaggauuacaggcgugagccacugcacccagccugcacaguuuauuuuacauguauauucuuuucuuacaaauacuucauaguaugugguagauauguuuccaauagugaauuuuguugaugaauuuuaucugcuguauuuugaguuacgucaaaaacuuuaaaaagugcccagagcccuuucuggauauucuuuuauuuuauaugcaugacuuggacuuguagugaagauugggagguauggacagccccuucuccacgcacaggcuggagcaauagagcuaaaaauagaaacccucucuguuaucuucaacauacucuggugguuaaaugaccuuaucuuuuugacccauuuacuaugauauuuucuuaggggcugacaauguuuaucuguucuuuuuuuuuuuuuuuuuuggagacagagucugacucugucacccagacuggaguaugguugcacagucuagcucacugcagucucugucuucuggguucaagugauucuccuuccucagccucccgaguagcugggauuauagguacgugcuaccacgccuagcuaaguuuuguauuuuuaguagagaugaggucucuccauguuggccaagcugaucucaaacuccugaccucuugauccacccuccucggccucccaaagugcuggaauuacaggugugagccaccgcgcccagccaauguuuaucaguucuuguugcuuuguacuugacucuguguuucccuucucaggugucugcaauugaacuccaaggugcagaaugguuuggaaaguagcuguauuccucaguguggcccugggcauuggugccguuccuauagaugauccugaagauggaggcaagcacuggguggugaucguggcagguucaaauggcugguauaauuauaggcaccagguaagaaaaugacuaaucuuuuuuuuguuaaggacacuggcauucugaaaacaauuccagacacuguuaauauuaaauagaaaagacuugaaaagccauugacggaccuguuaggcuggcuguaacauagguguguuagcgaggauguggggaaaucagaacccucauauguugccaggaggauuauaagaugguguagccauuuuggaaaacaguuuggucauuccucagaaguuuugauagggccaucuuaaucugaugcaagguuucugaaccuuggcacuguugauaguuggggaccaggucauucuugguuguugggggccgucuugugcauuugagguuuagcagcguccaugacaccuacccguuagaugauggcagcaucuccugcuccacuguaauaacgcagaauucuccagacgucgcccaguguccccagggagccagaucacccaggcugagacccacuuaguucaacaucuucauuuuagagauaaggaaacugaggccuagagaguggaggugacuugcucaaggucacauggcaaguggggaccagacaggacugaggccaggacucuggugacaggacccccaggccucucugcccuacugcucucucuucacacccuccucccccaucuuuccuggauuuccccacaucagccuaccagaagguagagagaagaagaaaagaagccacaucggaguguccaugaaaaguccagccucccugugggauguaaaauggugcaaccaccuugggaaagagucuggcaguuccucaaaauuuaaacaucaaauugaacauaugacccagcaauuccgcuccuaaguauguccuuaagagaggugaaaacaugugucuacacaugaacauguacaugacuguucauagcaguauuguucauaagagccaaaagguggaaacaagccagauguccaucaaagguugaauggagaaacacaaugugauuuauucauguaagaagauauuauuugaccguaagaaaggaagaaguacucacacaugcuucaacaugggugaaccuuacaaacaugcuaaggagcuagucacaaagaccacauauguuaugauuccauuuaaaugaaagcccaaauuuggaaaaucuauagagauagaaaguagguuaguaguugccaagggcugggugaaggagagacuggggaguaauugccgauggacauggggucucucuuugcaggaaugagaaugcucuagaaguaguggugaugaguacacaacuuggugaacauacuagaaaccacugaaucgucuguuuuagaagacugacuucuauggugcaugaacucuaucucaauacagcuguuauuuuuuuaaaaagucauuuaaucuugucagucucagaaacaaaugcuuagacuugcaguaucuauauauugggcucucuucuaagagcgcuuuacacagaguccuuuaacuccugcagugggguuaugugccauugguccaguucuuacucccucuuuacgaaugauuggacugaggcauaggcaaggucaguaguuugcccaaagcgguacagcucacaagugguggggccaguuuucaaacccaggccaacuggcucuggagcagcccugucugguaaaagagccaugguaaauguucuaguagccacauuuagaaggugaaauuaauuuuaauaacuucuuuuuuuuuuuuuuuugguugagacagagucuugcucugugucccaggcuagagugcaguggcgcgaucucggcucacugcagcuuccaccucccaaguucaagcuauucuccugccucagccucccgaguagcugauauuacagguccagcuaauuuuuguauuuuuagcagaggccggguuucaccauguuggccaggcuggucuuaacuccugaccucaggugaucugccugccucagccucccaaagugcugggauuacaggcgugagccaccaugcccggccuuaauaucuucuuuaaaccaguauuuccaaaccauuaucauuucaacauguaaucaauauaaaaaauuaauaauaagauaccagccagcaugcuuguagucccagcuacucuggaggcugaagugggaggauugcuugagcccaggaauuuaaggcugccgugagcuauuaucgcaccugugcauagccacugcgcuccagcuuggguagcagagcgagaccuuguuuaaaaaaaaugauaauaaugagauaucauacauucuuugauuuuguacuaagucauugaaauccagucuguauuuacauucacggaaugaaugaauaacucauuucucgaaucguuuuuguauguuagccgaauaggaaauuuggcuugauuaaaaaguuguuaucauggcaaaaugaucccuucucccuuuaauacuuaaccacagaccugacccauguaaagaggagcagcccgcgcacacagcuguucagcucucaguuuucuucucccccucuaaccucaaguuggaaagauuaguugugaaauacagaccacagagaguuaacacgauuacucaucaaccaccgugauuuuuauacaaccagcuuuuaagaaaauguauuuauuaaacauuauugaguagagguuauccaauuaccuuugcucccagaaaccuuuuuguuuuuuuaguguugcuaauuucccugaguaaaauacuaacuaucaaaauagaacaaagggaaacaaggccaaagaaguggcccagacugaaauauucguccccgaguaagagaggaugauggccuuaaggccgguggaggugagauuugugccgauucaccccugccucagcccucccugccaaggggcugcuucuguccucagccggcugccauuugccuucuugacuuuggaggcuuaucauuaaaagaguguucaaaagaacggucuccacagaaccuaggcagauuuuaaacuuacauuuucauagagguuuauauuuuccuuggauuaacacaacauucauuuaccacaaaucucuuguuuagggaagaguggcacaccaggcacaaauaaaucauugcuaagugcuuuccuauguguuauacuuguuaauuaaaccuuguuuugucuugaccaaauuggauuucucacuuuuccauuuugggcugggauuaaguguuuaacgggggcggggggggggggcgugaucugaggugaugugggcaggacauucugcauuguguccugagcauggggugaguaaggagggccccuuuggaagucguggaaucagaguagagucuggggugaucagagagagcuggaagagugaggugggggguugcauggauaauggggagaagggagcagccaagcaugagugccagagaggugugaggguguggccagccugggagggaguggggacagaggcagaccugggagaggggccagcaagaugggccaggaugggcagaggugcgcaggcaccugggaaguguggcgcaaucccagaacgaacaaaaaaaaaaaaaaaaaaaaagaaaagcugagcagguggaaguggcccaggagcagaacugacugaaaaugguaccuagcucauuccugcugagcacgugugagucagaugccguucagggugcuggcgaugcaugucaccccaccugcucugcagugcugacauacugguggaagaaggcugcccuugacuaagcgcuuccugugugcagggcucaguuccaagcacuuggcacguguuaucucaauccucagacaacccaagaggauagguccuauuagaucuccauuguaagauguggggguggggcuaaggcacagaaaggcuggguaacuuaucuaaggucacacagccaguaagggguggagcugagauuuaacccaggcaguccaugcuccacagcccaugcuuauaaucacuacucuagucauguggcauggguaucuuggcauuacuuuaucuuuuauuuuaaaauaguuuccuuuuuuuguauuaaaaauuuaacauguuaagguuuauuauagaaaacuuacacagccaaaggaagcaggucauuuguaauuagucaugcgccguauaacaaguuuguucagugauggaccgcauacacgacaagugguccuguaaaguauaguagcauauuuuuacuguacuuuuccuauguuuagauacacaaauacuugccauuguguuccauuugucugcaguauucaugacaguaacgugcaguacagguggauggccuaggauuaccaucugagcguuauaacaaacauuaucaccuuagcuccaccuccugucaggucaccgaugccaauucuaauaggagcgugaacccuaucgugaucugcguauaugaggaauccaggcugcgcacuccuugugagaaucuaacuaaugccuagugaucuaagcuggaacaguuucaucccgaaaccauugccccucaccccuguguguggaaaaauugucuuccacaaaaccagucccuggugccaaaaaggucguggaccgcugggcuagaccaucuaggguuguguaaauacauucuaugauacucacaaaacgacaaaaucaccucgugaagcaucucucagaaugcauccuugucuuuaagcaaucacaacugcuacauagacucaguguugcuggcauugcauucugaaaguggcaaacacggcagaauuuuucugagcauuaaaacagacuugauguauuggucuguuuaguuuaauguuuuucacuugaggcccaugguuugcaagggguguaggggaggauuguggagaauggggagucagggcccucugaucaggagcccccagccuuuuaggguagguguacaaauaccugaacucgaggcugagaaagagcagucucuacagcagcuccaguugccggguuuggguccagaaguagaugagguccaucaggagagggaugggaaugcagcuucuuggaggagaggcuugacguggguuugaaggaugacgggauuuccacagaagcucuuuccgcguggagggaagagcaucagcuggcagugggaauauaaaaucacagugaggggcguggccagcacaucgggugccuucaagugcauguaccagagcccucccuggugguuugaaagaguguggagacuccaggguuggcuaauuaagcaguuuagccucuuuaucucaaacccagguccuuuuuuuuuuuuuuuuuuuuuuugugaggcagucuugcucugccacccaggcuggaguguaguggugcaaucucggcucauugcaacauccaccucccggguucaaucaauucucgugccucagccucucgaguagcugggacuacaggcgccugccaccacgccuggcuaauuuuuauauuuuuaguagagacgggguuuugccguguugccuaggcuggucuugaacuccuggcuucaagugaucugcccgccucagcucccaaagugcugcgauuacaggcgugagccacugugcccagccucuuuucaucuugcuacucugucaucauaguugugacgaacuguccucaaauacacucuccucauagucacgaaauggcugcagcagcuccaggugucacauccaaacaaaaucucaaagaagaaaaagagggcaucuaugugucuugucuguuuggcuugcucuuuaucagaugcacaucuuuucuuggagccauggguggacuuugucccgagucuuccuggccagaauugcaucacgugcucauguucaagucagucaguuccuggugaggggaaauggauuuccaguucacacucagggaagcuccugaccacuugugaccacuuggagcuggguaggucaucugagcaaagccagggcccugguggaaaggaagguggccacagggcaugcaaggacagugcauggcccagguagauggggaggaggaagcgagggagaaggagaccggcaagguagggugagggcauggugaggcguguuaggaggagaaggcccagucagcaacucucccuuucuuucccuuugacagaaccucuccacucagaaguagauaaaggguuggacaggcgccaugucaccaaugacaagaacagggagcuccucacucugugugcuccuggcaagccccuuccccacccccacacacucagagccucaccauugcugucuggcucaagacuggggccugcagaguuuuuuucuauaaagggccagauaguagauauuugagguuuugugggccaaggggcaaaaaucgaggcuggcggggccaaagacaggcugggcagacugcagugacggaggcgagagggaguggccagggagugcaggaaggaggugguggugacucacagucuguuucucacaagcuauuuguuuacuuauuuaauuuuuuuuuuuuuuuugagacagagccucaaucuuguugcccagccuggagugcaauggcgugaucucagcucacugcagucuccgccuccuggguuuaagcgauucuccugucucagccucccgaauagcugggauuacaggcaccugccaccacgcccggcuaauuuuuguauuuuuaguagagacaggguuuuaccauguuagccagacuggucucgaucuccugaccucugaugauccaccugccucagccucccaaagugcugggauuacagguaugagccacugugcccggucagaugagcucauaacuuaugguguuuugagauuaauccauguuguugcacaauaucacuuuuauauuuaaaaaaauccguggccaggugugguggcucacaccuguaauuucaucacuuugggagaccaagguagguggaucaccugaggucaggaguuugagaccagccuggccaacauggugaaaccccaucucuacuaaaauacaaaaauuagccgggcaugguggcaugcaccuguaaucccagcuacucaggaggcugaggcaggaaaauagcuugaaccugggaggcagagguuguggugagccaaguucgugccacugcacuccagccugggugacagagugagacucugucuccaaaaaaaaaagaaaaagaaaaaagaaauccgcuuuuauuuuuauuuucagcaacagggucuuauucugucacuuaggcuggagcucgguggugugaucauagcucacugcaaccucaaacuccugggcucgagggauccucuugaguagcuggaaccgugggaccauaggugugccaccaugcccagcuaguuaaaaauuuuuuuuuauagagaugaagucuugcuauguuucccaggcuggucucaaacuccugggcucaagugauccucuuuccucagccucccaaagugcucagauuacaggccacugugucuggccugaaaucugcuuuuaaagagggcauggugggaagagauuaggagggaggacagaggggacugugcaagggaaugccaagcaugugggauaugggcuugggcccauucuugcagcagggccguccuuguaaaugccagaggcagcacaggaccuuggaaagaccauggcucuggauuugcucagaccucaggugucauuccuucucuccaguuaugugcuguguaaguuugaacaaacuacauugucagauucuuucucugggguuggcagugggcucagcgaggcacacugcaaaaccccagccugaugccucaccucagcacugcucagcugugugucgggaagugaucauauauguauacuuggcaggugagcagggcuggcuggagagcggacccuuuacagcaacugugacauggggcacgccaauguauuuagaccuuguucgacuugucuuuguuuagcugacagcuggccaagcuggaggcaguacaagcagacagaguagggacaguugcccuaucggcaaaucacgggaggcauuaggaagaccagcggaacucccagcacaagcuaucaaaccagccaagucacaaucucuguuugucauuccggagggcucugcgccucuuagaagucuugcucaauacccuccucucgaauaugaccucauaugacuuuucugggcuuaugcggggaaaauacaguauaggucacacggauuuaggggaaguaauacaaguagucaguaacaccauuuucacauuguuugaguugaaccccacuuguaucucuuuugagugcuaguaaauauuugacuuaauggaagaaccccgcugaguuaacaaagguagaggcaaccaagugccuccaaggcccagaagagagucacagccugaugaggaggcagugaguguggaagauggggcauaaggcacaguuggggucagccauggcccuuccugagcuagucccugucuguaagauggggaugaaagcauuuaccucucaagggugcugggggucccaaacagugcaggaguaacaacacaaggcacucugaaccugccccugcagaaaauauauaacuuuauugaggccuaguuuaagacauaucaucuuaauucacacauugaguuuaauuaaucuaauucaaugauuuuuuaguaaauuuaccaaguugugcaaacaucacuauaaaucaguuugauauuuccaucaucccaguaugauccuuugggcaggccgggugguggcucacaccuauaaucccagcacuuugggaagccaaggcggauggaucacuugaggccacgaguuugagaccagccuggccaacaugguaaaacccaauuucuacuaaaaauacaaaaauuagcugggcgugguggcacaugccuguaaucccagcuacuugggaggcugaguuucaagaaucgcuuggacccuggaggcagaggcugcagugagccaugaucacacugcugcacuccagccugggcaacagagcaagacugacucaaaaaaaaaaaaguuguuugggcauauuugcaguucccaccucuagccucaggcaacugcuaaucaucuacuuucuaucucuauagauuuguuuauucugaacauuuccuaucaguggagcuaaacagcguguggucuuuugugucuggcuuccccuagugucauguuuuugaaguuuguucacguuguagcaugcaucagugcuucacuccuguuuauucccaaauagcauuccauuguauggauagaccacguuuugccugcccauuuaccaguugauggacauuuggguuguuuccaauuuuuaguuauuaugaacaaugcugcugagaacauuugcaugcaaaucuuugugugaauacauuuuuuuguuucucuuggguagguacuuaagaguuggaauugcaggacagaugugguggcucacaccuguaaucccagcacuuugggaggccaaggcagguguaucacgaggucaggaguuugagaccagccugaccaacauggugaaaccccaucucuacuaaaaauauaaaaauuagccaggugugguggugcucaccuguaaucccagcuacucaggaggcugaggcaguagcaucgcuugcacccgggaggcggagguugcagugagccgagaucgcaccacugcacuccagucugggcgacagaacaagacucugucucaaaaaaaaaaaaaaauuuagacuuguugggucacaugguaaauuuauguuugacucuuugagaaacuauaacgcucguuuccaaaaucgcggcuccacuuuacauuaccauagcaguguauguauggaggcucuugguuccccaguuauuguccgucugucugugaaguggcagcucagugugguuuuaauuugcauuucuuaaugaugggugauguugaacaucuuuucaugugcugacuaacaauuuguauaucuucuuaggugaaauguuuauugaaaucuuuugccuauuuuuggcucagugauacaggagugcuuuagauguuucaguacaagcccuuuauccgauauauguuuugcaaauauuuucucauagucuguugcuugucuuuucauuuuuuuaauaaugucuuuggaagcacuaaagguuuuaauuuugcuaagccaauuuaucaaaguuuuguuuuuguuuuuguuuugagacagagucuugcucugucgcccaggcuggagugcagugguguaaucucggcucacugcaaccucugccucccggguucaagugauuucuccugccucagccucccgaguagcugggauuacaggcaugcaccaccaugccuggcuaauuucuuuguauuuuuaguagagaugggguuuuaccauauuggccagccuggucucgaacuccugaccucaagugaucccaaagugcugggaucccuggccucccaaagugcuagaauuacaggugugagccacugcgccuggccugacuucauuuuuaaauuaaauggcagacaaauaaugucuguauaacauguguacaccuuaaagaauaauaaaaugaauaccuguguaccuugcaccuugcuaaaaaaaaaaaaauuauacuaguaccuuguccccugucugauggacucuccuucccuucccuucagagaccaagcuccugaauuuuuugucauucauuccuuugcuuuauaguuuugcuguaugucuauuuaacugugaacagcauaauguuuacauuugccuguuuugaccuuuaugcaaauguaaucauagugaagguauuuuucuaugacuuguucuuuuuuucacuauguucccaagagucaucuauuuugaaacccggguuguacuuguuugcguauuuuuaaaaguuuuuauagauucaggggguacauagauacauugcauaguggugggguuugcacuucuuggguacccaucaccugaguaguggguuguaguucguucauuuucagguauuccauuuaugugaacuuaugacaauuuauuuuuccagcuguugacuaugauuggaguuauuucuuggcuuuugcuguuaaagugaugcugugaacacuuucugguuaucugugggagauagaguuuugcuaggcuauauggcuaggaguagaauugcuugguuggagggugugugguucaaccucauugauaaugucaagauguuuuccagaguggagugccaauuacacuauacuuccaucauagcuguauuaguuuacuaucacugcuuaaacagauugccacagacuucauggcuugaaacaauacaaauuuauuaucuuacaguucuggagguaagaaaugugaaauggcugucacuggguuaaaucacgguguugccugggcuguguuccuugguggcuguaguggaggcuccacuuucucgucuuuuccagcuuuuagacacugccugcagcuguuggcucauggccccuucuuccauccucaaugccaacaagggucaguugaaucuuucuuacacugcaucacuuggacacugacuccugccucugucuccacauacaaaagccuuugugauuacauuaggcccacugaaggccaggcgccguggcuugcaucuguaauccaagcacucucuauccaaggugggaggaucgcuugagcccaggaguucgagaccagccaaagcaacauagcgagacccugacucuacagaacauuuuagaaauuagccaggugcaguguugugugccuguagucccagcuaccugggaggcugaggugggaggaucacuugagcccaggaagucgaggcugcagugagcugagauugcaccugugcacucccgccugggagacagcaagacccugucucaaaaaaaaacaaaaacaaaaacaaaaaaauaaacaaaaaugacauugggccacuggaauaauccaggaaaaccucccuauuuuaagaccagcugauuggcaaccuuaaguccauccgcuaucuuaauaacccuuugcucuguaauguaauguaauguagugcaggcuucagggauuaggauguggacauccuuuggggggcuguuauuuugccuaccacaauuaguguuugagcaucuaacaaucgacagaguuuugcucuuguugcccaggcuggcgugcaauggugcuaucucggcucacugcaaccgccgccucccgcauucaggagauucucccaccucagccucccaaguagcuaggauuacacgcaugcaccaccaugccuggcuaauuuuguauuuuuaguagagacaggguuucaccauguuggucaggcuggucucgaacuccagaccucaggugauccgcccgccucagccucccaaagugcugggauuacaggcaugagccauugugccuggccagaaugccugggaucuuucacuugaacucugugugacuugggcaggucaccucaccuccaaaggcugcguuuuccuuauccauaauaaaauggggaucauuaccuuuaucaucaaggguugcugugagaauuaaacgagauaaggccuacaaagucuuagcacagugcuggacaaauagaagcaagucaauaaaaauguuuuccuauuuauugagucauccauucaucuaaucgcucuugagugccaggcccuggaccucacccauucagccuucaaaagcuguauaccaagcacccaucuuugucauaaaauaaguccauuuguuugggacauccacaggcaaagugccagucugcauguuuuaugagcuuuaguuuuauugcugugcucaguguuguuuagagugcacuguguguacacccaguugcucaggcugucuuccuuggggagacaaaucgcugggcacacgccucuccuuaugcuuacuuaugucuuuguucuaggaaugacaaaauuaaauguaagcagacaggcaacauuuuuccuuucugucuucagaugauuugcaaggcaugaagugguaguauguuucaccugagauaaggacgcaagccugucuucacccuugcguggacagggaguugcauuaggaacauuuuucucuuauuuauaauguugucuuccuuuguauucuuguuauuuuuuaaaacuuaagagcaauuucucaauuccugaguuggacuuuugaguguucagucaguucucuaaacagugucuuuggcagacaaaguacuuggaucagaagaauccugugggaaauagaacuagcucuguugaucauucugagucauucuguuuuugagacuaaaaucuaugcuuuccagagacuauuauauagucugaaaaauaaaaacaaguuacuuaggacuuucagagguccuucuuaccuauauaugugguggcaguggugguagugguggcgguguugguggcgguguugguggcgguguugguggugguggugguguugguggugguggcggugauggcgguggcgguggcggcggcggcgguggcggcgguggcggcggcggcggcggcggcgguggcggcggcggcgguggcggugguggugguggcggugguggcgguggcgguggugguguugguggcgguggugguguugguggcggugguggugaugguggugguggugguggugguggcaguggcgguggugguggcgguggcggugguugugguggugggguguguaugugcacgugugcucacaugugcaauguguacguagcccacgugugcacuaguuuccugcugaauaauacuuuggauggaugggagaucuuuuuaaauugagauaaaaaauaucaauguauguguuuuaaaauaauaauuuaaaugccugaccgacgggaugauucacaguaagucuuccaggagacagaacacaucacuccuuagaacuccaaaauuggccucccaggcaagaucuaaaacuucaccaaaucauuucucccaggcagacgcgugccaugccuaccagaucauucaccgcaaugggauuccugacgaacagaucguugugaugauguacgaugacauugcuuacucugaagaguaaguggggaacacuuggaacuugguggggaaggacuucaggguauuuaaaaaaaggucacauagacucacaggaauccuaguggccuaauguuaaaauauauaagagacucccagacagaagaucacagggauaccucauguugagcuuuuuuuuuuuuauuauuauuuauuugagacagucuugcucuguugcccaggcuggagugcaguggugcgaucucggcucacugcaaccuccacuuccuggguucaagugauccucccaccucagccucccaagaagcugggacugcaggugugcacugccaugcccagcuaauuuuuguauuuuuaguagagacaggauuucaccauguuggccaggcuggucuugaacuccugaccucaagugauccggcugccuuggccucccaaaaugcugggauuacagaugugagccaccaugucuggcccucauguugagcuucgaccauaacuugggugugcccugggaauggcaaagacauaggaagugggugcuggucgcugcuuugaaagggucuaaagccgaguuccuccucaccuucgaggacuuguuggauucuauggugcuugcuccuaagcuccgagcaggcugcagcacaggggaccugcacguagaauguuuuuguuuguagguuagauacuccuacuaccuucuuucuauacuuauuuuauuacuugcugaguuuaacuucacaaauaguucccuugugccugcuuaucugauuucuugcagagaucagaggcagcaaguaugggcauaaacucagcgaguucuaaccuccuagcuccguggucacccugcugcggugaaggacgcuacccuuacuguggucacauucucagcucauacaucacccacucugacgcuuuaacgccuaagcucuuguauuaaagucuuguucucuguccugucucuuucugaaaguaguuucacucugagagagcuuuugaugagaccuugcccucacgaugcucucugguuuccagcaggcagccaggcgcaccuaugcuuuggucccugcccgaggcuuuucgggcucagcuccucacugccucugccaagagcucuugggcugugggacugcugagauccccaagcugcucaaaccacucacacguuggccacccugcaggccauaaguuguuucuuugaccaacauagacguuuacuauuuuuucgcauaacauacauguguuugaagagagagauuucggaggcaugccacaucucguuuaaauuguguccuuuaauuuucagcaaucccacuccaggaauugugaucaacaggcccaauggcacagaugucuaucagggagucccgaaggacuacacuggagaggugaguggcuucuacgguuggagccagcugguuuaguuuucauuuuagugaugauuuuucccucuuucuucuguuucuagaaucagaaucucccuagacuggcuucuggucgguguuucacauucguauuaggauuuuugccugaggaguaaauuaugagaguuuugaaagaaagcagaggaaaagagaauguuuagaauaaguugcaauccacugauaguucccagucuucucauacuuuaggccugaccauguaguuucauccauauuaaccuuucuugagauaucaccauuaaucugaucauagauuaccugugcucuuuuauaaaaaucaguuuucucaguaccaggcuuggugcaaaguaucucaggauuuuugcugagauaguuuuucauuuauuauuguuauauaguuuauuauauaguguauuauagcuauaauaguauauuacuuccaaaaacuuuucuguuccuccuaguugauugagacugucucaauugacacauuuuuaaaaucgaccgugaugccuucauucaccugguuuucauagucuguuuuaaauaucggaucuuuuaggaauuaauuauccuuuugauaagaaacuuuuaucugauguuuaacaauucuuuguuucauuuuauuuuauuuuucuuuuaaagucaaauacaauuaaauuuaacauaucauacagguaaaaaagaugaccguauuuaaugaaauuguuucuguauaguguuuguuuguuugagauggagucuugcacuguuacccaggcuggagugcaguggcacaaucuuggcucacugcaaccuccgcuucccggguucaagugauucuccugccucagccuccauaguagcugggauuacaggcaggugccaugaugccuggcuaauuuuucuacuuucaguagagaugggguuucacuguguuggccaggcuagccuugaacuccugaccucaaguguuccgcccgcuucggccucccaaagugcuaggauuacaggcgugagccacggcacccgaccaaaaguguuugcuguuaagccaugagccuuggaaugugcaggcugguggcaugggucgguugcagacucagccaacucucuggguuggagcgacagcugcaucugauuguggcuccuaauucuuuguaggauguuaccccacaaaauuuccuugcuguguugagaggcgaugcagaagcagugaagggcauaggauccggcaaaguccugaagagguaaugucuguuuacggauacuacacuucucucaauggcuugggacccccguauagagaauugaaacagguguuguucugugccccuagccuguuuaccugugagaaauuacagaguggagaguuuuguucugacuuaggacaggugcuuagggcuguuguuucaguggcuucucuugguggcccauuucugcacugaauucaccuuaugauccagggccccucauuauuaauaaaauguuccuaucacuuaaacuccucguuccuugucuggggaucauagcacagggaugucccacugccagcggagccccugaggcaggugugaaucugaaucccugugcccagauugcagggccaccagcccugugcucugaucacagaucagcccagcggggagaggcacauucguaagucccuucauauuggaggaaguggacuuucauauuggggaacacgaaccccagugcuuacccccacuggcugugggcuagagaugucuuguuguuuaguaauugcucauguggcauuuuuaugugaugccagagauucuaguagcauauuucuuuuaagcuggaagggaggccugggcacaaguaagcucguguggauuagugcagaggcuggguacaguggcucacgccuguaaucccagcacuuugggaggccaaggugggcggaucacuugagaucaggaguugaagaccagccuggccaacaugaugaaaccccaucucuacuaaaaauacaaaaauuagccaggcgugguggcaugcaccuguaaucccagcuacucugguggcugaaggagaauugcuugaauccaggagguggagguugcagugaggcaagauugugccacuguacuccagccugagugacagagugagacucugucucaaacacacacacacacacacacccacccugaccaacagugugaauccccgucucuacuaaaaauacaaaaauuaaccaggcgugguggcgugugccuauaaucccagcuacucgggaggcugaggcaggagaacugcuuuaaccugggaggcggaaguuacagugagcugagaucaugccauugcacuccagccugggcgacagggcaagacuccaucucaaaaaaaaaaaaaaaaaaaaaauuaguauggagauggacaucugugagggugaaccaaauuggcuucauguaaguuacuacaucucugccacuuugaagcagcgccaucugguggaagcccuggugaggcagguaggugggcauccagacugugggccacaggaggccuggagggggggaggcugcaggccuguguugaggucauuuuggggagaucugguuggagaguguggcugccugggaugaggcccaauugccaaaggaccccacuauccaccucacaccaggucugucugauggguugcccaggaaaggccccuccuccuuuccagccguaguucagaauuuggaggcucuaggaucuauacugugguucagaaucacaccaaggggaguggaggggacaggccagacaccgggcaccgggcccuuguguucaucuucaaaccugguugggcaacucuacuccccaaacuucuuaauuuuuugauuagggcagcuuuucagagaaauagaaguaaaaacagaaaaaggaaaugauugacccccgauuccuucuuggcaguggcccccaggaucacguguucauuuacuucacugaccauggaucuacuggaauacugguuuuucccaaugaagaugugaguuuucuuaacguuuuaaggacaaacuagcagaacagaaaagcaagccuaggugucgagauuaaacccauagcguguauuuucuaguguccugccaggguugguuuguacguguggugggugggagugggggacagguuuagcagcuugaaaucuauccaaggacaucucuuccagacaguuuucccugcuuuucuguucaugucgcagcgucgguagcugucucaggauguggguguaucacacuagaccugagaauagaccaaaagcuccggacaaaguaaugggugaagagguacauccucuugcccuuuuuaaaugcgugcauaaaacaugugacgacauucugggguuauguucuucaccaugauuacuucuagggauugguagaaaagaguuuaugaaggaucaucagaacuuuacuaguggcuuauccagcaaauaguuucucuugauguguuggucugacaauauucucaccuuucagcuucauguaaaggaccugaaugagaccauccauuacauguacaaacacaaaauguaccgaaagguaauucagcccuuggggcagccuugugggggcggggggugugaggaaagccgugagugcagagcccacagucccgugaccguccuccaacugugggugcuguguuuucuagaaaggggauccuuccaaucccugguuucccaggaugaggcuuucggcuuuagcuauuagacuggaaucauggagagcuuguuaaaacagugugggccucgcccccagaguuugacccaguaggucugcggagggggccugagaauuugccuuggguuuccaugugauccugcugcugcuggucuucggcccacacuuugcagacuccuauuccuaggacuguccucaauuucgggcagcuggggaggaaaauaccacuaucuuauucucacuuugagccuuucucaccccuauagcacccuuuauggaaacugugcagggccagaguuuuuggcugggugugguggcucacuccuguagucccagcacuuuaggaggcugaggcgggaagaucacuugaggccaggaguuuaagaccagccugggcaacauagugagaccgugucucuacuaaaaaaacaaaaaaacaaaacaaaaaaaaaccugcauggguugggugauacgugacaguaacgcagaaagauggccugcugcacuguauggucuuugaaacuccucccugcacuggaugguggaaccguuuuccuuagcaucccauggcuccguuuucucugcauuauuucagcuacuagacgauuuuauuccauuagcaaugaauaaauuuguguggcagcagcuuccauagcuucuggcagcagccucuuuacagcaguaaugucuccagaagcaagccuggaggacuuguuaggaauggguagagagagugggcagagcuccaguagcauggcuggaggcccguaccuggauggggugagcucaccugccccgucugccucacagaugguguucuacauugaagccugugagucuggguccaugaugaaccaccugccggauaacaucaaugguaggugguuggggcgccggccucgaccugggcuggcaagcagguugcucagacaccgcugacauggaacugagcauucuccguaagcaggggcugcugagggcagccugggccauagaaguggggagauacuugcagguagcucugggcuuccucugcuucugaagcacugguagucagggaauaaagaaucuguaugugagccucacagugcucuuccagguucucguaaaacuacugaagcuaaaacuacaugggcuuuggacuagccuccauccuuugcaauguguugguugcacucugaccucaaagcaggugacugacucucuuugacccucaguuauccccaucuguaaaauggggauaaagauagugugugucuguugggagacuuguauuuuaaacacuagcauuuguccagcacaauucuaagcccaugguagagagauaguaagugguagcuuuuguauagguucaguuaaucuagauguuucuucaauaaaugucagaucucucuggaaaccaaaguaagcccauauuguucaaguuuccugugcuguggaaaugucagcauucuuccagaauagcaugauguccuaagcaugccaauuugccaauugcugcaaaaaacauccaccagcuggcuccucuuucuuccgcauuuaauuuuagaugaguuauuguaaucgaauacacaagucuggguauaguuacgugucccugcccuccuguguggaucauaaguagcaugcuucgauuucaccgggggagaaagaaggacucaagcuucaagcguaauccaaggcaggaauaaaaugcaacuaaaagaucaucuuuaauuccucguaguuuaugcaacuacugcugccaaccccagagagucguccuacgccuguuacuaugaugagaagagguccacguaccugggggacugguacagcgucaacuggauggaagauucggacguggugagcccuuugggggcuggcuguucagcugggguuuaaccgucagacucugauugucaaaggucucuaauggucucacuuuuugcaggaagaucugacuaaagagacccugcacaagcaguaccaccugguaaaaucgcacaccaacaccagccacgucaugcaguauggaaacaaagugagucgggagccucgcgugcuggcccucuguuccuuguguccuagguggacuugccuggaauauugaucucuugcuaaagagacaugggaucugagugaggaaugcuugaggcagggaugccucugccucucaugccacuccauccuggggaccugugggcuuuggaaucagaccuuucuagguucaaacuugcagaguugugagacuuugggcaagugauuucacuucugugaauuuguuuucucauugguugaaacccaagcguacaagguagcuaggagcaugcaagagggcuaugcguuacuuaugcuaaacacaggccuagugugcagcaagggaucacugacucaaaagcugcugcuuuacgguuuguagauugucccacagccacucugcaccuuggauuuucugggguccugccccuuugcaaauggcagguuguuaccuuuacccuuuggcuauaaauuggagacauuuuauccuccuccaaauauguccagaagggaccugugugguuaaaugguguugcaguaaguggcugcuaaaagcuugggcccuaagugaagcugcuggggcuagcguuugggaugugcaaacaccguaacaaaugugcagggccucccaauuguucaccaucccccaagaagcccacccccagcggagagcucgccagcugagaucuguuccuugggcacaaacguuggccuucuagaagaaacuggagucaguaaauccagccaugguuagcccuucagcagggcaugggaugggggacaugagaccugcacccagggcacaaugaccuggucaggcuuuugagcagguguaggagagaguuggagcagagggacggccagggaaaggugacacggagaaggcagggucagugguggcauagcccuggccaugugggggccccgccuugggcuuuccguucucuucacaguguccucaucauuggccauuucugaucuugguugaggaguugugguggaucuucuccaaacucuguguuuuuauauagauuggugugugugguauugcugauuuuagaacuguuguuagauuauuguugcuugcuuuaggaagagaacgcuugcagcauuuucccuucugauugggagccagucuguagugaccgcuacagccaaaucgagccuggccgcugugcccauuugguagcucuugaugccaagcaucagccuggccucucuguggccuuagcucugcccuucccaguggacccagacuucagcucuaaccugggcagaugcuuuguaccuucccacuacugguccuuagggacuugcaggugagugcgggggagugagcacauacaggucacccgccuggauaggcggcauccuuugcaggugacauucuuugccuggcauccuuugcagcagaacugcuauucuuuuacauaugaagggcacugcugaugcagucaggcagagcuuggaccagagcugucuggugaaagaauagcaguucugcaaaggaugccaggcauuuugagucacucacugguagauuucaggggcucccgugcauugccugcguacugcuggggugaccaugccuuucagacugugacuguggcccugugguccugaaagcaugaggaguaaaugugagccucugagggagaggcuggacuugggguauguugggcaccucugcuccucccacucaaaccagcucucucucucccucucucucuggccuucucucacucucucucgcuuucucucucgcucucucuugcugucugucuccccagacaaucuccaccaugaaagugaugcaguuucaggguaugaaacgcaaagccaguucucccgucccccuaccuccagucacacaccuugaccucacccccagcccugaugugccucucaccaucaugaaaaggaaacugaugaacaccaaugaucuggaggaguccaggcagcucacggaggagauccagcggcaucuggaugugaguaguggugaaaggagcugugcccaggugcuguccccagcccaggugggcagcaugcaugagcacggcccugccuccuaugcucccugccacacaggaguauggggggacagaagccagccuuuguccuccauguaacggaagcgggugggcggagccgugguugccucccaucuucaugaguaaacuaaccuugaccucuucgguaguagggagcaguggaaugggggccuaucuccccuguaucguaccaagaagccauguacauggguguuucccucuuuuauaccuuguugcuuagaggauauuuuuauuuuguugcuuauuaaguuauuagcuaaucauauucauuuuaaaaauccagagacagguacgguggcgugcgccucuagucccagcuacuuagggggcugaggcaggaggauuccuugagucugggacuuugaggucagcuugggcaaccuagcaaaaccccuucucuuaaaaaaaaaaaaaauccaauccacaaaaauuucugcuguucucagaaaaacauagucaugccuaaaauucuuucuaaaaugcuuaugccguccuuuccaaucagugagucuguuuucaguagcucaucaguguguuuggagcuggcagaauugcuauguaaauuacagcugugugcucaccggaaugcugggcagagggcugccugucccuucccacaaagccaacucuguuagcccuuauccccauugucagcacagcacagugauggaugugcugaaauauggccugaguuuucuaggcaagauuuuuuuuuuuuuuuuuuuuuuuuugagacaagagucuugcucugucgccaggcuggaaugcaguggugugaucucggcucacugcaaccuccgccuccuggguuuaagagauuccccugccucagccucccaaguagcugggauuacaggcaugugccaccaugccccaguuaauuuuuguauuuuuaguagagaugggguuucaccauguuggucaggcuggucucgaacuccugaccucaggugauccacccgucuaggcaagauucuuuuuuuaaaucaaugugguuuguuuuaaaugcacauaucuaguuaucuccaaaauuggugcccugugugugaaaaacguauuaaccaggacauauuuuuaguuggugucaaacgcaguauagcacaguagugcucagacauuuuagucuugggccucuuuauuuauuaauuuuuuuguagagcuggggugucacuauguugcccaggcuggucucaaacuccugagcucaagugaucuucccaccugggcccugaaagugcugggauuacaggagugggccacugcacccggccaaaccucuuuauacucuuuaaauuauugaucccaaagagcuuuuguucaugguggguuaugucuauugauauuuauugcauuaaauuaagaugagaugaaaggacauuuuugauaguucacagaaagugaaccagagguuuuuuggugauuuuuuuuuuuuuuuugagauggaguucugcucuugcugcccaggcuggaguacaauggcaugaucucagcucacugcaaccucugccucccggguucaagcgauucuccugccucagccucccgaguagcugggauuacaggcacccgucaccacgccuggcuaauuuuguauuuuuaguagagacgggguuucaccacguuggccagacuggucucaaacuccuggccucaagugauccaccugcaucagccucccaaaguucugggauuacaggcgugaggcaccgcaccuggcucagaguuuucuuguguuugcuuaaacagcuguguaaaucauauaggacuucuuugguaucugcugcaaauuugaaaacuauuuccaagacuguuuaacuauugcauaauuauacuuuuauguaaaguaaaagauuaugaaaaaauuaaaacuaagauuuaaaaauauuuaacucauuuacaaauaacaauauucuuaacaaauaacauuuuacacuaauauauuuucuaugagaaauaaccauuuuccaaaacaaaaagcauugggugagaagaguggcauugcuuuacaugugggaguaucucuuuuguguccggcauugcuagacgacagcuggauccuugaacuggcuucugcuuucgccgucgggcgcuguucuuucggcugaaguguaagaagaaaauccagccuuguaaagauacagaguugaggaagggaagaccuucuggagccugagagcucuuggggagucugugguucuggaccacgccuggagaacugcuggucuaacacacaguggguggagggucuuuguggaauucagauaugaagcaagcaaacccuggcuggagagcggguaggacagagcuugcuuguagagugaagguuuuuuuuuuuuuuaguuuuuugauuuuuauuuuaauagaggcagggucuuccuguguugcccaggccggucuggaacugcuggccucaagugauccuccugccucggccuccuaaaaguacugggaguacaggccugagccacugugccuggccagagugaggguaguguagaagcauuuucuucuuuaugaugcuguuuuucauugucuggaaagaaaauaaaagucccucugugcccugcuguguaaccauucaauaguuuccugaaugggcagaggugcccguggacacagcacccucacggcacagucgucugcuuuggggcacagguucugccaccuccuuucuccacagcaaagguuguuuuuugauacaaauguuugcaucaugccagaagauccccaaaaggcaggucuuucugaccgucgcacaagugggcacagacaucucucgccuuucucggagcacauugauuguuauuuccucuaaccugcgggaggcugagggcuguguggagaguagccuuugaaugcacuucucaccgcaccugggucccugagagaccgcauucagggaggcacauucugacaggccgcguuucuccccaggccaggcaccucauugagaagucagugcguaagaucgucuccuugcuggcagcguccgaggcugagguggagcagcuccuguccgagagagccccgcucacggggcacagcugcuacccagaggcccugcugcacuuccggacccacugcuucaacuggcacucccccacggugagccagcaggcucuccccaugaccagaauccagaagcugaauucauauuguccccuggcagucacauugguuguacgaccuuauagaagguuccauccaggcugagaaacagugggcucauuucagagaggaagaagguuguccaaauucacuaauuuuaaaucuuggccccagaacacucuucuugucccaguggguaggagaguuuaccagagccauagaugacagcucucacuucuaguuugaagaacaguuacuuguguucacacuucugcugucccugccaaaccccacccucgucucuaccccucacacgagccacacacaucuucucccuucugagucuguucugaccucuucccaagacaguugaagucagguguggcccauggagaaguacugaguuucugcagauguagaauuggaaggcaccugaaaagccuccuggucaguagcauguggugcuucaauccuucuagagaaagguuggcaaacuggccuacaggucuguuucucccccauaaccuguuuuuguaaauaaaguuuuauuggggccgggcaugguggcucaugucugcaaucccagcacguugggaggccaagguggguggcucaccugaagucaggaguuccagaccagccuggccaacaugguaagaccucaucucuacuaaauauaccaaaauuagccagacuugguggugcacgcccguaaucccaacuacucgggaggcugaggcaggagaaucgcuugaaccagggagguggagguugcaaugagccgagauugugccacuauacuccagccugggcgacagagugaaacucugucuccaaaaaaaaguuuuauuggaacauagccacauccugcucaguucccuguugucccugucccuggcuucuuucacacuggggcagaguuaagguagcucgacuuuaccccuccagucuuguuuuuuuuguuuguuuguuuguuuuagacacaguuuugcucuuguugcccaggcuagagugcaguggugugaucucagcucacugcaaccucugccuccuggguucaagcaauucuccugccucagccucccgaguagcugggauuacaggcacgcgccaccacaccuggcuaauuuucguauuuuuaguagagacaggguuucaccauguuguccaggcugguccugaacuucuggccucaggugacccaccugccucggccucccacagugcugggauuacaagcaugagccaccgcacccggcccagucuuggucuuuugaccuuuggagucaugcacagugaaccucuuccuuuguucucagagaguucuuggguuccccugaaguuuguuucaagauaaacauccccgcugcuucacccuucccuggugugauccagcguggcuuucacacgccguccaucucccucgcuggcgugucccucccagaaucaaaaggcagacuucccggggagaucccaggccauggcggggagcagagccaucgggaguucccugucaggaguccugcccucagauuugagagugcagaaccccgccagccccccaacuugcaugcaaacccuggcaugugugccucuuuccugagggaucguccauaaauaucaccagauuaucuaaagguugggaaaggauccaugaaccaaaauagggcaagagccacuggucaagaugcuuccccucugcaauugcaaaaguggaguggauuguguggugagaugaggaaguuucauucuucucguuuguuuucucccaguacgaguaugcguugagacauuuguacgugcuggucaaccuuugugagaagccguauccgcuucacagguaacuaaugcagcggugacgcuugaaaggucgaugucauucugaaagcagaaggggcugccauccucuucugcaagugggcauuuucacuucugccaggagcucccuccagcuuuccucuacagccauuugucagcaggguccagaagccacguucucagugacagcugcugggcgggccugucauaacugccugccugccgcauguggguuugcguuugucugccuuucuucagaguugacacgguucaccaaguucuccuuccugucucucgcaggauaaaauuguccauggaccacgugugccuuggucacuacugaagagcugccuccuggaagcuuuuccaagugugagcgccccaccgacugugugcugaucagagacuggagagguggagugagaagucuccgcugcucgggcccuccuggggagcccccgcuccagggcucgcuccaggaccuucuucacaagaugacuugcucgcuguuaccugcuuccccagucuuuucugaaaaacuacaaauuagggugggaaaagcucuguauugagaagggucauauuugcuuucuaggagguuuguuguuuugccuguuaguuuugaggagcaggaagcucaugggggcuucuguagccccucucaaaaggagucuuuauucugagaauuugaagcugaaaccucuuuaaaucuucagaaugauuuuauugaagagggccgcaagccccaaauggaaaacuguuuuuagaaaauaugaugauuuuugauugcuuuuguauuuaauucugcagguguucaagucuuaaaaaauaaagauuuauaacagaacccaaaua

SEQ ID NO: 192384 - RNA, 22161 nt, Homo sapiens
uauuuuguauugguuuuauuuaaauuuuacagaaaccugaucagaguuaaguauguaauuauaaguccaguaacaauuucuacaaaaaugcacauacaaugccagaacuccuuaaaagcaacuaauaucauauuuguguuuugcauaaaacaugcauuaauauguuggccaaaaucagucucuacaagaagagacaguccaauacagucaauaagaaaacuaguugugaacaacagguaaaaaaagagguuuccaguuaaugugaaagaaggaauaguaccuuucauaaaacaagcccuucagcgcugaguuaacugaucgguacuauugugcugcacguaauguaacacaucaccuccaagacuugguccugauuggucauaggaaguaagggacuuucugguaguuacaucagauauuugagaagauuaaaaguuuuccggacaugaugguauacuaauagugcaaccuugcaaaaaggguucgaaacauugucagacuuggaagaguuccccagcuugauaaacaaccucaaagacaccccgagccuuugaacggagcccucugcacaaggccagcucagggcucaccagcauguccuguggccacaagaccuuccagcuccacauaccacccuucgugaggaucugcaauuaggagccugagugccgaagaacaugguugugccauuucuuugaggcuuugacuuuuuauaaggccuaguucaucucauccagggauugggcacucgaaugaauacacagaugcuggacacauaaggaguauuaauauacaugguggccccacagccugaaaugcuuuuauuaacauacaucaaggugugucuccgacugucaggaaagaccuugguccuccagaggcagagagaagcugaggguucucuauguaucacaaggcauuuccuacauagacugagggguguuaaagagaucucauaucaacugaaaggacuuccccucaaauguggggcucuguacaaccuuccaugaggaucuucaaaaaaaagaucucauagucguuagggaaguggcgguggacauuaacauuauauacacaaaacucaucauucgugcagccucgggccuuguuuguaaucucuuccacagucugucucuuccaaaacagggcucccugcccugcuuauuucaaguaagcuaagucaggaucuguuuucuuuagcagauucaagggggaaaaauaauaauuuauugggguucuaauaacauuuucauaacagaauaucaaaauagguccauuuuugauauaugcuuaugaauaucccugauaauaucaagaaauccagaggacuucguaaaccaccaagauuucacaggggugagacccggucuguuuucuaggcagcagagaagggacuaguauacgggcaaauguucuccaggaagcccugugagcacuacaguacugaaauucuaauucuagugccaauagaaucaugaacgaaaauuucacuugaacuguauuaguaaaauucauaacaaaggcuugcuuccucaacccugucaucuguuaaucucuccgccugugacagacauccagaccagaaaaccaucaguccuggcuacucuggagguugggccuagagaaaacaagccccaagauccuuucuaagcuaugaccaaaccucagaaaacagggacgugaaagaaggagcagaccaggcuugaggaagcuuugacccaaggcaccacgaucauaggggcgaggggaccuguagagguucuaggugacgggaagagagccuuccgugaugccugcggaggagguucuggaaggcaacagcucuguggcaaaacacacacaucugggagugaaauaacagaucauuaaacaagacaccaauuugcuuucucaaaacaaaaucaaacuuaaaaacuaugcaaauaacccugggugcacuggaguaggaguacacuggagaagucuguggaaugagcugcaucagcugagucacagaggacgcuggcugugaagucagcauccacacgguggcuacugcagcuaaagagaaugaagggagcgcgaggccucuccaaacagaggaggacggaaagggggccaaaugugaaccacaccucuuuuauuccaagaaugggaagcgcauuuucauuggcuugaaugagaaagcuucauacuccacucuagcugcaguaauacugcaucccauccacucuucuucucuuuuuugacugaaacucuucaaagaacugcugaauguccucucucuuaacaaccuguuuuugaaaagcaaagauuaugaaagagaacuaaguaacagaaucgcaauccgaggucauagcauucacaaacaagucaaaugauacuguuaagaauuauguuaaugauaacaucuccauuuucuauuuuuuuuuuuuuuuuuuuuugagauggagugucgcucugucacccaggcuggagugcaguggcacgaucucggcucacugcaagcucugccucccggguuaacaccauucuccugccucagccucccgaguagcugggacuacaggcgcccgccaccaagcccggcuaauuuuuuuuuguauuuuuaguagagacgggguuucaccguguuagccaggauggucucgaucuccugaccucaugauccgccugccucggccucccaaagugcugggauuacaggcgugagccaccgugcccagccuacgccuggcuaauuuuuaaauuuuguguagauacgaggucucacuauauuauccaugcuggucucaaacuucugagcucaagugauccucccgcuuccucccagaaugcugggauuacaggugugagccaugacacccagcauguuuauuuuuuacugagguaacacaugcuuauuguuaagaaagaaggacagugagacaaggaaagugaaggaaagagaaagaaaaauagagcacgugaaugaauucgagcaaaaagggaaagagauaaagagaaaguaagaaagagggguauaaagugaaaacuucccucucauucccuaguaaguguggcuaccauacucaaaagagcaacuuggaauaaugcuaacuuggaauaauuuucucagaccaguagcugauacaccaguuucauaagcaccaacaguaauacugcugcucaaccagugaggaauccaaaccccuaacagauucaggaugcagaggcugaacacauccugaaaugacugcagcucaaaauucuaauguacuuggcuaaauggcacgggaauuuacacuuaacaaaaugcuaauaaauaggauacuugcaaguugcaaaaugaaggaucugucccuacccuggauuacaaacauuagccacagaaagcccguaaguaaaaggaaauaucucuagcaaggauacuguaggaggagaccuaacaacacacaaaugagacugugcagcuuuugguuucuggauauccucaaauggucacagcuaacgugcagaguagaaacgcuagugaauaaauacuuggguucaauaacaaaucaguuuuuuaauuuauuucagaaaauguguaguuucuaaguuuauuaauuauuauugcuuuuuagagacagggucucgcucugucacccaggcuggaguacagaggugugaugauagcucauuggagccucaaauuccugggcucaagcgauccuccgaucucagccucccaaguagcugggaccacaggcacacgucaccaugccagccuaauuuuuuuuuuuuuuuuuuuuguagaggcggggucucaucaucuugcccaggcuagucuugaacuccugagcucaagcaauccucccaccuuagccucccaaagugcugggauuccaggcaugagacacugcacccagucuaagugguuuuuuuuuugguuuuuguuuuuguuuuguuagauacaaacauuaaauaaaaggcaguccaccaucuaagaacagcuagaacuuauuaacauuaucccuauggacaaauacaaccaaagcagauaagcuuuauggcaaccugagguuuuguuucuuuuucugugaagaucugguuaguaaugucauggaacaaacaacaaaaauaccacauuuuucugaccuuuuaaauuaucuggucagauaaaaaauucucuccuaaagacuccuaaagaguggcgcuagugauaacaaggacccggauguugaagauaccugugaagaccuugaguaaaagucuccaaugugcaugaaaaagaacaugccuaacuuuuuucuuuuauguaauuuuaaguauauguuugugauaaaauaaagaaaaccgaccacaaaagaguggaggugcaacagcaccagcaucaagagggcaugccugcacacuauuugaaacaccucaaauguccauugacaguucagagguuaccacacugaggcagagugccccauuacacccaugaacauucuuaguucuagcaccaaagaagcuugagucuguauuaaccagaggauagucucugcaacagaaacaagaauaacuacauuaaguuuuaagaacuguagggaaggccgggcgagguggcucaugccuguaaucccagcacuuugggaggccaaggugggcggaucacaaggucaggaaaucgagaccauccuggcuaacacggugaaaccccgucucuacuaaaaauacaaaacauuagccgggcgugguggcgggugccuguaguccagcuacuugggaggcugaggcaggagaaugacaugaaccugggaggcacagguugcagugagccgagaucacgccacugcccuccaaccuaggcgacagagcaagacuccaucucaaaaaaaaaaaaaaaaaaaaaaaagaacuguaaggaaguaggaauuguucucagugauagugaagaagucucuaaaaacugagaaaaccacuuagaagaaggcucuuuuaacuuuacaauucauuuugcagaaaggcagcaggcagcacugugacccuguccagaaauucaggcaguuaaauguucuucccacaucuaugacaaagaaaaaaacgaccuaaccuuuugcgggugguggcgagcgcggagaggacgccaugaaggccucgggcacacuaugagaguacaagguggugggucacugccugcccacccccaaaugccacacaccgccccucuaccacaugcgaaucuuugcgccuaaucacguugucgccaagucccgggacuucugguacuucguaucucaguuaaaaaagaugaagaagucuucaggggagauugucuacugugggcagguguuugagaaguccccaccgcgggucaagaacuucggcaucuggcugagcuaugacucccggagcggcgcccccaacauguaccgggaauaccgggaccugaccaccgcgggcgcuguuacccagugcuaccgagaggucuaugggcgccuggcaccgcaccugggcccauuccaucgagauccugaaggugaaggagaucgcagccagcaagugccgccagccggccggccaucaagcaguuccacgacuccaagaucaaguuucccgcugccccaccggguccugcccgucagcccaagccacgcuucaccaccaagaggcccaacacguucuucuaggggcagggcccucgcccgggugugccccaaauaaacucaggaacgccccccaccccaaaaaagaaaaaaaaggaaaaaaugaccuaaaguagguagacagagaugacaucuucuaagaaagcagggcucaagccagccucccaaguagcugaaacuacagguacaagccgccaugcccaguucuuuuuuuuuuuuuuuuuuuugagauggagucuugcucugucacccaggcuggagugcaauagcacaaucuuggcucacugcaaccuccaccugugggguucaagcguuucuccugccucagccucggaguagcugggauuacaggcacccgcccucauacccagcuaauuuguguauuuuuguagagacaagguuucaccauguuggccaggcuggucuugaacuccugaccucaggugauccacccaccucagccuccuaaagugcugggauuaaggcgugagccacugcacccggccaccaugcccaguuucuauucuaaaccauggaacuuagaauuccagaaacugggucugguguuaauuuuuccuguccagucauuuuccccuccccgucccaaagauccaugcuucaaggucaggaccagcagaaucaguacugcggauuccuuccaaugaccuucugcuaagcuacaaguacucucucagaggcugugggacugcgcccucccaucauucuucccggcuuagcugggguugguaaggacugccaauguaacucugauguuucacuaccucuuauucauuccccuuagccugccaauuugcucaaaacagucccugaauucaacucucaaguacccacuuaagucgcagucauuuuuuuuuuuuugaaauagggucuugcucugucgcccaggcuggggugcaguggcguguucucggcucacuacaaccuccgccuccuggguucaagugagucuccugccucagccucccuaguagcugggacuacaggcgcccaucaccacgccuggcuaauuuucguauuuuuaguagagaugggguuucaccauauuggcuaggcuggucuugaacuccugaccuugugauccacccacauuggccucccaaaguacugggauuacaggugugagccaccgcaccccgccagucgcagucauuuuuaaucgucaaaggaaauaaacccuucauucaaaacuuacagggcuaugauuagaauucuuuaacucaacauaccgugccuucaucagcaaaucucuugagauagucuuuaaguucagucuucaaaucauuguauucuaaaucaaaaccacaaaaguauuuaaguuuagauaaaccauuugcuuucaaaaacaaaauauucuuugccauugacaccugagucuguuaauaauguagucuaaauaaaaauuuucuuaagugaaagcugcauagaaacucguucccaaauuaucuguacgucuaccauguugauaugagacccuuuuucauuaaaaaaaaaaaaagcaaaauuuuuuaaaaagcauaaaaagcagagauauccuaaucccauaaagauuaagaauuuuuaaaagggcuuccuauuucucuggaauucugguagcugaaauaaccuuggacuuguugaauauuuaauuuaauuuaauuuauuuuauuuuuugagauggagucucacucugucacccaggcuggaaugcaguggcacgaucucggcucacugcaaccuccgccucccgaguagcugggacuacaggcacgcgccaccaugccuggcuacuuuuuuauauuuuuaguagagacaggguuucaccacgucagccaggcuggucuugaacuccugaccucaggugauccaccugccuuggccucccaaagugcugggauuacaggcgugagccauggcgcccagcccaagcaaacugacucacuuaacaguuuauauuauguacaagguaccuugagggcuacaaguaucuuuuaggugcauccucuauccuugaaaaguuuuuacucuaauaaaggcaaaaagaaauuaauaauuauaaauaaaagacacggccaggugcaguggcuugcaccuguaaucccagcacuuugggaggcugaggcagguggaucaccucagcucgggaguucgagaccagccugggugacauggugaaacccugacucuacuaaaaauacaaaaauuaguggggacugggcaugguggcucaugccuguaaucccaguacuuugggaggccaaggcagguagaucaccugaggucagaaguucgaaaccagcuuggccaacaugguaaaaccuugucucuacuaaaaauacaaaguaaauuagccaagcaugguggcaggugccuguaaucccagcuacuugggaggcugaggcaggagaaucacuugaaccugggaggcagagguugcagugagccgagaucgcgccacugcacuccagccugggugacagagugagacuccaucucaaaaaaaaaaaaaaaauugggggggcgcaguggcaugcgucuguggucacagcuacuugagagacugaggcaggagaaucacuugagccugggcagcagagguugcagugagcugagaaugcaccauugcacuccagccugggcaacagagcaagacccugucucaaaauaaauaaauaaauaauaaaagacagaaaugacugaugcuauaaaagucacauaaaagugguggcauccaaguggaaauggcugggauagaaaccacugaaauaaguuuggccugcugcagcuggguggugguggggggauguaaaagccuucaaucaaggguuuggggguauuuucuccucuagugguuuccugugaaccacugaagcaaccucaagaacugucaaaauggugacaugccuugcucaagaacaugacacauaauguccaaaaauuguuucaauggauggaaaauuugcauucauccaucuacccuuaaucagaauagcauauguugugguuucucaagcauguaauuauucuagcauguaacucugauucaaugguaaaagcagcugaauacccaccaauaugaaaaucaagcaauggucuaaaauucaaaauuuuaauucuuuguauuaaauuaaaaauauagguguuuacugcccccuuuauauuuuuuuacauagugaaggaaaugaugaauuuucacacacacacaguauuuaccacaaaugaguuccacuugcuggacucuauucaugcugcuaaggguauccauuaggggaucgcuccugucaguggccugggcaaucuucccuuuguuuucauaagccagaacugugucguauucaucugucaggaauaagacaucuagaucuccauacauuuucuuuagggaaaaaaaaaaaaaaaaaagaaagaggaguuuccccauuagaacuguuuaucauucucagaaagccaauuuccugagaaucacuaaaaauguaauuuuuuuauauuaagaccuagaaaaacuggagcgucuuuaacacagaauugcuagaaggauuuauucuuuuugccuaaauuucuuucagaaaucucccaauuucccagaugucauauggucuaugagaucuuuauuuaaaaaccauugauuuacuguuaacuuuuuuuuuuuuugagauggaguuucacucguugcccaggcuggagugcaauggcaugaucucgacucauugcaaccuccgccuucuggguucaagcgauucuccugccuuggccucccaaggagcugggauuacaggcaugugccaccacacccagcuaauuuuguauuuuuaguacagacaggauuucaccauguuggucaggcuggucucgaacuccugaccucaggugaucgagaccuaacuuggccucccagagugcugggauuacaggcgugagccaaagcaccuggccaauuuacuauaacuuucaaccaguguuuccaagcaacuuugauauaacaaagauaaguaaacuaaaauuaaaauaaguaaauuuaaaauacugcauaauuauccauuucuuccacaaacauuccaacuguaaguacuaugucauaaauuugcuuaauguaaaaauuuggagggucuccuaaacauuaauuucauaaauauauuguucagguguucuuuuuauuuuccuuucuuccucugguacaaaaauugaauguuuuccccagguguucuuauuuuggggcaccaguacacaaaacaugcuaacacugagcacaaucagauacuuuaccauacagucuuggcagguacacaacuugcuacgccaguucaggggccaauagguggcagugucuuucuuuauaagcugcuuagcuuuaagcuccugaaguuugcagccagauuuugauucugcguugaggcuuucauucuuaaacacugucugaaauaaaauuaaguuuugaagcauguuuuuuaaacuaccauaguuuucauaguuuagauuuuguaaagagauuucuuuaggcaaaggauaaaauugaaauccaaagccauaaguuuacagaauuaauuccacuucaguuuucuuuuuuuuuuuugagacggaaucucauucuguugcccaggcuagagugcaguggcaugaucucggaucacuguaaccuccgccuccuggguucaagcaauucuccugccucagccuccugaguagcugggauuacaggcaugugccaccaugccuggcuaguuuuuguaauuuuaguagagaugagguuuacccauguugccaaggcuggucucaaacccgugaccucaggugauccgccaccucagccucccaaagugcugggauuaugggcaugagccaccgcgccuggcccagucuuauuucuugauggcucguacuucacacauuaccuggagaucagauucagaacuagagccggcacaugguucacuguucugcucuacuuuaaccucccggacaucauccuuucccuguucuggaacauccucuuugaggguacuaucuugaugcucuccauuuucagguuugauaacuuccugaucaccuauuccaucaauguuccgcaccaauccaucauccucaguggauauuuugguuacugugaguucaaagaaaaagaaaaacacauacacacauauccacugaccuaacggacaauaaaaucccaacagacaauaaaaucacuuauucuauuauuauuauuuuuuuuuuuuacagacagagucucacucugucguccacacuggagugcaguggcauggucuugacucacugcaaccucugucucccagguucaagcaauucucaugccucagccacccgaguagcugggacuacaggugcgugccaccaugacuggcuaauuuuuuguauuuuuaguagagacgggguuucgccauguuggccaggcuggucuugaacuccugaugucaagugaucugccugccucagccucccaaagugcugggauuacaggugugagccaccacaucaggcauacaauagcuuuugcuauuuuuuuuuuuuuuuugagauagaguuucgcucuuguugcccaggcuggagugcaauggcgugaucuuggcucauugcaacccccaccuccuggguucaggcaauucuccugccucagcccccugaguagcugggauuacaggcaugcaccagcaugccuggcuauuuuuuauuuuuaguagagaugggguuucuccauguuggucaggcuggucuggaacuccugaccucaggugauccaccugccucggccucccaaagugcugggauuacaggcaugagccaccacaucugaccuaaaaucacuuuuucugauauuaaaauauuucagaaucuggaaaaagagauuaguccaccguagucuccgaaauacugagaaagaaaauuccaacgcuucuuuagguuaugucugccuaacccaaagaauucaaauaauuaaacaguuuauuugaaaauaucaaucacugcuuaagcacuuuacacauaaaggagaaaauauuguacuguacuuguuagagacagaauaauacaagaagcaggaggaagagauugaauuguaaacacagacagaaggguaauuuuuuaaaaacagcuuuucuuuaugggaggaagaaauaaaaaaaaugauggguguaguggcagauauacucugagacagagaagagaaacgauaggggagcucacauuggaugccagcauuucaauguaauaggagaugaagccaucugcugaugggagaggaaaugaagggagaggcaggagaucaauuuaaaaaacccaauuaagcuggguaugguagcucacaccuguaaucacagcacucugggaggccaagguggguggaucaccugaggucaggaguucgagaccagccuggccaacauggugaaaccccuucucuacuaaaaauagaagaauuagcuaggcaugcuggugcaugccuguaaucccagcuacuugggaggcugaggcaggagaauugccugaacccaggaggcauagguuacagugagcagagauugugccacugcacuccagccugggcaacagagcaagauuccgucuugaaaaaacaaaaaaacccaaugaaugagaacuacacauagauagguucagcaucuguggacagugagagagaucacuggaaagggugugaacagaaagggagcagcacuuaagaacucugaggcaaacuggccgggcgugguggcucaugccuguaaucccagcacuuugggagaccgaggcggguggaucacuugacaucaggaguuugagaccagccuggccaacaugguaaaagccuugucucuacuaaaaauacaaaaauuugccaggugugguggcaugugccuguagucccagcuacucuggaagccgcgucacaagaaucgcuugaacccaggaggcaagguugaggugagccgagauagcaccacuguacuccagccuggauaacacagugagacucugucucaaaaaaaaaaaaaaggcagaaaaacaaaagaacucuaaggcaaaucuaaacuguaggaugagaucagagguauggcuaugcugcucaugguuuguauggugaacuggucucuaaagaugagaaaggcaagaaauuaugaagccuaagcagcagauaccaugaguaacugccaccuuaaaaauaaagaaauacauaaagcauuaccaauaagauaguuaaugccucaggaccauucauuaauuaguuguuuugauuuaauuucuuaguguauaauaaaagcaccagauagacugggcaugguggcucaugccuguaaucccagcagucugggaagccaagaugaguggaucacuugagcucaggaguucaagaccagccugggcaacauggugaaacacugucucuacagaaaauacaaaauuagcagggcaugguagugugugccuguaguccacuuuuauaaaggcacuaaucccauucacgagggcucugacuuauaaaagaggcccaagcgagcuuguuugccccuuuuaacagguacggacacguagaaggaucugucuaugaggaaugggcccucaaccaaacacugacucugcgggcaccugaauuuuggacuucccagucuccagaacugugagaaauaucugucuauuguuuauaaauuacccagccuaagguauuuuguuuuagcaccccagacagacuaagacaccaccuccuccccaacugauaccauguguuagaauuaacaacuuauuucaguucuauuuaucuuucaaaaucccauucaaaaacugccuccuccauucucuaacucuggucucaucaauacucugcaucauaucauuuaaguauaaauuuguuuuugguaguaucccaacaaaucuaugcaccuuguggagaaagaacacauacuauucuuuuuuuuuuuuuuuuuuuuugaggauggagucuuguucuauugcccaggcuggacugcagugacgugaucucggcucacugcaaccucugccuccuggguucaagugauucuccugccucagccucuggaguagcugggauuacaggcaagcgccgugacgccaggcuaauuuucauauuuuuaguagagaugggguuucgccauguuggccaggcuggucucgaacuccugaccucaggugauccaucugucuuguuggccucccaaagugcugggauuacaggcgugagccaccaugccuggccagaacauauacuauuuuauaaccacagagcccaguuaaaaauaguugcuaaaaauucugaauugaacauacaaauuucacaagcacaaguuuguggcacaccaacuucacaaagauaccuaccugccaauugugcagcauaagcccacaaaaaagaacaacguuucaugcaggccuggcauaccaucuccugaaaauccccacucucagggggaauggcaccaagaugcugugaauauagaacaccaaaaauuuucuugugauugccaaauuguccaaaaugcccauuauuuuauaaauacuguaauaauacacugaucauaucauuagaauuuauuuuuagaagacuaauuauaauguaaaauauaaccuuuaucuuuuugugacaacaaugguuucaaaagguggaacauuuuccuuacccuuccauggaaccagucuucacagacuacgcacuggaucaucucaucuggaaucuaacagagaaaagcaguuuguuaaggauuacauugaauucgggaacauggaaauaaccuggcacacaguaaaauaagauacuaaauauuuguucuacaugaacugguguuccaaaggcuuacauugagauaagcacuuuacaaacaaucucaaggcucuuucacauccauuacuuaauaucugauucucacaaaacuguguagacaaggagggcauucccauuuuauacaaaacucaggcccaggcaaguaaugugaauggaccagugcagacagugacaacugggacuuuuuaccacaccauccuuuaauacaauauucaguuguauuacuguauaaggauguucacuccagccuucuuuauaauauugaaaaauuagacaaugccuuucugcugcagaagaaccauccugccaaguacacugaaaaguaaauguuaugaaaaaccucgauagauaacuccucuaauuugaauaaauuaaauaauuaaaugcuggcccuaggaaaauaauauaccaaaggacauagacuauuuuggggaugauuuucuuuuacucccaggcucucauaacuguuaauuaacaucccaauguuguucuguccuuuuccuaucguaggcuucuuaaagggaauaaaaaagcacauauuguggaacaggaggagcuguaacacuuuaccacaugccuuaaaauauccaguuuuggcugggcgugguggcucacgccuauaaucccagcacuuuggaaggccaagguggguggaucgccugaggucagaaguuuaagacuagccuggccaacaugcugaaauccugucucuacuaaaaauacacaaauuagccgggcaugguggcgagugccuguaaucccagcuacucaggaggcugaggcagaagaaucgcuuggaccugggaggcagagguugcagugagcugagaucgcacuacuguacuccagccugggugacagagcgaaacuccgucuuaaaaaaaagaaaaaaaaaauccaguuuuaagguuuuauuuuuguuaacucaaagagacuuucaaucugucccucuauauaauuugguucaauaauuauaguuccaacgcaauuagaaagcaaggaagaaggcagaagacuaauaucucuaaagacaaaaaguacucuuucaaaucgguaaauacccagacaaaacccaaaccaaucaaaacauggacugaggauaugaaaggacaauucagagagaagguuauuauggauguccaaugaacuuaugaaaagaugcauaaccucacuuaucaucagggaaagaaaaaaaaauuuaagauacuauucuuuggcugggcgcgguggcucacgccuguaaucccagcacuuugggagcccgaggcaggcggaucaugaggucaggagauugagaccauccuggcuaacacggugaaacccugacucuacuaaaauuacaaaaaauuagcugggcgugguggcgggcaccuguagucccagcuacucaggaggcugaggcaggagaauggcaugaacccgggagguggaacuugcagugagccgagaucgcgccacugcauuccagccugggugacagagcgagacuccgucugaaaaaaaaaaugaaaaaaaagauacuauucuucauuuaucagaauggcaaaauuuucaagaacugguaauaugcaagguugacaaaaguguuggggaaaaaacacuaucauauacuguugcugguacaacuuuuuuggcagauaugaucacaauuuuauuuuauuauuuauuaugauuauuauuuuuugagacagggucucgcucugucacccaggcuggagugcagugccgcaaucccagcuuacugcaaccucugccccauggguucaagugauucuugugucucagccucccgcguagccaggacuacaggcauaagccacagugcccagccaaucacaauuuuaaaugccacaaauacacuuugauccgucaauuauaccgauccauucuacauaaauacuuggaguauacucaguuguauuacuguaugaggauguucacucuagcuuucuuuauaauauugaaaaauuacacaaugccauucugcuguagaagaacaaucagguugacuaacuuauggcauaugaaauuauaggauacucugcagcaguuagaaggggguaaguguguuuuguugacaugaaagaaugucuaugauauacuggugagaaaagccagcugcagaagugaguguacagaauuuucacuucuguuaauagaaaggaaacuacacauugaaacacacauucacucaaacacuucuaugugcacagaaaaaggacuaaaaauauacacaccaaaaguguuaacagugguuaugccugggagguaagaggugcagaagugaggaagaacucguuuugaauuuugcauauacuucucauugacguuuuuaagaggaugcuguuuguauaccccauuuuuuuccguaaagagacaaaagaaguugaaggucauuucuuagaaaguguuuggggacugggggaggcagucagggaaggagaggaagggaagaagcucuggcuuugggaaaguccucuccaauauuucauucuuaugauguaaaaaugaaaagaaugguugagauguguaccaauuauagauccaacccagauucauaagaaaagauaaaucuagagcccuuucaccaucccacacugccucuugaagagccagaggcucggauaugacaagcaguugaggaaucaaggcuagaggggacacacccccagguuuaacuuccaauucucuuaccucgucuucaggaucaggauaaggucucuugcaaaugcaguacaauccaaaaaaguugucauuguacuuauugccagaauuuaccuuugcuuuguccugaaauauaauauugauuucaauaauaauauggucuaauuuuaacuauaauuucacacauuauaaaauuuaugcauucaauacauuuccacauuauuucccccaagaggcugaucuuuaauuuucaaaguaggaaaaaaaaaacucacuaccacuaaagggauacuuuuuucaggacacagggaaaaaauaauuuuuuuuuguuuuuuuuugugguaauuaggagaaauuaaauacaccuauucaauaaaauggagauaaaaguuaaucauaaauauuaauuaucaaucuaugugaacugauauuggccuggaauuucaagguacuucuuuuuucuuuuugauagagauggggucucacuaugaugcccaggcuggucuggguucaagccauucucccaccuaggccucccaaaguguugggauuacagguaugagccaccacgcccagccuuauuuauugguuuuucuuuuucuuuuuuuuuugagauggagucucgcucugucgcccaggcuggagugcgguggcacaaucucggguaacugcaaccuccgccuccuggguucaagcgauucuccugccucagccucccaaguagcugggauuacaggcacgcaccaccaugcccagauaauuuuuuguauuuuuaguacggggggguuucaccaugauggccaagcugguuuugaacuccugaccucaagugauccaccugccucggccucccaaagugcuaggauuacaggugugagccaccgugcccggccuauuuauuguuuuuguuuguuuguuuugagauggagucuugcucuguugccagcuggagugcaguggcgcaaucucggcucacugcaaccuccgccuccuggguucaagcaauucuccugccucagccucccaaguagcugaccgaguagaugacugggugccaccaugcccagcuaauuuuuguauuuuuaguagagacaggguuucaccauguuggccaggauggucucgaucucuugacccuauuuauuguuuuuaagucauauccgcugauuuaaaagccucagagaauaaguacaaccaauauaauuaaaccugaauuacuuucaaguacaucucucccccaaaccuuucauauuaauuaccaucuaucuuguaggcucucaacaguuuauauaguuuuucuaacaaaguaaaaaaugaaauggccaucugcaaagaauaagcauaagaacuucuuuuuuuggaaaauacagguauuuguuuuuuuacccacucuggcaaauauuaaccucagcugcucuaaaugcauuuauaguuacagugcuuacuuacaggaaguaauuugcauuccaaauuuuuaaacuugcuguuuccacaaucacaacgaaaauuucugaaaaaaggaggaaauaacaauuuuauuuuucuuuuuacaaaauccaauuuaaaauuucuucaagcauucaagcacauaguaagacuucacaauucgggaaauuaauauguacaaaagcaaauauuuauaucacauacaaacacacaaguaaaaugauggcagggaaagauaaaugguuugaguuuguaccauauuauguuuuuaaaggcucuagaaacaacucucuccaauuauauaaaauaauuacauuaaauuucauuagugcugggcgagguggcucacgccuguaaucccagcacuuugggaggcugaggcgggcggaucacgaggucaggagaucgagaccauccuggcuaacucggugaaacaccgucucuacuaaaaauacaaaaaauuagcugggcgugguggugggagccuuuaaucccagcuauucgggaggcugaggcaggagaauggcgugaacccgggagacggagcuugcagugagccuagaucacaccacugcacuccagccugggugacagagcaagacuccgucucaaaauaaauaaauaaauaaauuaauuaauuaauuucauuaguguucaacugcuuugcaugaaaaaacaagauuaggaaaaaguguagaugggaaagaaucuauacuucaaaagcauuuaguaacaaucucuugacuauguuuaccuuuuuguguauagcucaaauaguuugugacuuccaugacauucauaacugcaagcuaaacaaauuccugcugguucuucucccucuggggugcagguacuacaggcauauagugcuugucucuuuacugagcccugaaagcccccaaaauggaaaagagaauuaauguaguagcaugguuuaccuaauacccacacuaggaacugaaaaauaauuaaaaucagauuaucuguggucaagaucuuucuguaaaaaccauuaagacuaaaaaguuuacacaacagagcaucaaccaaaacacaguugcguugcaaguuucauuuuuauacuagugcuuuuuuucaugcaagcacuuuuuucuuucuuccuuauuuauuuuuugcagagauaaggucuugcuauguugcccaggcuggucucaaacuccugggcucaagcaauucucugccuuggccuuccaaagugcugggauuacaagcauuagccacgacacaagccagcacuucuuucuuaaagugauaggaagucugaauuugucaaucagcugugaauaaauggaucuguuuaaucauuuuaauaugugaaaacacaggagcauauguacagguuuauguaaguaacaucacacuuucauccuggaaaauguuuguaaaucuaccaaagaaagaaucaacacaugcaaagaaucccuuugauuuuuaggagaugccugcugaaguauuuagagguauagugucaucgugucugcaacuuauuuuuaaauaguucaaaauuuuaaaacagcaaauuuuaaguagaaaaggagauaaaacaaaugugacaaaauguuaaaaagugaauauguaggcugggcacgguggcucacgccuguaaucccagcacuuugggaggccgaggugggcagaucacuugaggucaggaguucaagaccaaccuggucaacguggugaaaaccucaucucuagaacaccccauccacuaaaaauacaaaaauuagcuggacgugauggcgggcgccuguuaucccagcuacuugggaggcuaagacaggagaaucacuugaacccaggagguggagguugcagugagcagagaucaugacauugcacuccagccuggguggcaagagugaaauuccaucucaaaaagaaaaaaaaagugaauauguauaagagguauaguuaccuuccucuaggaaggaggaagauagauaaggaggcuuccgggaugccaguaagguucuauuucuuuuucuuucuuuuuuuuuuaaaguucuauuccaauaagccuuuugcacuccuaauguucuauuuguugaucuggguugugggaacacgcacacuuuccuuucaagcuguguacaugauuugugcaaauuuccguauuuuuuuuuuuaccacaaagaaaauauuaaggaauccauuuuauaaagguaacuacacuucaaaaauaguuuacauauagacauaacuuuuuucuuuuuuuuuuuuuuaaguaaagcaggggaaaaauuguuuuaguggugaccaaagguuuuaaaauaccuggggcuaugucuggauaccagguuuauucaacaaucuagcacuuugcaguguaaacuaaccuuggucaacaacgagaacugguauuaugaucucaguucauaccacauaaugaauacaagucucuccccucaucuccccaguguuccaauccaccccucuuccuagguaacccuucuuccuaccaauucucauccuuugucagucuucuuccuacccauccuuuuccauuuuuguaccucgaaguguagggugagucacuaaacaccacaucacacccccucaaacacuugcucacucacaacgucuuccaaaugccaaacagauccuuuucuccucucuccccucccuugccagagccacuugcuguucuguuuccggucuauuuccaggggaggggggcagacugcagauagacauggguacuugcuucauuuugccaaaaaaagaaagaaagaaaaaguacuagcuagcacuuguccaacuaaauugcagaggaacuagcugucaaggagcucaccgcaaaugcccuauggauuugaaaaucucuuuaaccugacucucccauucggucccuaauaaauaaauaaauaaauaaucuuaggaugggaaaaucagggacaaagaugucuggaucugagaggucgcggggugguuucgugaaaagcaguggugcaccaagaagaggcuggagaggacggacagagcagcugcuccagggcccuuccuggcgggccggacagaguuggagacaggggagaggggggccccugcuggacacaggcugaagggggcccaggagguugggguuaaaagggaagggugagcuuggggugaggaagcggcagacuaacggcggccccggaccaccacuggggagacgacugcggcaaggcgggaauagggacagccgggccgggaaggggagguucggcgggagccgggggagaggaggcccgggccgcgcgcccaccugagaguaggagcacuucucggagucgcugccgcccaggacagcgcacgccucauucuccagcuccucguccuccucaaggacgucgaccaacgauaccacgggcuccagcuccgacugccgcccagcggcgcccucggcuccggccauccucaacugucagccgaacagcggcucggccccggcggaggcgggaaaagcggccgugaggggcguagccggaggagguggggcccgagugccaggaaccaaugacaaggaaaaaaagcgaaggaagggggaggagcgacuuccgacaaacggaugucacuccucucccuucucccgccugcgccggacgcgggcugauuuccgccuccggguggcgcuucccggugucguguucu

SEQ ID NO: 192385 - RNA, 1840 nt, Homo sapiens
ugcaucugcaugugaccuuuauuccucauguuucucugacuugaguggggguuuuggagguucaccuugggguacauuuucucuugccucaucuucuuuagccucggguucagcugggagagaagaagaaggugaauuccccaagcaggcccccaacacugacccaacagaggccaggaggauguuggaugauguggagaguccagcugccccuguggaggagacagagaaugagcacaggggucgggcaguggcccagaaaucccacccggaucccuccuccagguccugaaaaucccagggcucugccauggguagaagcugcuagaggcaacuaaaagacagcucaggggugaauucacggaaacugagagacagagggagagucauccacagacagacccuaagagcuacagagccccucacuuuacacaggaggccacugaggcccagagaggacaggggaccuugcccaggucacccaggugucagaacccaggcauugcucuuggccuagguuccuuuccucuucucccuacccagcaccccaucaccccuccacuccuaccccaaaccucacucagaaggagccagaagaggggacagugagggagagacugaagacccaggaagcugagggucacggaacuucagggugagaagagcuucccucgggcucagccucagggcuggaucuucucgcagcucuggugguccugucuaggacacuuacccacggacugcagaguagccaccaggcuccccgcagaaacaccacccccguuggcaauggcugcugcggacaucaucuuggcugcuauggaggacgcggcgauuccugccccagugaagcccauggcacugagcaccacgggcacagcccccacugccagggcuguggggagagagaagcugagugcagaggugggcucaggagaagggacccuuccccccgccccccgcuuaggaauuccuugacaguuuccggagacugucagcuugagcaauacagagauggcaacuuaguggucuucuggugaagaaaagguggaguguggagccaggugaagcaaagaugucauagaaggaccagccauggcccugguuugucucuaacuugcugugugaugcugaggaagucaauacccuucauuggucucaaauuuguguguguguguguguguguguguguguguccacgcauaaaugugaaauaagccacguggaguuuagcugcaaauccucuuucaaacgaucuuccuccuaugcuuauucgacauaaggacuagaagagaagcugggucaggaaugggagugagcuuuucccuggaguauuuugaugcuguggcucacucaggcuacucgggcagcuucggaaguggagggugagagccagcccagcgccucaucucugcguucucccagcagcccggggaccaggcuaggugagggccuggagacaggcgauccggguaacuuaccuccucccacugcagcagcagcugcccguucuagagagagagugccaggggaaggcagagggagaugggaaaggggagaaagaggagagagaagggcagaaagggagggagggggagggaagcaaggagcggagggaggaagggaaggggagggaggaagggagggagagggagucaguaggucagcugguugaugaagucagggaaugaagcuauucccugucccuuccugggcugggguuggggaagccugcccccagcccagcccgccagcccccuggggaagcaagacucacucaucauggugaggccguccgggucccaacuuggcccaggaaaugacagcguucuuggggugu

SEQ ID NO: 192386 - RNA, 5955 nt, Homo sapiens
gggaacacauccaagcuuaagacggugaggucagcuucacauucucaggaacucuccuucuuuggguaagacugggagggugggcaggagcuacccuucccguggccccggaccuugggugggcugugggcucagggagcggaggggaggccuuaagcauccacucucugcccgguguuuuuguucucaucagggagccucagaugggaagggacucgagccccaccugucccuggacucuggaauguaaggacaauuagcuuuguccuugcccagguuuuccucaggccuugagggcggcuugggguaaagugggcaaggggaagagauaaguguuaggaggaaccaagucgaagccauugcaaguccaugccugggcgggguguugcuucccuauggaaagcuucugaccuggagcaaaucacugagccagaucgcgcucccucaucuguaacaugcggaggaggagggucccaucuuuuucacguuagugaggagauuacauaagagcaggcaccucgccugcuguauaugccuuaaaaaugcgauugguucugauuucuuaguuuuggugcuuuuucaauugcuccguggagagauaagggagucccggaagugucuaagacauuggcgcugggacuuucaggagaaagaaagcagccccccuggggaaauaaagucccucagggcccugaccuaacacagguccuuugguagccccaacuccccaacaucccucccucccucaccccaggauccuuucaaggccugcugcuccacaagcucagagcagccucccuagcccccuggagcccgucacauuuuucaggacagugggaagcaagucagguugugugcccaucccguccucagagcuccaucccuucggcaggucuggcugaaguugaggaucucuuacucucuaggccacggaauuaacccgagcaggcauggaggccucugcucucaccucaucagcagugaccaguguggccaaaguggucaggguggccucuggcucugccguaguuuugccccugggugaguguuccugggaggggcuggugcugggggcgaggaggcggcugggaagggcggggguccugucccgggacccgugggagagaaaaugggggacacccgcagccuugcugcccuguccugucuucucacagcaggcguccacccuaacuuuccaucugggagggggcccggggcaggcagacucuggccagaugcccagcccuggguguuccacagguccucuccccucugggcccgggccuccuccugccuagccggaaagggucuaucuaccacugagucccacucucuucagcucucccuucccccagauucaccaucagaauucaucuccuuuaggaguuuaccuugucaauagggccccguguccuaugggaucucacauccagaguaucgauuuuaacaaaauucuucagcucacuuuuuucauuaguuucugggagaucucuuucugguuuuauuuauucucauuuucuuccuuuucacccucgauuccccucccucaaagucaaccuuucuaauauauuuaaugugugucuguuuuucauauguauuuuugcagaauggguauuguguuuuguuugcgggcauuuuaacugacaugcaggauggugugcuguagaucccauucuauugcuuuuuuccacacugagaaccauauucuugagauccaucagugucauucgaugagcaucuaauccuggcuucuaccugcugacaagugcuccucuguguguauccccugcccuuuaccuuucugucuccguggguggacauccagggguucccccaacuccgccagcacaaauggcacaggcuugaaugggggcacagggccccugacuccgacccugacuucugaccccugccccaaccucuaaccucuguuugagccugcacucacccuuugcugacccugucauccucagcugcccugagccccaacaucucucuccucagacccuugcugggggcacuggaggcuagcuccuucaugcuggggucccucacuggcacccuguuuugcaacuuggagguaacuggcccucggcaacacacaccacucugggcucccaacucaguacagagaagugugaugagcaagcaagggccugggccacgcccagcaguccuuucuguuugucagaaaugcagaugacuucucaguuuaagaucaagcaauucauaaaauuaaaauaauaacagcucaacuuaagcaagcgcuuuuauguucuagucacuuacccuagcacuugagguuugucaauuuaauucucauaacaaccccagaggaagauaagaagauaauaucgucccuuauuuaccaacugggacaauuuacuguuguccaagugcucugggcaggacagaagggugugggugugcugcuuccaggcuuggaacaggagguagaacaaugaacaaugacagaaaguauuaauaggccaggcacgguggcucacaccugcaaucccggcacuuugggaggccaagaagggcggaucacucgaggucaggaguuugagaccagccuggccaccacgguaaaacccugucucuaccaaaaauacaaauauuagcuaggcaugguggugcaugccuguaaucccagcuacuugggaagcugagucagaagaaucacuugaauccaggaggcagagguugcagugagccgagauugugccacugcacuccaggcugggugacagagcuaagauucugucucaaaaaaaaagaaagaaauauuaauagaaguaggaaaagguuggagggaggucucaggguagggcagguucugaauggcacgaaauaauggccaggcuacuccgccguaugaaugcccaucagcugagccuaacaggcaggccuccagacacaccgcagccaguuccugagggcuuuugugugucagggugcaggucugcugggcugccagccaacuugacaucaccucucuugccugccaauaaaacugaaccuucuaacgagguuauccauuccugauucccugggcucauaacccuucuagguggccuuucuggucacucaggggugggccuucauaccugcgucucuuuacuuccucccaccaucacucuaaggccucucccugggagcuggcugagcucacuccugcacauuuggcugucuuuagaacuccuggucccaaauugcaguucuggccccucuggcugcuggggaacauaaccucugccugcuccccaggggcucaccgugugggggagcaaaucauguauauccagugcugugaguggcuccagucauggaggagcaaggaugaguucugccuggaagaaucugggaaggcuuccuggaggagggaacaauggcauggaccuugaagagucagaagcuuucaauucauuccauucaagcauugcucucauguggcauucaagcauucuauagugcuugccgugacucaggcgcacagugcaaaaggaagcacaucuuucucugccaugaggacuuauuagugucugaagagcuuuuucuggacuauaggagaaagucauggucucccucacuaauaaacacugacccugcuucggaugagcuaacagcccugcucagaaagcaugacacccauccuguucacuuuucccugccccggucaaaccaccaagcccuagauuucauugccaaguauccuguauuuacugggaauggacaucacaguagcaugccuuccuagccacaucuaugagguuuuguucauuuucauucugcuuuuuguuugagcuaaaccugccuugggaggcagaaaagaaaagauaacaucugauucccccgaucaaccaaccaaucaacuaggucagggccacguaaauucauucaggacaagcacugaggucaaacuccccagugauccucacccuccuccagaauuuccacuucccgaaaugaagcaaagagcgguagacaggagucaucccuucuuguggcucccaaccuggggcagcccccugccucccuuuagaugggcaaucggcuuagaaaguggaggggaagccaguguggaucuacucacagaauguucuuuugguuuccagccaggauugcuacaguugugauuggaggaggugagucuguggggaaggggcucaaguaaccaccugccccuagggagguggacuuggggagcagcuggccuuguccaugccaauguuucccucacauggguggucaggggaggagguggggaugaggggcuaaguaugaaccaaggagcuagaaauacagcacuggaagcuggaagcagggggcuuggagacugggagcuggagugcgugugggcaggguguggcagcagccggcagaggccauuuccccuuggcagaacauucaccaugugacccugagcaugucuuugaacuccucugagcuccuguuuccucuccagagaaaaggcugguaaugcccauucaggguuauggucaggauugcauagggugaaacaauagagauugaacacaguagacaugaaagagaugccagggcucagcucccuuugguuuaguugcuuccagugugcucuguggcaacaccacggagcccuagagcugucucuuugagccgcucugaaugugccucuuacauaaucuccugggcaacaucugcuccccuaaugagauuugcuccccagcaaagauaagaaacuugccaaccacuccccugguccagcauuuggccaaggcagacacugaggcucugaggacaaguggcuuucccaaggaagguccugcugcccagaagagcuuggcccagagcccugugcccagugaccccacuagcuuuucccucuacuuuccccgccuggcugugcuccccuugauucgugccuauuggccgugcccauagucucucccaagcucaaaguucaccucuuucuccagauccccugggguccccaagccugacucaguguaucugggggggucccuucugagcccacgcaccgacccagcuccucuucccugcaguuguggcugugcccauggugcucagugccaugggcuucacugcggcgggaaucgccucguccuccauagcagccaagaugauguccgcggcggccauugccaauggggguggaguugccucgggcagccuuguggcuacucugcagucacuggguaaguauccuggcggggcuugcuggggagggcgaugaggagggcaagagccuccaaggacccagucccaaucucaacccuaugaaccucaaucucccuguuccucugucucucucuacacauucucucaggguuucucugagggagauggaggagggagggaaggagcccaagccaggaacagugcacucaggaagacucagcccgaagcagauuugcuggguuaccuggggcgucuccuccccucuggggugcagccuccuucccugaagagcgaggcugcuucuagcucuggaguucaccauggggguucaugccugcagcagccucuccccaaacaaagaccccgaggguacugggaaacagagaggggaacuggguggggucuguaagccucagccccugcugagggucacuggagucucugaccccacaguccugcccacagagcuuccccgacaggcaugucccacucuguccacccucugcuucuucccaggagcaacuggacucuccggauugaccaaguucauccugggcuccauugggucugccauugcggcugucauugcgagguucuacuagcucccugccccucgcccugcagagaagagaaccaugccaggggagaaggcacccagccauccugacccagcgaggagccaacuaucccaaauauaccuggggugaaauauaccaaauucugcaucuccagaggaaaauaagaaauaaagaugaauuguugcaacucuuc

SEQ ID NO: 192387 - RNA, 9733 nt, Homo sapiens
aaugagggccuccagggggcgggucggacugccgcgggccggggagcgcucuggguggccagcugugggcccgggccgucgugggcuccggcuugcgugcggagaugagcgggucccucggccgagcugcggcggcucugcuccgcugggggcgcggcgcgggcggcgguggccuuugggguccgggcgugcgggcggcgggcucgggcgcgggcggcggcggcucggcggagcaguuggacgcgcuggugaagaaggacaaggugguggucuuccucaaggggacgccggagcagccccagugcggcuucagcaacgccguggugcagauccugcggcugcacggcguccgcgauuacgcggccuacaacgugcuggacgacccggagcuccgacaaggucaggccagugugccgggcaggcgcccuccgccccgggcccaggagcaucgcugcacgaggccgagggguuccgccgcgccgggcuggggagcggggcuccauccgccggggucugucugaagguucgagccggguuagggcgaggaguacugcccuggaguagagucugggcugaggguguaguugauuucacugggucuugaggaucuggggcucuguacuguugccaacuugagcaguagguaaaguccuaaagguucacuuauccucacuucgagcuaauauaggcguuucggggcgauuugucaaugacugacucggaggaggguggcccgcugccugacugcucugcacgguuaggaaacucauaguaaggacccacugugagauagguacuuucgcggacacuuuggggagguuggaagccauuggccuacucguggguaaggucuagggcugucgaugguggggagagggcugagguugcccuugaggcuagugaggucggaggcugaucucgcuuggcucacggcucagggugucaagcaucauccucugugguugcuacaagcaaaggguugggacagcugucggcugaccuuagucgggaucuauguugucggggaagagucaugacauuuggcuuuagauacucaagcacagggcugaauuuaugugggccagggcuuggagagguuuguggggaaaagaagcagcccuggcuccugggcccugggcuaacucacuggcucagccuuggagcccagggggccagggcaccagggaccagauggauuaggccgggagagggaaggcugcagcuaauaagcaucuuuuccaaguacuccacgugcauucgccagucuuaucugaguaggggaggaggaagaggccaggcacaagggccugcuccuuggccaggauggucaggguugguggaaaacugggaaggcuguaccuuuuccuucuagagagugacuuaggauaccugcaucccaguuagagacuuucagugacugagucccugcaugucccuagcuaaaaagaggugccaguugugugcuaaaaauaggugccagguucucuguuacucuaaauucgaaauuacuaaucauagucauugcuuacaaugaugagacaggcugguguuuggaaaagcuuuggguugacauccucuucuguggcuaaucagguguaaaacuuaagucacucaccugcauuugaggauaaugagacaauuuggcaaaguuuguguuaggaagccaaaguaaaaauuauagaaaguguguauuauuuuaccuggcacagaaagcacccgguaaaugguagcuggcuucguauuagcacuugaugguuuucaaauguauuuuuucccagauuaucuaguccuuaaagacucuuggggauaacugauccuccauuugcuguaggugauagugguggugggugggaccuagaaagcauguugaguugaggagucgagagggcagguucaaauuaccacguauauguaauauuaccauguguuauucucaugacccuuuugucuuccuugucaacuaguaugccaccaguuacugggcucaguuuuaucaugugcaaggcaagggaccugcagucuuccuucgaagacagcuucucugcuuaaaagaggaguaacuauuuugcagucuuuugacagagaccuugcagggaguccccugcaaauugccaauauggcacuaguaaaaaagugguguuguuaucucgcuuaguaucauguuucgagggucuuugguuugugaauuuauuuucucuuguuuaauauaacuggaaaugagauaugcuggaauauagcuaguaaacggaaaauaggagcaaaaauacgaauauguacugauaacauuuuauuuuucugucuuuuauccacgucuggugucugguuucugagcuuacuuucuuaaguuuucaaacagcagcgacaggaauuuaacccuuacauuccuugaccacugaguuucaucagauugcuauuuugguuaauaaacgcguugcauauauauugaauauaacauaccucuuuuauugauuagaaaaguaaagauuaguaaguauuaacauuuggacugggcagggugguaaaagcacguuccccaaauggggauuaguucagccagguuauuaagacucuuccccucuucccuauacagcuuuauuuaccaagagcaacuaacgggcuguccgaugcuugcuuuugccagccgaaacuauguuuguacaccagauccaaggucauuucuaguaauaggaacggagcucuugcaaaacuggccuuuuguugguucuuaugccaaggagaccugaacuuuacaaagugccuaaaccggaggaaaacauucuuuccuaguuuugaguacuggguucccaggagugugauacagacacaucuugagacugugacccaaggaacaaaggugacuaugaggcagcauuguguucuggccuucucaagaccuucuuguccuucucuuuuuaucuggagugcacacagaagacagucacaaagggaucaggucccaguagacugacaucaucauuuccuaauccuggucuuaauaaaggaacuuaugcucauggaagcaauguagaaaacacugaaaaguuuaaagaaggaaaaucaccuguaauuuauggaaacuauuguauuaacauuuagaucuaguuccuaacaguuuuuuuuuuuuuaacacauugagaccaugcuugucuauacauaguauuuugcccuccagagacgagggaauaugucuuaugccacugccuguggugcuguguguaccgcuuaugcaaagcaagcuuucagugagcauuuuaauaaauaaauaaauacugcuuuuauuuaucauuauauugcaaacucugcggccuuaaaggcauuauaaacauuugcugccgauuuagaucaucauuguaguccuugcaucuggaacagugacagaauagggacucaaaugauuuguugaauaaauaaccauauccuguuguugaauguuuauuaagcauuugaaaauacgcuccaccuuuucaguaucagggaauugaagacaguagugaaacaugucaugcuggugaaccuuaaaaguuggauaacaaguuguguguaugugcuuguguggugcacauguaugcugcagaugggaguauaaaaugguaccaacacuuuggaggaguaacuaucaguacccagucaagcuaugggugaacagagccuaagacccagcugcgugacuccuagguauauauucuagagagggggaucugcaaacuuacccuaguaaagggccagagacuaaguacgucaggcuuugugggcugugugguuuuuguugcaucuauucaacucugcuguuauauagccugaagucagucaugggcaauauguagaugaaugagcaggcugaguuucaauaaaacuuuauuuaugaaaauacagcuuuaauuacgaaguagacuggauuuggccugaagaccauaguuuaucugucccuggccuagagacugacuucugcauguguguguuaggacauggguccccaacccccaggccagggaucgaggacuuacagcaggagguaagcgguggguaagugagcuuuaccgccugagcuccgccuccugccacaucagugacgacauuagguucucauaggagcacaaacucuauugugaacugcacaugugaggaaucuagguugugcguuccuuacgagaauguaacuaaugccugaugaugugagguggaaccguuucaucccgaagcuauccccacccuucccugguccguggaaaaauugucuuccacaaaaccagucccuggugccaaaaagguuggggaccucuguguuaggauaccuguguuggcgcguucauugcagcauggcuugcaauaaugaaaaacugacaggaagggaucuuggucuauuagcagcagaccagauaaauaaacuuuagucacaugauggaaagcuaaacuguaguuaaaaugaacuagaucuagauguauuuaacauggcugaaucucaaaaauacaauauuuagucaaaaagcaaguugcaaacacguaauuauggcauaauaccauuuguauauguaaauguuaaaggcauaaaacagucccauauauugcagauaugugugcagugcacuuguagcuccugggcaggagugagauggcagcuagaggguagaggccaccucuggugagggacucagguagcaugugguuaagagucugggcuuuuguacuccuggaagccuggauauaaauccugguuucacugcgcugucacugugaguuucgguaaguuacuuaacccuucugagccuuaguuucuucaucuuauguaaaguagggauaauuguaccugccuugucagauuuuuguaaagauuaaauaagauuauuuuuguaaaacgcuuaaagaguaugaaacucaguaauccuuaacucaauaaaugguauauauauauauauuuuuuuuuuuuugagagaguguuacucugcugccuaggcugaagugcagggggcaaucucggcucacugccaccccugccucccggguucaagcgauucuccugccucagccucccaaggagcugggauugcaggcaccuggcaccaugccuggcuaauuuuuuuuauuuuuaguagggacaggguuucaccauguuggccaggcuggucuugaacuccugaccucaggugaugcaccagccuuggccucccaaagugcugggauuacaggugugagccaccgcaccuggccugaauggcguuuucauuacuuuaggguauacuuaaucacuuuuuccugcuuuauuuuccuaugcuuuuucuguugccuuucucagaaaagcauuacugugaagggugggugguggagcauguugguauggagagaauguccacacuguaccugguacuaugcugggagcucaauucauuucauuccuuagauaucauggaaucuucauaauaugugaggcguagaguauauucccauuuuacagaugaggaaacugaggcuaaaagauuaacagauuugucugaggcuacauuuacaggcuagcaaaccagaucuacugauccuuaagccugugccuugcccacucugccccgugccuugcuuuuccucuagugagggucuacugauuuccgugcuuucagcucagaucaucuuaucucgacuuaacgccauucucuaaauuagagaauaugaagaaauugugacucucagaggugguguaacuugcccaagaucacagagucuaguagguaagagacagaguuggaacucauaucagauucugaagcuacuguagugagguucuaccaggaaaaauaaaaagaaagaaaacuaugauuaugcugcucucguaauuuaguguccaaaucaggaguaaugcccaguguucugaaugugaugaauuuugaaaaauaccuuuugaaaguucuggaagggaauuuuaaaguaucauuucuguacucuuucuggguugauacuuuggaauaugaauuuguuuguauggguuuuuuugguggagcauuagaugcguguaaacugacuuuguaagauagccuccuaacucccaguuccuaguguuacucugccauauaacuuugcagucagcauuuucugccccagauggaaucaccaccgucuaucacauaugaaauaaugauuaucauuaaaauucauucuuggaugugauuuucuaauuuucaggaguagcucucugauucugaguuaauuucaagugauauuuguaagaacuaccacugcauauugcaguuuuugaaaacuaaagugugagagagauuaaccauguguaaacaguuacuuguggauccgcaggauucauuuuaauauucaacuuaugaagaguagucuuuuauuauuauuaggaguuucucacuucacucuauaggaagcaauuggguauuuccuuaaauauuuaaacugguaaucaacuuucuuaaaaauggaaaagagcauagucauuaagaagggugccaacguuuggccuugaugccagcugccuauuacaccuauucaucuaaaaauuaaagaagcagcuaaguuuaauuuugauaaaccgucagcugcugucaagaacaggcagguggcucaugagaaguuaguaucacuugcauguggcuguguguguuggguguugagaaugucugaaagccugcuuguuuugauaauuuuggugguaaggauucugggggucuccccuucucucguagucaggacauaugaucaacagcaacauaaaguuuaaucaaugaggcaagcccaaugcuucgauugagugugauacuauaaaagugauugaugaaaagcaauuuuacuuuaaaaacauguauuuuuuggguaaaacauguaguuuuggguaguucucaggcagcaaacauuuccauuuuugguguguuucagaaauuauagacauccaucaaaauaaaucaguaaaaauugauuaucauggaaagcuucacacaauauauuauucauugaaacaaaacaggucguucaugcacauaaaugauucauuuguauaaaagguauuuaagaaaguugaagauaaugaaaagaagcucacguuuacuuuaaauauuucuuaauucucgcacccagcucucagucaucauaaagguaaaaguuuuguaaucggcaucauuguaaaaagugaguuuugauagacuuuguauuugaggacagaguuugaagaaaguaaaaaaacacacaaauuaugcuaguuguuuuuguugauggagcaucaaacaucaccaugaugaacaacuugaauucaucaggguauucuacuaugucuagauauuuggcauuauaaagacauuuugaugauuaauggaauuuacccuuuauuggcagcugccaaagagcuagcuguuguuucuuuacuagcacccagaguggcugagagguguccuuuuggaggccuagagcaauguaacccuuucuuaauaugugaagucuggagaaggaagauaaagcccuugguucaggggcuuucuuuagggcugucauuuagagcaaagucaguuuuuuuaauaaggcaauaacuuuuaagaaaaaaauaaauaguauauugggacuugugauauaacugaaaucaguaauuuuauuuggaaaauguuugauaauaaauuauaggguaucaagagcaaguuuuuguauuuuuaguuuguuuacauaaaaaucgauuuguguaaacuguacuggacuugaacaaucuguugacuuuuccguuuuguuuauccauaugcucauuuuggccauuuaaaaauaucuaucuauguaaauauaaaagugucacauaaguguuaguuauuauaugccaugcuuugaccaucuucguuuuuaacaugaccaauacaggcuuuuuaauggccgacuauguuuuugaaagcacagucaucucaacauacaaguagaaaaggaaguagacugaugaagaggaauguuaagaguaaucuuuuaugucuuaagauugaagccacauuucuuucuuaccauuuuguuacagucaucauccuuguggcucagaauugaacagaguaguugcacagcugcgcugucacagagugucccucaucucauguguguccucagagccauuugcacacaggacugaucacaugcaugcugguugguuucuuggcugcugugagcgcuuaagagcagagcgggucucacucccccaccccucagcccuggacagggaccuugcugagcucugggccuucauuagacucaccagucacuucggguucugcacagagccucaucauccacuccacagagagcccaucacaguggcuggauagaugggaacugacaacccauagcugugggacagggauuuuucccuggguaaaaguaauuguuaaaaauuaaaaaaaaaaaaaacucaacaacucaucaucucgaggagaagugacugacggccugcaccaacuuagacagucacagucaugaaaagugcacaggugggauugcccgaguuggccaugaauuaccgugauggauccauuuggaaaugaaguugguugugacauuucuucaaguuuuguuucgcuugaagcuugacugguagauggagaauuuuggccuuauguaucuuaugugacuugcauuacccaguccaguccucugccauuaaucuaagguccgcaauguaucagguauuuuacugagaaucuugcuuaccuaauucucacaaaaaaaaaaaccuugggagaugaggguggaaacaggaugagaggucaggugacuugucugagggcugacgguuuguaauuggaagagucagggccuaaccacuggucucuuugacacaaaaacucaugcucuuaguggcaagcacaguguucucaagauugggggaagccagggagggacaguggguugucugcuacuagugggucaaaauuacauauuuagucaugaaugguucagcuuuuaccauuuaaauaacaaauaaauguucuuucuccauaggcauuaaagacuauuccaacuggcccaccaucccgcaaguguaccucaauggcgaguuuguagggggcugugacauucuucugcagaugcaccagaauggggacuugguggaagaacugaaaaagcuggggauccacuccgcccuuuuagaugaaaagaaagaccaagacuccaagugagggcggccaaguccucgcugagcagagagggagccguucaugucagagacucacugccagaaaagccuuacccauuuugguuuucacuauugagaccgcaacugcuugcacugaucauuuugguucgugagcaguuggugauuuuaguuggucugguguucgggcuaagaauauuuuauuguggacuuaauuacaaccacugcacuguaaugauucaaugcuguauuaugauauugcuguaaacaaaauucauucuuauauugucacuuauucuuugccugauucagaaguuaaauaggagcuuuggaaucauuauucaugaccccucugcaaaugugucagucuccaaagagaguaucuccccccaaauuuuguguagcuucuuuuguuauggaaaauggugaacaaaaaaagaaacugugauaacuggggcguuguuuuuuaaaauaaacuccagcacagggaugcugugcaugccugaguugauuccgaagugcauaugucuguaaggauuuggagugccugcaguguuuuaugugugggaaguaagggugagucucauauucuucuauuaaauuugccacaagaauugc

SEQ ID NO: 192388 - RNA, 4230 nt, Homo sapiens
uccaugaauauuuuuuauuugggggcugccuauucucacuucucuccaccagaaucuaagucaaggauagaagcugauuccgcacgaaguuagauaaacuaucuugcauuuaaucaaucauuacaaaaaguauucaugccacauacaacuuuguaacacccaggugcgugaccaucuauaaaaggggggaaacccaaccucuaucccuuuuccacgugggcaagccaaggguucugagggcucauccacagggcucgccggccuggccuccugcugcgucccgggauguggaccacugacccagaggcuucugaguccugagcacagauaagggcuccuuucaggccuuuccuugagcugcacgugaaccugugugggcaggcagcguuugcaggcguguuuacgggcaggcagcguuugcaggcguguuuaccggcaggcagcguuugcaggcguguuuacaugcaggcguagcaccaugugagaccacugguccaggguuucagagguccugcucaggugaaucggcuguguucucacaaguucacggagcugagugggugugcaacaugaaauacuagugcugugagggacagaagggacagaaagaggcugaagaccaucauccagcugagaaaagccgaggcacagguauagcugggcaccuggaagaagcucugccaaauggaauccuccuuggcaggagugguagugcuaaggcgagcagagugggcuacaggcagguccugcaggcccuggguagagcucauccucugucuguccauuccucccagaccccagcgugguggagaagacacaggcauaguaaacgaaggugaacagaaacacaacauccccauuguaggcuggccaggcucaggcccuggggugaaaggagacaggugcugccaagaccuggagaaggacaaaagaagacagaaucaagggugaaggaaaggaccaggcaguggcgagggguggugcugcuggagcaggucuaagugggaagccuaguggucagggauggcccccagaggccuucugagccaaggcaaauucugacaccugggucuguaaucugaagaugucacuauacuucaacucauuucugaguuuuguacucuuauuuccucaaaacucaauagcguaucuaauaucuggcucagcugauauaaucaagcaccagugcuuauuuaauaaagcaaugguaaggccggacgugguggcucaugccuguaaucccagcacuuugggaggccgaggcgggcagaucaugaggucaggagaucgagaccauccuggcuaacacggugaaaccccgucucuacuaaaaaaaaaaaaaaaaaaaaaaaauuagccaggugugguggcgggcgccuguagucccagcuacuccgagggcugaggcaggagaauggugugaacccgggaggcagagcuugcagugagcugagauugcaccacuacacucuagccugggccacagagccagacucaucucaaaaaaaaaaaaaagcaaugguaaaugaaagugccagcugaaacuugugaaguacuuuauagauaugagcagcugcgauaaagggggcugccuacaaagcccuuggcucccgaagugguaagggagacaugagugccuccaggaagccucucccaucccuagggacccucagauggcagcagucggggagggguuagcacugccuucauggagaagggguggucuuucuuucugauacagccacuguggacuaagaggggucaggcuccaguggagcucaccauacaucagucaucuggcagcagcucgagaagcauguccuccacgccgucaaucugagaggcagagagagagagaaggcauugaucggccagagcccuccacucccuccauuccucacuccugcgccuuccccuagcuggaaacagcagguaggaacccaggugugaggauuucaggggcucuuggagacugccccuccucccaccagccuucagccugugacugcccaccagagaugucuuccugcggcuagcugguggcugggaggaaguggagguaggguucuguuagagaccucagaggaucuaucuucucucugguaaaguccuuuagaaaucugcacuuguacauuucccccauuuuuuaaugcuuuugggacugggauggagggaagauaaaccacuaaggccagacauggaggagggcaaacccaagaucacccgauggaccucugggagaaagacacucaccuugaugugguacacuaagcgccagaaacuggagucugaggaucgguaucguccaucaggguagagcugccacaugauaggcagcaggcuugggccuaucugggugggggucauaggccuccccaggacgacgucuucccgacgcaagagcacccguaacuguaaccuauccuuuaucugaggagaagaaaaggacagggcauacuuucagguuccgcuugccagggcuucuccaggcgcagaaaaccggaaucccuccugccagccauccacccaucugggcagggguccgagugugaaaugauggucaucacuguucccugaagcucacuuccuuaggccaugcaugcuccucucagggacucuggcugggccaggaccaccagcacacacacgugucuagccacccagacagggccaugaaaggcacacuuuuuucuggcggguugcagcggcucacacuuguaauuccagugcuuuggaaggcagaggcaggaggaucgcuugaggccaggaguuuaagaccagccugggucacagagcgagacccuguaucuacaggaaaaaaaaaaaacaacaaagaaagaaagagagaaaaagaauacuggccuuuucaaugaugugaggcaaaaucugucccacaguuugcuaguggguuauuuuuuguggagcauguaucaugauuuuaugaaaaacugucugguucgugguuuuggugucacguugaagaagagauuucucagagauuuaaaaaaagaaauccacugaaucuucaaauuauuucuucaaauuuugauuuuaaaaaaguaaguauuuaacuugauuuuuaaaguaaaaacauauuuaaaaaauugaaaugccaauaaaaaugcagauuuuguggugguuaagagccuagaauuccaaccccauuaccuacuagcaaucuuaccucggacaaauguacauuuuugugccucaguuucccaucuguagagacacagucaacacucaauaauuuuugauugcuacuggacauacguguucuaauauauuuuuuaauuuuuaugcuuucuucaguguauguuuggagagaguuugaacauuuuuugacucuuuuucauugaguaaauccaaauacuuguaaaagacuuaucuauuucuuuaacaaaaacuuaacauggauuaaggacccaucuuaaggcaucacacauuaaaaaagucaauauugauucaauaccggcgcuuauacuacgacaucacuuguuaaauuuguuuucuaaauaaagcccagagguaguggaaaauacuucacacucuaggccaguguuugcuaugccugguugacccuaaacuguugaggguucuuuuuaaaaauacagauuucugggacccaccugagaugauuccgauaaucggccauauggaugagucacuuagagauacccauuuuuaaggauuaggaccccgaagcccagaaaaugccugcuguagucaacauuauagucacacuccacaggcacuggguccaccccuuugaccgacauuccuuugcgguuuucccacccuucuucccugccuggagaacuccuauucauccuccagagcccggcucaaaguggcuucaucuguggggauccucccugccccauagugagugcuccuugaguccucgcccuuccuagggcaucccaagcucccaggggcugccccugcugccucgccauccgcuccaaagcuggcuguaccucgaugguuaagggcagccaggcgugcugcuucucguccaaauacacgaacuucucccaggcccacaggcgguccggguggucggugacugccuccccgagugucgggcacucggccauggcguccucgggccgccuaagaagcaagagccagagccucucaaggccgcucgcuggucccugggauguggggccgacccuuuauauccgggcagcaugcggccgccaccaagcggcggggcgggaggac

SEQ ID NO: 192389 - RNA, 4230 nt, Homo sapiens
guccucccgccccgccgcuugguggcggccgcaugcugcccggauauaaagggucggccccacaucccagggaccagcgagcggccuugagaggcucuggcucuugcuucuuaggcggcccgaggacgccauggccgagugcccgacacucggggaggcagucaccgaccacccggaccgccugugggccugggagaaguucguguauuuggacgagaagcagcacgccuggcugcccuuaaccaucgagguacagccagcuuuggagcggauggcgaggcagcaggggcagccccugggagcuugggaugcccuaggaagggcgaggacucaaggagcacucacuauggggcagggaggauccccacagaugaagccacuuugagccgggcucuggaggaugaauaggaguucuccaggcagggaagaagggugggaaaaccgcaaaggaaugucggucaaagggguggacccagugccuguggagugugacuauaauguugacuacagcaggcauuuucugggcuucgggguccuaauccuuaaaaauggguaucucuaagugacucauccauauggccgauuaucggaaucaucucaggugggucccagaaaucuguauuuuuaaaaagaacccucaacaguuuagggucaaccaggcauagcaaacacuggccuagagugugaaguauuuuccacuaccucugggcuuuauuuagaaaacaaauuuaacaagugaugucguaguauaagcgccgguauugaaucaauauugacuuuuuuaaugugugaugccuuaagauggguccuuaauccauguuaaguuuuuguuaaagaaauagauaagucuuuuacaaguauuuggauuuacucaaugaaaaagagucaaaaaauguucaaacucucuccaaacauacacugaagaaagcauaaaaauuaaaaaauauauuagaacacguauguccaguagcaaucaaaaauuauugaguguugacugugucucuacagaugggaaacugaggcacaaaaauguacauuuguccgagguaagauugcuaguagguaaugggguuggaauucuaggcucuuaaccaccacaaaaucugcauuuuuauuggcauuucaauuuuuuaaauauguuuuuacuuuaaaaaucaaguuaaauacuuacuuuuuuaaaaucaaaauuugaagaaauaauuugaagauucaguggauuucuuuuuuuaaaucucugagaaaucucuucuucaacgugacaccaaaaccacgaaccagacaguuuuucauaaaaucaugauacaugcuccacaaaaaauaacccacuagcaaacugugggacagauuuugccucacaucauugaaaaggccaguauucuuuuucucucuuucuuucuuuguuguuuuuuuuuuuuccuguagauacagggucucgcucugugacccaggcuggucuuaaacuccuggccucaagcgauccuccugccucugccuuccaaagcacuggaauuacaagugugagccgcugcaacccgccagaaaaaagugugccuuucauggcccugucuggguggcuagacacgugugugugcuggugguccuggcccagccagagucccugagaggagcaugcauggccuaaggaagugagcuucagggaacagugaugaccaucauuucacacucggaccccugcccagauggguggauggcuggcaggagggauuccgguuuucugcgccuggagaagcccuggcaagcggaaccugaaaguaugcccuguccuuuucuucuccucagauaaaggauagguuacaguuacgggugcucuugcgucgggaagacgucguccuggggaggccuaugacccccacccagauaggcccaagccugcugccuaucauguggcagcucuacccugauggacgauaccgauccucagacuccaguuucuggcgcuuaguguaccacaucaaggugagugucuuucucccagagguccaucgggugaucuuggguuugcccuccuccaugucuggccuuagugguuuaucuucccuccaucccagucccaaaagcauuaaaaaaugggggaaauguacaagugcagauuucuaaaggacuuuaccagagagaagauagauccucugaggucucuaacagaacccuaccuccacuuccucccagccaccagcuagccgcaggaagacaucucuggugggcagucacaggcugaaggcuggugggaggaggggcagucuccaagagccccugaaauccucacaccuggguuccuaccugcuguuuccagcuaggggaaggcgcaggagugaggaauggagggaguggagggcucuggccgaucaaugccuucucucucucucugccucucagauugacggcguggaggacaugcuucucgagcugcugccagaugacugauguauggugagcuccacuggagccugaccccucuuaguccacaguggcuguaucagaaagaaagaccaccccuucuccaugaaggcagugcuaaccccuccccgacugcugccaucugagggucccuagggaugggagaggcuuccuggaggcacucaugucucccuuaccacuucgggagccaagggcuuuguaggcagcccccuuuaucgcagcugcucauaucuauaaaguacuucacaaguuucagcuggcacuuucauuuaccauugcuuuuuuuuuuuuuugagaugagucuggcucuguggcccaggcuagaguguaguggugcaaucucagcucacugcaagcucugccucccggguucacaccauucuccugccucagcccucggaguagcugggacuacaggcgcccgccaccacaccuggcuaauuuuuuuuuuuuuuuuuuuuuuuuaguagagacgggguuucaccguguuagccaggauggucucgaucuccugaccucaugaucugcccgccucggccucccaaagugcugggauuacaggcaugagccaccacguccggccuuaccauugcuuuauuaaauaagcacuggugcuugauuauaucagcugagccagauauuagauacgcuauugaguuuugaggaaauaagaguacaaaacucagaaaugaguugaaguauagugacaucuucagauuacagacccaggugucagaauuugccuuggcucagaaggccucugggggccaucccugaccacuaggcuucccacuuagaccugcuccagcagcaccaccccucgccacugccugguccuuuccuucacccuugauucugucuucuuuuguccuucuccaggucuuggcagcaccugucuccuuucaccccagggccugagccuggccagccuacaauggggauguuguguuucuguucaccuucguuuacuaugccugugucuucuccaccacgcuggggucugggaggaauggacagacagaggaugagcucuacccagggccugcaggaccugccuguagcccacucugcucgccuuagcacuaccacuccugccaaggaggauuccauuuggcagagcuucuuccaggugcccagcuauaccugugccucggcuuuucucagcuggaugauggucuucagccucuuucugucccuucugucccucacagcacuaguauuucauguugcacacccacucagcuccgugaacuugugagaacacagccgauucaccugagcaggaccucugaaacccuggaccaguggucucacauggugcuacgccugcauguaaacacgccugcaaacgcugccugccgguaaacacgccugcaaacgcugccugcccguaaacacgccugcaaacgcugccugcccacacagguucacgugcagcucaaggaaaggccugaaaggagcccuuaucugugcucaggacucagaagccucugggucagugguccacaucccgggacgcagcaggaggccaggccggcgagcccuguggaugagcccucagaacccuuggcuugcccacguggaaaagggauagagguuggguuuccccccuuuuauagauggucacgcaccuggguguuacaaaguuguauguggcaugaauacuuuuuguaaugauugauuaaaugcaagauaguuuaucuaacuucgugcggaaucagcuucuauccuugacuuagauucugguggagagaagugagaauaggcagcccccaaauaaaaaauauucaugga

SEQ ID NO: 192390 - RNA, 41803 nt, Homo sapiens
agcaggagccaaggaaguuuauuuacucuacugggugacaggagggcagagugcuccagaggagacccagauacaucaaccaaggacuucccugagauuuggcuuugcucuuccaggccugcacaugcugcgugaugaaaugaggccugccuagacaucugugagggccucgagggcugcugccucgacuuucucccuagcuaaguccacccguccagggacacagccagggcacugcucugugcugacuuccacugcagccaagggucaaaaugaagcaucugcggaggccaggacuccuuggcaucggacacagucaggggaaaagccacccugacucugcaggacagagggucuagggucauuuggcaggagaacacuggugugccaagggaagcgagcaugauuucuggaguggacuacaugcauggucuggaguucaguaaacuggaaaguuucacccccaagucuuaauuuaaucaaaauugcugaacucuguucaaucuucauuguuaaaagcagcuuuaaagcugggugauuucuuagucaaauguauaacgaagcuuuuacuuaucaauuucuuuuugggagggggcaugggcugaaauacaucuugugcucaauaaaccuccccacaucaauauuucaaagcacuuucuagguuacaauaaugacauuucaauuccauauacgcauacauagaauauauauuuuuaaacagagugggucuuaagaguauacuuggaacccucggaguccuccauggacaagaacaggguggcccauggacuuccagccaaaggcuccacuguggggcugcuuuggggagagacucacagcuggacuucucuauccgaccaugcaauguuagccagcaccaauuacccacaaugcuuugcccauaagagauagaaauaauggaacucacaggaagaaacaguauugauaacauacacaggcuuacagaggccaggcccaguaauuaccaugagacagaagccuacagguggcggugcuuugacugggcugggauuauugauacauuacugauacaucacuucuuuuauaagcauauguaaaacgagugcuacugaaagucgaaggacagcuuccggggagucaugaacucuuucacuaucucauccgugaccuccuugcgccgggccuggugcucugcgaucaagggcugcagaaccucuaugagugccuucuugagcucaccggugagcauggcuccgcugguguaauccugcccggagggagacagccacgugagagauggcuccacauguccugaguggcuccuuccugccucgggcaccagcucagcccacaccacccaugcagagccuggcacguggguggcacucagaagugagaucuguuguuaccacaacaauaaccuauaccuucagcuacacuuuuccuaaaacggcuagaaaccuggcucugacgauagccaugacuuggccucucacagugaaagggccaauggggagggcaguccccaccccuaccgaugcuaggggccauucccccaggcacuaaacaacaacaauuccuggcagccuuauggcuucuguaaaaucuugcuaauuuuuuuuuuuuugagauggagucucacucuguugccagguuggagugcaguggcaugaucucagcucacugcaaccuccgccucccagguucaagugauucuccugccucagccuccugaguagcugggauuacaggugccugccaccacgccuggcuaauuuuuguauuuuuaguagagaugggauuucaccauauuggccaggcuggucucgaucuccugaccucgugauccacuccccccaccugccucggccucccaaagugcuaggauuacaggcgugagccacugcgcccagccaaaucuugcuaauuuuuucuuuuucugauuguacugcaugcucauuaagcaaauuuaauaaaguacccaaaccacaaagcagcagcaaaguaaagaaaaaucaccuacaaauugcccaccugaaaaaugcccagaggugggucucccgcuaacauuugguagauuuucuucacauuucuuucccugugcauuucauuuaaacauaguuaacuccucccugaguuuucauuugguauccuuuuuucacuaucauaggcauauuuuccugugucacuaaaacuuuuuuuuuuuuaaaagaaaugagggucuuggcuggacgcgguggucacagcuguaauccaagcacuuugggaggccaaggcggguggaucacgaggucgggaggucgagaccaucuugaauaagacgguaaaacccugucucuacuaaaaauacaaaaaaauuagccgggcaugguggcgggugccuguagucccagcuacucgggaggcugaggcaggagaauggugugaacccgggaggcagagcuugcagugagccgagauugcgccacugcacuccagccugggugacagagcaggacucugucucaaaaaaaaaaaaaaaagaaagaaaugagggucuugcuaugucgcccaggcuggauuugaacuccugggcucaagggauccuccugucucagcuucccaaguagcaggggcuacagaugugugccaccaugcccugcauaugaacacuuaaaauaguucaugcccgcauaauaauccacccuguaacaauucuaauuuaacguuuccucuguuguacugagucuguguugaacuuuuugcuauuaucauuuuuaacaucuuuguguggaaagcuuucucuuacucaggauuauuuccuuggaaaaaaucuaagaaugagaaaaccugaggagaagcucugaacauuuuugggcucuuuguacccaguaccaaacugcuuccugaggcugugcugauaaacacucugcucacuugagugugccuugaagcaucugcuucauaaucacugaaaauagucaauggcaacacaaaagccccuacuaauucuauacucaacugucuuagcuuugaucacguuaacuuacauuucucugaugacuaauaaagcaagacuguuuuggguggcuccuaaaugaauagugauuuguaucugcucuuucgagauuuguucaugaggcuucugagcccaggccuaaaaaccaugagggcgagucuacucaguuuucaccuuguuucaguugagcaccuccgaccaagccuucaugccuggcuguuggagccuuccaggccccaugggcaggaguggguggcagaaggcggcugugggcccuugggguucccugcucaccuuccugaucugcucgagcuugucgucguccucgaggaagaaggucagguacaugaaagacacguccacaucacaguugcccccaaacugccugugcuccucgauggugucucucccuccagaaaacgcaugcuuauugaccugcaccagaagaggacacagacacgcuccucaguccugcucauccugugccuggacacuggcuagaagcccaaguguggaagucagaggugugagugcugucagauucuggacccgggaaaggccaaggcgcacagccgguugggggcgcacagccagugggggacccacugcuguucuuccugugaggcuugggugugagcuacuguggggcucacugcaggagaggugggggcagaugagcuuugaaccccccauccucggagacacaggagaauagaguugggaaagccaaggcacugauugaacugaaaccugggacagacaaguuccucagguaacaagcgucagaaaaaggauggguaaggccagacaugguagcuugugccaguaaucucagcauuuugggaggcugaggggggaggaucgauugaggccaggaggucaagaccagucuggguaacuuagugagcccuccucucugccaaaaaaaaaaaaaaaaaggaauuagcugguguggugacgugcgccuguaguccuagcgacucgggaggcugagguggaaggaucgcucagacucaggaguuugagguuauaguggacugugauugcaucacugcacgccagccucggcgacagagcaagaccuuguuucuaaaauaauaaaaacuaaaaaaauaaauaaauaaaagaaaaaggaugaguaagucauccucagaguaagggagauggcaggaagggcagccucucuuagggauagguacugcaguguuaauggggacaggaaagcaguggccagccccacacagaaagcauaacaagaaggcacaggguaaggcaguaagggaaggcaaacccacgagaagugcugugcagggagaggggccugcaggcaggucuucacuuacaaacaggcaacacugucagagcugaaaaacucagaaacacaaugacuuuuaggaauuguuaaagauaaucacgggguaauuaaggcuaauaaaagccagaacaaauaggugaaacuccuucaacauucuuucagugagcaucugagaaaaugucacccuaauuuuuuuuuuuuagauaggaucuccagucuguugcccaggcuggagugcaguggugugaucauggcucacugcagccuugaccuccuggucucagguuaccuuccugccucagccuccugaguagcuaggaguauaggugugugccaccagccuggcuaauuuuuugguauuuuuuguagagaccagguuuugucguguaguccagucuggucuugaacuccugggcucaagugaucugccugccuuggccucccgaagugcugggauuacaggugugagucacugugcucagccccuuaacuuuuuuuuuugucaccaugcccggcuaauuuuguauuuuuaguagagacaggguuucaccauguuggccaggcuggucuugaacucccaaccucaggugauucgccugccuuggccucccaaagugcuggaacugcaggcaugagccacugugcccagucuuaacuuuuuuuuaaugggaaaaaaggugggcagagucaauaaauucuaaguuguuauguuuaguaaguuuccuuaaaagaauuccagagcagccgggugcaguggcucacaccuguaaucccagcacuuugggaggccgaggcaggcagaucaccggagguaaggaguuugagaccagccugaccaacaugaagaaaccccgucucuacugaaacuacaaaauuagcugggcguggugucaugugccuguaaucccagcuauuugggagguugaggcaggagaaucgcuugaacccgggaggcggagguuguggugagccgagauugugccauugcacuccagccugggcaacaagagugaaacuccaucacacacacacacacacacauacacacacacacacacacacacagaauucuagagcagaguccuaacuagauaaguugggauugugcaaaaggagcagaugaguguuggggcaaaggcgccugucuccauuuuggcagggcauugcugagaggcugggcagggaaagcagcagucacgcgagaggcucaggcaaggcccaugcgaggggcuggcgcaguggcucacgccuguaaucccagcacuuugggaggccaaggcgggcagauuacgaggucaggagaucaagaccauccuggcuaacacggugaaaccccgucucuaccaaaauacaaaaaauuagcugggugugguggugggcgccuguaggcccagcuacucgggagccuugaggcaggagaauggcgugaaccugggaggcagagcuugcagugagccgagauugugccacugcacuccagccugggcgacagagugagacuccgucucaaaaaaaaaaaaaaaaaaaggaaaaaaaaaguuauagaaugaaaaacuauggaaaauaccaauaaacaggaggaagaaaaaaaccaccuaguaguggugucuccuagcaucuaagugccugauagagucacugcuaugugguggccauagcccucccugcugggccuuggggaagaagcuucagugucaggaagaaagucugagaacacagguccuggcuuccaggggcaguuugaagaggauauugaaaggccaguucccagaacuuuaucugagaggagaacaaggaaacuggugucugcugcauguuuuucaagaugugcuggcgucaccaccaccugcacacucccccuccccaggcuuuucccacgguaggcacacagcagaugugccauccguggaggcuguuaggguuaugacaugcauuuuauccccaacaacccaaugaccucuguagugaugucucuaucuuacaggugaaggaaaucaggcccagagugucaggaaccugccauaugugacagggauuggcaggaccaggcuggcuccugggacaccaggcuucuggguggagcucgagaacugaggggcucaguucugccuccuugacgugaucaguccucagugaugcaggaaccagccuaccaggccugacuuacaggaaaacagauggagggcugacuuggggguggguauggagcacugcugccagcaacuaagaugauggaagugggugaccagugugacucugugugacaggaaaugaugccgaauggacacagccagcuagggugguaguuggaauaaaguuagauaacacaggcuuacugugugcagguggcagguacucacucagcaaagccaccugagucgucagcacugugcuacuauuuugauuuuuuuaauuugagagauggggccucacugugccaccccagcuggggugcaguggcuauucacaggcacaauaguagcucacugcagccuugaaucccugggcucaagccauccuccugaguagcugggacuacaggcacgugccacugcccugccugaaccuguuauuuuuaggaggcuggagcagaugugcccucucuuuucuaguguggagauucugauuuuggagcugaagucgggcacggggauuuagagugagggccugggcgggcccuguucugccccacaagaagccugcaggcccagugaccgucuguaggccucuguuuuuccugaccucaugcuaacugcucaccucgagggcucuacuggucccuaagugaaugauaaaugucccagauccauaaacaaguuuuucuuuuuucuuuucuuuuuuuuuuuuuuugagcuggagucucacucuguugcccaggcuggagaacaguggugcgaucucggcucacugcaaccccugucuuccagggucaaacaauucuccugccucagccucccgaguagcugggauuauaggugccugccaccaagccugguuaauuuuuguauuuuuaguagagacaggaguuucaccauguuggccacgcuggucucgaacuccugaccucaggugauccaccugccucggccucucaaagugcuggaauuauaggugugagcuaucgcaccuggccauaaacaacuuuuuccaaacaacuucucagaagcaaaauaaaacaguggacuuuuccaauggcgcuucccuccccacucugcacccugugcuccggaaguuuuggccagaagugaaagggaaagaaaagucuucaauuauaccagcuuccaacugaguggggagaguugguggagggcaugucuuaggaaguuuugauaugaaaggcuuccccauugucaaccagaaccugcuugggacuuuccagaacggucaggggcagugacucagagggcaugugacaugccucaaauacaguucccagcauucccacugcaaucuucuagccugcaaacacacacuugauuccaaagaaaaugucaacugcuuuguguaacagugaggcaauuauauauacacuggcuguugaggaaccaggcaacagaacuggggccaugcaaaauaaggaagcucaaacuaacuucuccuuuuaguuucucuagugauuugucaaauguuugcugaaugccugcugcaugcaucccuccuggggccagcaggacugucccguggauggacguuucuccguucuaugucucucagugagaacgcucucugggagaagaccagcucauaaccccugcuugguaauggcugcucagggccaggagagcagugcugcugauuccuggugguggaaacuuggucaaguggcugggcuucucuaagccucaucaucucaucuuuaaagggaauagcaccaccaccucccagugagaaugaaacaugagaaaacauaaauaaggcaccggguccagccgcuggaacacagcugaugaugagaaauauacacaaaucuuuuccauuauuuaauaacauccacacuaauuauaacuuuaaggaaauugccaugacuuugccugcagaacagugcugauaagaaaagcagaaaaggaaaaaaagaaaaaaaauucaaaauuuuaccuaaaugaaaggacacaaaacaaauucaccugauucaugugggaaggacaggcugccuugaguucugcagggagcaaaguuggcaauccuggaguucagcauugcuacgguggcuggguggcugaggcccaaagcacugcgcaguggugugugugugcgugugccccccagggcauguuucugaucccgcuggcugcccucugccugggccacugcucaccuugguuuugaucugcuuggccgugucggugaggaagauggaggaguuggggucgcuggcacucauuuuggucugggcgcccugcagggcugggaagaagguggagugcagcagggcugguuuaggauagccgauccugggggcgacgucccuugucauucuaaaguaaggauccuguggggagaguaaggacccugaugagggcggccagaaaacaugccagcuuucagccaugagcagucccugugagcaucuucccagaaggcucucaugcuuccaaccaaagaaauucacucccuccuccccuucaucuuuuccuuuuuuuuuuuuaaauuuuacuuccaguucugggauacauguacagaacacgcagguuuguuacauagguauacaugugccauggugguuugcugcacccaucaacccgucaucuagguuuuaagccccgcaugcauuagguauuuguccuaaugcucucccuccccuugccccacuccccaacuuucuuuccuuuuuuuugagacagagccuugcucugucgcccaggcuagagugcagugaugcgcucucgcugcaaccucugccucugggguucaagcgaggcgaguagcugggauuacaggcgccugccaccacauguggcuaaauuuuguauuuuuaguagagacgggguuucgccauguuggccaggcuggucuugaacuccuggccucaagugauccgccugccuuggccucccagagugcugguauuacaggcgugagccacccugccuggcugcccaucauaucuuucaauaccucuccccgcugaagaguaagaggaaccugcugucaaugccccagacuuagagagccuugcuuuucugccugcugaccuggucaauggcacaugggauaaggcacuggauauccguccugucucggaagaucugugggaaugaguugcugaaggagggagcagccuggauggcaggaaaacugaucuucccugaaaaugagaaaaaguauuuuuacacgugagaugaguuccuguucugcuuaguuaauaaaggaaugaacaaaaacagguuuucucccauuauaaaacaaucauuaaaauaaaucuaaaaaauacagaaaaguagaaagaacaagcuguacaguugcaaugugucugauuucauccauuuucuuuauauauuuuacucuaugcauuuuuguugugauuacacuauauuuggucuuuccuuggcuuuuucuuuuccuuuuuuuuuucucagaaggagucucgcuuuguugccaggcuggagugugguggcucgaucucagcucaccgcuaccucugccuccugggguucaagugauucuccugccucaggcucccgaguagcugggacuacaggugcguaccacacccagcugauuuuuguauuuuuaguagagaugagguuucaucauguuggccagcauggucucaaucucuugaccucgugaucugcccaccucggccucccaaagugcugggauuacaggcgugagccacggcgcccggccuuccuugccuuuuucauuguaaugacuauccauguuguuacuaaguauauucuauccugucaauguaucauaucauuuaaccauucucuagccaccuuccaccuuuaauuaucagaaguuaugauggcuucccucuucccucuucccucuccccacggucucccucucccucucuuuccacggucucccucugaugcggagccaaagcuggacuguacugcugccaucucggcucacugcaaccucccugccucauucuccugccucagccugccgagugccugcaauugcaggcgcgcgccgccacgccugacugguuuucggauuuuuuugguggagacgggguuucgcuguguuggccgggcuggucuccagcuccuaaccgcgagugaucagccagccucggccuccugaggugccgggauugcagacggagucugguucacuuagugcucaauggugcccaggcuggagugcaguggugugaucucggcucgcuacaaccuccaccucccagccgccugccuuggccucccaaagugccgagauugcagccucugcauggccgccaccccgucugggaagugaggagcgucucugccuggccgcccaucgucugggacguaaggagccccucugccuggcugcccagucuggaaagugaggagcgucucugcccggccgccaucccaucuaggaagugaggagcgccucuucccggccgccaucccaucuaggaagugaggagugucucugcccggccgcccaucgucugagauguggggagcgccucugccccgccgccccgucugggaugugaggagcgccucuacccggccgcgaccccauccgggaggugaggagcgucucugcccggccgcccugucugagaagugaggagacccuccgcccggcaaccgcccgccugagaagugaggagccccuccacccggcagccaccccgucugggaagugaggagcgucuccgcccagcagccaccccguccuggagggagguggggggucagccccccgcccggccagccgccccguccgggagggaagugggggggucagccccccgcccggccagccgccccguccgggagggagguggcggggucagccccccgcccggccagccgccccguccgggaggugaggggcgccucugcccggccgccccuacugggaagugaggagccccucugcccggccaccaccccgucugggagguguacccaacagcucauugagaacgggccaugaugacaauggcaguuuuguggaauagaaaggcgggaaagguggggaaaagauugagaaaucggaugguugccgugucuguguagaaagagguagacaugggagacuuuucauuuugcucuguacuaagaaaaauucuuauccuguugaucugugaccuuacccccaacccugugcucucugaaacaugugcugagucuacucaggguuaaauggauuaagggcggugcaagaugugcuuuguuaaacagaugcuugaaggcagcaugcucguuaagagucaucaccacucccuaaucucaaguacccagggacacaaacacugcggaaggccgcaggguccucugccuaggaaaaccagagaccuuuguucacuuguuuaucugcugaccuucccuccacuauuguccugugacccugccaaaucccccucugcgagaaacacccaagaaugaucaauaaaaauaaauaaauaaauuaaaaaaaaaaagaaguuaugaugaauguauuuugauauuuaaaaguguuuaguguuuuggauguuguugcuguuauuacugucauuaguauuugcuuagaccugcagaagcagaacuuuugaccucucuauggcccgacagguggugccacgccagcccccaccaaguggcgguacccagacccuugggugagcgcagagguuuccgggcccugggcacgcggcuggcccagcgugacccugacgcuguggagcacacgccgcuguggcucuggcuccaagcagggugaacgcuccucacggagagccccggcagcgcaucccagggagcuggcucggcuggcagcugacugaaggccucaagggccugcuaugccugaagccacgcaccaaacaucaaguagaggaggggaucagaaggcccagccacaagucucaaggaccaaaagucuaaaagucuacgaagccaaugcaucugaaagacacauggaaauuuauggagagggccaugaaggcaugcacgugggaggcaaaccauuugcacaucugcugggguggagccauggaaggagagcagggcaggggugggaaggcuccagaagaccucgugucaagccccucaucuuacauguggggacacugaggcccagggagacaaagacucaaaggcccucucaugggcagcagacccagcuguccuucuucaucaccccuggguuccauccaaggccacccuacacugacuggggucccaccagagcuguuggaacuccaaagucauccuuagauuuuucuuucuucuaaaccuuaagacgggugacaagagagggacagacucacauccugaagugcagcuucacccaacccagagaagcugcucaaugcauuacacuagcuagucagauuccaggacaacgaugacccacccacgccugggcauccuacuuaaagagacaguugcaaacgcuaacaucucagagauauuuaaaccaggcaugugucuccuccagaacucugcuccuuuuugaagggugcagggagugguccacagcagcagugggccucuuaccaaugcagucgcugucagugaagccgaaaaugccuuucacuugguugaagguaacaugcuuuugaaucuucaccacauuuuuguagaaaccugagcucauccugcaaagacaacgagaaugaaaucccaaacggagggcggccuucacugaaggcaaagucacaguuauuaaaauuggaugccaaugaguaguggcaugggccagacucggggccacauuguggucaacacguaagcacugggaaggugccaggaagucaucuguaggcaaagauaccugcaucaggcaaagcagacacacguuuaccuguggaguugacugggaaaggcagaaaccagugugaaaccgacgugaagcagacauacaaacaaggcaagaacacaagcagauucagagacuugcagcuagcaugaaaaauuuaaauucugccagggucagcaguucagugggcuguggagcucaagucugggagcccccaggagcuucuuagcugagacauacuguguugugggagaccaucugcuuguugucggaugagcguauggauagaaacccacggcccgagaaggaggaaggccuguuucagugcagcugguccuccuagucucuggccacugcuccccccugcuguuugggcagaacuaacccuauccacagcaacagggcuaggccacaguggcugauucaagcaacccaacucucucuucuggauggugagggguguggguaccaggccugaauguguggcauccauuccacuaccagaaggaacuaggcugaagaagaagcaaacacagugggguguagggguuuggcagaacccagaguggcuucuuuuuuuuuguuuugagacagagucucacucuguagcccaggcuggagugcaguggcaugaucuuggcucacugcaaccuccaucucuuggguucaagcaauucuccugccucagccuccugaguagcugggauuacagcugcucgccaccaugccuggcuaauuuuuguauuuuuaguagagaugggguuucaccauguuguccaggcuggucucaaacuccugaccucaggugauccaccugccuuggccucccaaagugcugggauuacaggugugagccaccgcgcccagccaaguggcuucuuauauugcaucuuuguauuacuauauucaguagcuuuuucucuaggcccuaccauguguuagacacuacgagggaaaagggggaaggcuggugucuuuuaaguguuugcaccauguggcaggagcugugcuagaugcugcguaugugucaauacuccuaaaauccccuucaaaguaguagcauugccuccaccuuacaguuagacuaggcucaaagaaguucagggucauagucacaggcccagugaguacaggggcugggaucccaacacagauucaccuggccccaaagccuaugcuuuucucaccacaucuuauccuuuagaagaguuuagacuuuuggggcaggguggagaacuacugaaugucuuugugcaggugggguggggugucaggagugcaggaacacuggccguuugugcugggcgaagcacaaugcugggaggccuguaacggucaaggucagugccaaggccuguccagguugagcagaggcagcacgugagggauggacugugucuuucgccuagcagccggcugaguuucaggcccuggggggcacuggagagggcgggcgcaguacugugaaggggcaugccaggagaacccagcaucugugucacccacucagcacaauggaaacaacagagagcaagagcacagccaacagcagcacugccuggaaagaugcggccuuuguccuccugccaagcaagccaagaacaccgcaggcagggagggucccuccugggcaccgcagcaggacucacagccaguaaggacagcagcugucugucaccuggggagaugggcugcagcaaagacuccaugcgcccuugggauugaggcaccugggacacccuaaccccuacaaggagggaaagucuccaguacccccaaacuguggcaggacuguagcuucacggcgucugacugguauuucugaguuagagcacgcugcccuuucuuagaagacuggucauuacuugcugcaagcugcugccacugugcuggcugcagggugaaugcaggugcugcaccgugagcacgugugauccuccccucaagggacggcugucccccugcacagcugggacggacccaucacgcaaagcagccaugccagugccggcacauggaggcuucucacuggcugcagugaacacaccuaacuguauaucacauguggcugaaccaccaguuaccccagggagggcaccugcuuuucacucucagacaggguuuaaagugggaagagauuuuagauuacaacauuuacugagcacuccccaggugccaggcguggcuugaagcacuuuauaugcagugcaggcacuaucaucuccugaccacagucuucucuaccccugcccuuugucccuauuaucaccauagaacuuauuaucaccugauugaucaccuguuagcugauucuccccauuagaagagaggcuuuacacagcugcugagauaaugguuuugcucccugcuguacccccaccaugagucuggcauauagcagauguccaauaaauauuuguagaacaaaggagcagagugaagaaagcaggcagagaggagcuccucccaugcccgggccacacaguggaaggcuccucccaugcccaggccacacagcggacggccgucaagcagagcacuugcaaccucugcuaugcugccccccacuagcacccagcucccuuccucacaggaacauggaagcucagagauuuaaggacuugcccaagggaacaagaccaggcaggggcagagcugggucuggaacacaaguuuucagacucccagcucagugccuuugcaucccucagggcccugggcaggaaggccguucuggggccaugugcaaugugcagggggaacugcacuggccuccucccucauggaggccucaccaccucccucccacucaaagagggcgauggcuggcuuuguugaauuuccagcuccuaaacaccaggaaggagcuuuauuaagccaaagauauagauuuugaguuaaauucaagaaagaaaaguaaaaugcucaaauguuuagaagaaacucuuaaaguaaaauguuugaauagaggauuuacccuuuaaaaugucucuccucacuuuagguucaauauaaaaugccuuucaagaaaagauaucaucgacccuuuugguugacauacugucuggguuucaucuuuaccccauguuuguaagaaaaaaggaaguucccgaccaggugcaguggcucacgcaucccagcacuuuggguggucgaggcggguggaucacuugaggucguucgagaccagccuggccaacauggugaaacuccguuucuacuaaaaauacaaaaauuagcugggugugguggcgggcgccuguaaucccagcuacucaggaggcugaggcaugagaauugcuugaacccaggaggcagauauugcaguaagccgagaucaugccacugcucuccaguuugggcgacagagcaagacuccaucucaaaaaaagaaaaaaaaaaaaaaaaaggaaguucuuauuuagcgaagguggaggcuggucaggagcugcaaccgcaguugccaaagagacagcacgaggaauggcggccucacuccacguucagagagcgcugaaagugggguugcucaggugguggucuuuucacauggacuguucaaaaguucaucuaccccaucgugcaucuauuggcugaaucagcuucauggacuauuauaggcacuugcucuugucucaccaccagcauuuauauccaucaacgaagcggcucagcuuugcuucugcugugucuguggggcccaggaggggaugggccacagagagcacaaauucaggaacuaugugucuuacucagcuaguggggagagggccacacuguaccagauguggcagagguaaggcccagccugauggaggaccagagaggggcaucuaaauuuggcuguggggagggaaagcuccuaggaaaaggugaugcuugaucaugccuuuggaagaaaguguaggaauuagcuaagcuggggguggcagggucaggagagugggugggaauucugggcagcacagagcauguacaaaggagaaggauguggaacugcaagcuguuccacugagcuggagguagcagugacgcuggagaggaacacagggccaaucacgaaagggcucgugugccaagugaaaggugagaauucucaaugucaucuaaggaggagagcugggaaagacccgcaaguggaagaugagauuagcucugaguuuuagggagaucacuggcuggugggggcagugguggugugggaagaggauagcagcuacugggcaaugccagcagcacugccugacuggaaaaggagaagcagaacccacaguugucucugcagagguucaaucaguugaaucauuguauggaauggggugagaauaaggaaauaaagugccaugaaaauuauacuaacacggcugggcaugguggcucacaccuguaaucgcagcacuuugggaggcugaggcggggaggaucacuugaggucaggaguucaagaccagccuggccaacauggcaaaacccaugagugagacucugucucaaaaaaaaaaaaaaaaaagaaaauuaugcuaaugaugacaucuauguucuuguuugaucccauuucauggacacggcugcuaugacacacagccacuaaacccaggugccaggaucuggaucccugucuauuuuccuuccuucaaggaugccacagggccuccaugcucacauggcugaaccaagagaaguaauuuuaaaagaucuaauaggugcugggcgugguggcucaugccuguaaucccagugcuuugggaggccgaggcaggcagaucaugaggucagaagaucgagaccauccuggcuaacacagugaaaccccgucucuacuaaaaauacaaaaaauuagccggacaugguggcgggcaccuguagucccagcuacuugggaggcugaggcaagagaauggugugaaccugagaggcggagcuugcagugagccgagauugugccacugcacuccagccugggugacagagcgagacuccgucucaaaaaaaaaaagaaaaagaaaaagcuaacaguuuuacuggcugauagaagggcgagauuuccuaucaggguauacauugcucucaauggauauaaaaccacuacucaguuucuuucuuuuuuuuuuuuuuuuuuuuugagacagagucucacucuguugcccaggcuggaaugcaguggcaugaucucggcucacugcaaccuccgccucccagguucaagcgauucuucugccucagccucccaaguagcugcaacuacaggagcacgccaccacacccggcuaauuuuuguguuuuuaguagagaugggguuucaccauauuggccaggcuggucucgaacuccugaccuccugaccuugugauccacccaccucagccucccaaagugcugggauuacaggcaugagccaccgcgccuggcugccacuacucaguuuuaaggucuuauaagagggaacguucuggggaugcggcucuaagcaaguccuccugugcucacugcucaccugccccuuuagugucccucuuauccugccucggcauggucccugauggugagcuaacaugggagggccugcucagagcccagccugggcugcaggagcauagcaaugaacccacuccuccuggggaaucacuuuaggggaggaguaacacgucuuuggggaguggaguaacaugccuuaggggaguaccaugccuuaggagagaccacgccuuaggggaguacuaugacuuagaagaguaucucaccuuaggggaguaccacaacucaggugcucaagaaauauuuguugagcuagauaguauccuucuugugaugguugaccaaagucuuauuuuucuaacacauuucuugguaaucauuugggaugaaacuugaaggauuuucagaaugaaauauuuugguuuauuaaauggcugauuaaaagaacuagacugaggaaacuguguaaccacugagucuuuucucugugaggaaaaggugcguugaaaaggaggaagacauaacucuggaagacugacuauccuuggcaagaaacugcaaggcaggacuuccuggcacagcugaggaugaagaucugagaugccaucaugcuguggcugagcccauauuuuaaauuucuguaaauguaauuauggagacaauaaucgagucuuuaagauacugauaucacuuaauccuuucuauguacauacacagcuuuucacuuucaaaauuauugguaaauaaaaccaauaaaccagcucauagcauuuuuuuuuccuuuuugagauggagucucgcucuguugcccaggcuggagugcaauggcgugaucucaacucacuguaaccuccaccucccggguucaagcgauucuccugcuucagccaccugaguagcugggcuuauaggugcgugccaccacacccaacuaauuuuuguauuuucaauagagauggguuucaccauguuggucaggcuggucuugaacuccugaccucgugacccgcccaccucggccucccaaagugcugggauuacaggugugagccaccauggcuggccacucauagcauuuaauaaaggaagaagaacauuuacuaggccuuaagaccauuucaguuguuucgaauuuagcuguggucaugacaacuugacauccuccucuaccuauugaaaaggcagccagacguuuucuccuuaccccauguaguccaggucagagaauaugaaagucuuguugaugucaaagccacaggcgaugauguccuuggcauucuccacagcauagcuauaggccugguccagggucagguccuuccacagauacuucucgucauccgucaucuggaugaccaagggcacguuaaauacauccuggagccaccuaaagaaacacagggggagaaagcugacgucucaucuccccuguggaggaacgccaucgugcaucugaaaacacagcuccuacuuacaacguauguuaaaacuuccuugccuacaaaaucacaauuugaauugugauaugaauuugacuauggauaaugauaaggucuacuaccauuuaucgaccagguggcccugugugcucuguguuagcugcucuacacacuuuguuuugaagcuuuacaguaguucuaugagguagguaucuucauucucaucuugcagauguggaaacuuaggcucagagaaguagcaggcccauggccaugcagacagggagcaggaugagaagaggagcaggccuggcugacuccaaagcugcgcucuccccaucacuccaugguccucuaaagugagcccaggaacaaagugaauggaagccaaaaaagugccaacucuugacaucuugguugcucagcaaaugaacuagcaugaucuugucaguucuaaacaugguuuauaagcaacauucucaauucacuaagagaguaagaaaagccauaagauccaauacuuacuuugugaaaauaaauggaaugaggugaccuacaugcauugcuucagaagaggggccccggcccguguacagauaaaauggcuucuuauuuucauaggcaucaagaaccugauucauaucucuaaaggaaaaaggagaagaggaagagugugauuuucugagaaaaauaucaaggcacuaaugcacuuuuggaaauggaaaauauagacagagacgaaacaacauggauaauaacuagaauuuguuaccuuuggugcuuaugauauaaauauagacaggaaacuucuacugaaaugguuucuccugugaguguuuuaaaagacaagauguguagguuuggaauaauguguuuaaaagauggauccagcuaugcaguuacugggacuccuggaaucccuccaaacaucagugccgacauacugugagcuugguacacuucccuggggauaccaggccaacaccauaugauccuugcucagaaucacccagccccgaggacucucagaccaauaccaggcaaacugcaugggaccagacaguccuggcuuagcagggaaaguaagaauuguccucugggaguucagaggucaagugcccaguuggagaucuaucugggccccucagccagcuugggacuagguaucuucaucugcaagucacucaagagucaucccccucccuaccaggcugcuuccaaucacagcugccugcgccccaccuccagagacugauucaauggaucugaggugcucucugggaauguguuuguuuguuuguuuauuuauuuauuuuugagacagagucucacucugucacccaggcuggagugcaguggugugaucucugcucacugcaaccucugccuccuggguucaagcgauucuccugccucagccucccgaguagcugggcauaguaggcaccugccacuaugcccagcuaauuuuuuguguuuuuaauagagacgggguuucaccauguuggccaggcuggucucaaacuccugaccucgugauuugccugccucggccucccaaagugcugggauuacaggugugagccacugcgccuggccgggaauuuguauuuuuaaaaagcuccgugaggaguuccaauguucagcagggugggaaaccaacgcucgaggaugaauguccuuuguuucuggguaaaguguccccaaauacaagaggaauaacuaccuuuuccagaggucuggauaggagaaucuagagaacaguauucugaaagugacuucuccuuauauuccccaagccaagggucaacauugcuuaucucuggacagauacaauuguggguguucugguuuuugggcuuaguuuucauuuuuuuuccccaugaaaugcucacauacugcuuuugaaauaaggaaagaaaauaacccauaauuuuggaaggaaagaauccuucuuugguucucacaacuaaccauaugggcuuacagaagagaaaaaaauguaacugugccacgagcugcuuuucuuguguuuauguggagcaucugagaacucacugugugcucgguccuggggugaggugcuccugacaagcgugcagaaauuuacuggguuccaauuuugagaucauguuuuaugaggauggauuccagcagagacucauucagcuacuaagggaacccaguuaccugcccaccacuugaagcuugacugugcauaguagaucucauuuaauccccaauuuuacagaugacaaaauuagacagaggggcaguuugaaauuugagaaugggcaaaugacucagguccuaugcuuuccuaagccaagaggcuacaguauuacuauacugcaguuaauaaauaagucacaaaggcagugagaagaaccaugccaugcuaagauaaaaaaugcugacuacaaaccaacaaaauuaguaaacuuugaaccaaagugacuggguguguguguguguguggggggggguguggaauaaaagagaagacucaaacggccaaaaucaggaauauaagaagggguauuacuacugaccuuauaggaauaaaaaggauuacuacauaagggaauacuaugaauaacuguauaccaauacauuagauaaccuugaugaaauagacaaauuccuagaaacaaacuacugaaacgaacccaagaagaaauagaaaauauacacagaucuggaacaaacaaaaagacugaauuaguaaucaaaaaacuuccuacaaagaaaagcccaaaaccccauuuucacugguaaagucuaucaaauguucaaaaaagaauuaauaccaauccuucccaagcuuuuccaaaaaaaauugaauaagaaauacuucccaacucauucuaugaggccaguauuacccugauaccaaaccaaagacauuaaaagaaaacuacagaccaauaucccuuaugaacacagauguaaaaauccucagcaacucacaaaccaaauccagcaacauauaaaaaagauuauacacuaugauugaaaauaaauugauuuucaacaccaugauuaaguggaauuuguuccaggaacgcaagguugauuaaacacgcaaaaaccuaucagugugauacaccauacuaauaaaauagaggccaaaacccacaugaucaucucaauaaacacagaaaaugcauuugauaaaaucuaacaucuuuucauaauaaaaacacauguugaaggguauauagaaagcccacagcuaacauuauacuaaaugguguauauucagucuuuacugaaaguuuuuccccuaagaucaggaauaagacaaggaugcucacuuucaccacuacuauucaacauccuauugaaaguugaagucagagaaauuaggaacgaaaaaaaaauccaaauuggaaaggaggaaguaaaacugucucuaaucauaggagauacaauccuauauguaggaaauccuaucgaaucugcaaaaagaaaaaaagcauuagcgcuaauaaacucagcaaaauuucaggauauaagauuaauacacaaacaucaauuguauuuuuuuuuuuuuugagagggaguuuugcucuuuuugcccgggcuggagugcaauggcacgaucucgggucacugccaccucugccuccuggguucaagugauucuccugccuuagccucuuggguagcugggauuacaggcgcccaccaccaugccugcccaauuuuguauuuuuaguagagaugugguuucaccauguuggucaggcuggucucgaacuccugaccucaagugauccacccgccucggccucccaaaguguugggauuacagguguaagccaccgugcccggccaucaguuguauuucuauauaguagcaaugaacaaucaaaaugagauuaagaaaaugccauuuagaauagcauuaaaaagauaaaauucuaaugaauaaaucuaagcaaagaagugcaaaaccuauacacugaaaauuacaaaacaucaaugaaagaaaucaaagaagugaaaagacaucccauguucauggauuagaugaauuaauauuuuaagauggcaauacuccacaaaugaaucuacagauucagugcaaucccuaucaaaauccuagcugcugcuuuugcagaaauggaaaagcugaaauucauauggaaaugcaaggggcccagaauaccuaaacaaucuugaaaaagaaccauguuugaguacucacauuuucuuauuuuuuuuugagacggagucucacugccacccaggcuggagugcaguggcgcgaucucggcucacugcaagcuccgccucccggguucaugccauucuccugccucagccucccgaguagcugggacuacaggcgcccaucaccacaccuggcuaauuuuuuguauuuuuaguagagaugggguuucaccguguuagccaggauggucucaaucuccugaccucgugauccgccugccuuggccucccaaagugcugggauuacagacaugagccacugcgcccagccaagaauagucuuuucaaaaaacagugcugggacaauuggauacccacaagcaaaagaaugaaguuggagcuguaccucacaaauauacaaaaauuaacucaaaaaggaucagaaacugaaauguaagagcuaaaaccacaaaacucugagaagaaaccauagguguaaaucuucacaaccuucgauuagucagugguuucucagauaugacaccaaaaacacaaucaaucaaagauaaaauaaacuggacuucaucaaaauuaaaaacuuucauacuucaaaggacuaucaguagagugaagagacaaccuauauaaugggagcaaauauuugcaaguaauauuugaauaagaaacuaguauccagaauauagaaagaacuauuauaacuaacaauaaaaagacaacccaauuaaaaaguaggcaaaggaucugaauagacauuucucuaaagauauaaaaauuguuaauaagcacaugaaaagauucucaacauccuugucauuagggaaauacaaucaaaaccacaaugaaauacuacuucacaccuauuaggauggcuauaaaacacaacaacauggaaaauaacaagagugggugaagauguggagaaaugggaagcuuccuauguugcuggugggaaaguaaaaugauacaguugcuguagaaaagucugucaguuccucaaagaguuaaacauggaauuacuauauaagccauuaauucuauuucgagguauaugcccaagagaauugaaaacauauauccacccaaaaacuuguauacaaauggucagagcagcauuguugauaaccaaaaagugaaaauaacucaaacguccaucaacuaaugaaugaauaaacaaaaugugagguauauccauucaauggaauauuauuuggcaauaaaaaggaauccaguauggauacaugcuacaacauggaggaaccuugaaaauguuaugccaaguaaaagaagccagacacaaaaggccacauguuacaugaucccauuuauauaaaaugccuaaaucuagauauagagaaagcagacuaaugguugccaguggggagggagaaaugggggaugacuguuaacccauuuaugccuaccuacuguuccaaaauuggaaugcuaaacuugugggaguuauugauaucuuacugcucaaggugauugccaaggucugauuuuucacaaaaaauuuuuacaacuucuggcauaaauggguuaauggguagaaguuuccuuuuggggugaugaaauguuuuggaauuagauagucuugauggucucacaaccuugugaauauacuaaaacccacuuaacuguacauuuaaaaaaauaaguuuuauaguaugugaauuaaggaaaauuuuuuauuauauuccacccagaaaguggguugagcaaggccuggaguucuuugcagguagaauuugaaguguuugggcagacugcugggcucuguccugggguuguucuccuguaagcgugaagugccaguagaacagaacaacccuacaucagaucauaaauuccauggacacagcuucaaaaagggggcugccucagcccagauaacuguagguugggagaggcagaaacucuuuuggaaccugcccauaucuugacguuaucugcguggaauuuacggccuaagguacagauaaucuguuccaugcauucucuguugguuugucuguugguauuguuuaugagcaagucaauacaauaggaggaagaggguuuggaauuucaggaagccuacuguuugucaugugggaaaugcugaucuuggacauauuauucucuuuuguuuucaugacauuuuauaauuucuuuacagccuguaaucugggaagaaucucaccugcuauuaauaugauucccaccuugugaggugggcagucuacaaaugaaaaaacuaagagccugagggugauggacaagcaugaucccacaguggguuacugacaggacagaggauggaucucagucuuaccacagcuggccaucacuuuucccacaguaccagguggcuuaugaagagagugucuuacgauuuuuuugaacuaaaagaagaggacaggugagaaggccuguggugaagagccccugaccugugugagaagaagaugccucugcgcaggaagugguguggucuuuggccgguggcucucucuauucgguuuauuagcucuuugucaauuuuacuacuuccaaaccgaacuggaaaaaaagaaaagaugacuuucuuagguggcaggagguuuagugaucagauauuacugaaaugaagaugaaaagugagugauccaugcacaaucuuaaugaacacaaaccucuuuaggccuucugcuaaagguccuuacccccaacaugaaguaaaaggucuuuggauuaaaacaacagcugagaucaacacaaccaacaaaacaggaaauaaauuacaacacaaaaugcuguuuugccugagacuggguucugaugggaaacauauucagaaugcaguccagcuagcaacuuuugacaacaaaauauaaacauauacauauauaaauagguauauauauauauauuuguuuauuaagguaaaauuuauauucauugacaaccaugauuucucacauucuuuauuuguugaacugaauuaaugucggucuucaagugaauuuucccucauugauagucuauacugaaaucauggaaaauggcuuugacuuagaugaaaacauuucaguucuguuucuucucugauaauuagcaaugaucucagaguaaagacuucaauggaauggcaacagucuuuccugagcaggaaggcccucaaggaagggcaugacaguaagaacuugcccgaugugagaagucacugcucuuaagcugacuuccagccuucuagguccauagucaguaucacuggaggugaaaccuaaguaaucuaugauugacuuguagccacuaaauguuauaaauggccauuucaauagaccuuucccaaguucugaagugcucaaaaaaagggaaaaccuucuauuaagcugucuacuauagaucauuauuuugaaauauauuuuauauuguuauuuuauuuuaaaauaauccuuugggaauauaaugcacaaccaaaagauuuuaguauccauuuuuucuuggcauugaagcuucacugaauuuaugauuaauucaaaauuuaaaaacaucaauggaaucaacucaaugggaccacuucuaaaaguugcagcuuuuucugggaagaaagcagaggacguaccaaugagcuuaucguagucuaugccuuuugcacugcuugucuguacuguccauggguccacaaaauccucuucagcuucuguggcaucugggccaugauuacugguaggugcuggguucccuggaggacagucagccuuguaauccucccccgcggcagcuuuguagcucauuuuuaaugacaccaacaucuuuacugcagaaucaauuucauccugagagaggaaauaaaagggauggcuaaaaguauuacuaauagcugauaugugcugaaugccuauucuguggcaggcacuguguuaaaugcuuuuacacguguuaccuuaguuagugucacaacccuacaaggcagguauuguugucacuguccuuuuccagcucaagaaucugagacucagagagguagaggagcuuacccauagaaucacagcaagucauuggcucgaaaacacuucauuuuuaucuguuauucuagugcuaccaugaacacuuugggacaguagcagugacacaauauacacugucauuuaugacaaaguucauaugcuaaagauuucucaaacaccacugaugccagagaacgugugugacaagcuccuuuaauugagauuccuggaguucugcauuggaacuaguuuuuacauaccacacagguugagaugaauauuuacguuaacuuaaccaaugaugccacuaaggauaguaagagcaacuaaaacagauaaaagcaaggacaaaaaauguaggcucucagguuauaaauuaaggagggauucacugggaaauaguuacaucaucacauuuuggagucuuaucaaacuaucuugaaaaaaaaaaaacaaagguaaaauguacccuuggguagucuggaaauguauuaaagacucuuuugcaggaguccauaguggccaccccuggaagccugguguuuagaaaagcaggccuaauuaagcugauuagucaugcuaugcccuaaagcucuauucugguaauuggccuugcuggauuagaucacaaacaaagaauauacacagcccaauuugcuuaccaagggaaauacaaacauuuccacuuacaguuuauacagaacauucuuucuuuuaaaucuccuuaaauuccuuuuaccauauacagaauguucuauaaacaccaaccuccauucagagauaacuauuccaucagauauagcacuugggccauaaaggacugugauucuggaguaaucuguguuucaaacuacaaaauuaucugagacucaucauuaaaaugagccagauuuguggaaucaguaacccaauggauacgauucauagaugagauguuugcccagguuagauaguuaaguauguuccacccaucucauuucuguaguaccuaggcucaguacuugcaaaaaauaacaguuuaguacguauaaucuauccaauuaucuaugggaaggcuuaccuugcuuugaaguacacugcagucaauaucacuuaauaacuagcuuuguugacauuucauacucuaucuggucuaauucugcuuguaacuaggaggcucugcgaaagucaaacauuuaaccaaugucccugcucaaggaccaucugcauuuuggaauagcaccaaaauaagacaagcaggcuuaccuugucuauuuucuuauaaucagucuuaaucagugucugaaccaggacacugaaacaggauucaaaagcugauguuagcugggugcaguggcucacaccuguaaucccagcacuuugggaggccaaggcgggcggaucgccugagcucauaaguucgagaccacccuaggcaacauggcaaaacccugucucuaccaaaaauagaaaaaauuagccaggugugguggcacacaccuguguuccuagcucaucgggaggcugaagucagaggauugcuugagccagggaggcagagguugcagugagccgagauugcaccacugcacuccaaccugggugaugaagugagauccccaccccacaaaaaacccagaacaucaguuuuuuuuagacagggucucacuucagucuccugaguagcugggacugcaggugugugccaccaugucuggcuaauuuuuaaauuuuuuguagagacagggucucacuauauuauccaggcuggucccaaacucuuggccugaagcgauccuccugccuuggccuccuaagugcugggauuauaggcaugagccacggagccucgccaaaagcugauguucagaaaaaaaagccagacacaagacuguauuacauacaguucaaacccagguagagcuaccccuggugggaggagucauggcagaggcugaggcgcgugaggguggcuucuaggugcucucugcuugcuguugauuugggugcugguuacacagguguggucauuuugugaaaauucagugaggugccugcuugugcuuaugaucagcauguuuuucuauaugaaugguauauuuugauuuuagaaguuacuuaaacaaaaaggagaagaagaaaaaggcucugcucucuuucuuaauaccuaagaccuagcauugcuucuuuaguccugcucaaacuauuuccccucacagcccucagaugcugacuuauuucccccuaggaaacuugccgcuuuaaugagcugcugcuacugaaggauguggaucuuauucuuuagauacacuggagcagaaaagaccuucaagguccauggccuagauaaauggcaggagaagaaagagcucaaggugcccucucuuagaacuggcacucccaauguggcucacacuauuuugcuaaaaguuaauuuuuaaaauuuccaaaacaucaagugcuucuacuaccaagacauuucagggucagauacaaauguacuucugaauuuuucaccacuuaacucuggucucauugugcaaccucugaugucuucaacgugugccagccaauugcauuagucaaauaauacacuuggaagaguuauuauaaaauguauuaaguugacuaaaauaaugaacauaacugcagucacuaagaauuacuaacuaaaaacauuuacuaaauguuauucaaauuuaauauuaaauggacaaaaauaccacugucaacuucccaaaaugaugggcuuacauaaccccacugggucuuuuauuuauuuuauaauuuuguuuuaaaacaacuugguuuaaucguuugaggccuaccuggugaguaaaucucuuucuguaaaaaaguaacuuuuuuuugacauuacuuucuuucaguacuauuuauuucauuuaaaauaugagcugggugcaguggcuugcaucuauaauuccagcaacuuggcaggcuaaggugggagcccaggaguuugagggugcacugagcuaggauugcaccacugcacuccaacguggaaagagcgagacccugucucaaaaaauacacacacacacacacacacacacacacacacacacacaaauaaugauuuaaaucagggucccaaauagucaaaguaaacuacuggggaaugugagaugguugacacaaucuggugacaagcaagguguuugaaaagauaacagauaacaggaguuaaaagugucggaagucgggccgggcgugguggcucacaccugucaucccaguacuuugggaggcugaggcgggcggaucaccugagaucaggaguucaagauuagccuggccaacauggcaagacccccucucuacuaaaaauacaaaaauuagccgggugugguggcgggcgccugcagucccagcuacuuacgaggccagggcaggagaaucgcucgaacucaggaggcagagguuguagugagccaagacugugccagugcacuccagccugggcgacagagugagacucagccucaaaaaaaaaaaaaaaaaaaaagugauggaagucauggagaagccggaguggagucaccccagaaggaaaugaaaugcuuauguucuaguuaaagaugcguauugaugaugauauuucugaaaucuacuacaacaaaagcagagaucuucuuuuuuuuuuuuuuuuuuaaagcauaaucccacaaggacaaaggaaacaagaagaggaugacagcaacaagguuucagaagccagaaagcugaugaaugaucagugccuaacagcaugagagaaaaacaaaugcuaagacaucauggaaauacuggaaggugaccgaguguacacuguuacggaaucacccaaagguucgggccuuagugaccuugcgcacuuacaggagugggggcaggaaagcggguuaugaaaacaggagcgcugguugaagucucuucaagaagcaguuauugagaaucccucuccccucggccaagggagugucacaguuuccccuccauuccaagguuucaugucaagagaggacagaguuacaggugccuagacugggggcagucugcacaguuggggcacuggcagcacacagagaauagggagcuucggggaaggaucccacagcccagcccuucucucccacucagccguagaacucuggcagcgggacucacccccucugaacaguggacugggggagcuuucucuggggaaucucacuuaacuuuaaagaaaagaucuaaagaccuugacacgaaagauuccccaacaaaaggggagcagccuggucacucuccaggaaguggaaccuauguugauaagcucuuccccaaugaagagugcauccagcagcuuucagugcaccccccaaaacaccagcaaauagccaagaaacaccaaacaguugagaauugccucuaauaugaaaggcagguagaaaacaaauuaagauggaagaaacugagguuauaaaggauguagaggacauauggaaaacuaccauuaagaucucagagagagagaguugaguguccugagaggucagauugcugucagacauggcccauggacauggacaugagcauggacaucguaaaauggaacuucuagauuacagacaacggaagacagaagggacaccauuagaaacuauccagaagaagcuggcugaaaaagggcuaagggauccguggggccacaaugaagcuugaagauacauggguggcuuugcaaagaguguuuccuuuuuugauguauuguuuaaaggauucaaauggggauuugcugcauuugugguagcuguaggagcugaauauuaccuggagucccugaauaaagauaagaagcaucacugaagauaauaccuggaaguaucauagugguuucuuaacucuccaaaauaagauuucuucacuguagccuacucgucugguuugucccuuacagaauauuaguaagauuuaauacaguaaaauaagauuaaaaaaaaaaaucucagagagaaaagggugguacuguaccuaugagucagggcagagugcugugaggaaacuucagggagcauacaugcuccuggaaguuaaaaaugauagcagaaauggaaaacaauaggaggguuagaaaaucagagaaacagucucugaauuaaaaaaaaaagucugugaagagagaaaacagaagagaucaaagaaaucaugauuucugagaauuaacggccaugaguuucuagucuaaaaggcaggcugagugugguggcucacgccuguaaucccagcacuuucggaggccgaggugggcagaucaugaggucaggaguuugagaucagccuggcuaauauagugaaaccccgucucuacuaaaaauacaaaaauuagccugguaugguggcggaugccuguaaucccagcuacuugggaggcuaagacaggagaacugcuugaacccaggaggcggagguugcggugagucgagauugugccaccacacuccagccugggugaaagagugagauuccaucucggggggcgggggugggguggcaaaaaaaaaaaaaaaaaaaaaaagaaaggcauacugaaccugcaucccaugaaauuucagaacacgggaacaaagaagauccugcuaacuuccaaaaagaaaaaacaaaggaauggcaacugacuucucugcagcaagcccagaagcuaggugccaauagagcaguggcuucagcauuuccaggggaaaucacuuccaugcuagaacccuacacccagccuggcuaucaaucauguuuuagguaaaauaaauacgcuuucagaugggcaagaucccccuagaaauauuuccuuugcaauauuuuuuucagaaacaauuggaagauuugcucugcccaaagaguaaagcaaagaggaauaaagaugcaggagcaggaaacggggcacccaaucgacaggggugaaagaaccccuugggucgacagugaagaaagacgccaagaugggcaguguaggaagcaagagcccccacuucagagggaagcaggcagaagguuuugggagagaucgccucaagaagaugaacuugauagacuaguugauguguguugaaaggagauucacuggacagggaaagggcuuggagauacauuaucauuaguaucauugacauaaaaaagucaagcaaacagauauuaagacaaauauuaacuccagagaaaacaaaagcugggcgagaaaguuagaguacucauucuauccgugaugguucagcuguccacgucuauuuccauggucauaauaaugucaguguacagauacugaccuaacuacaacugcaauacagauggggagacugccuggacgggaagugguugugaagguacgaaugcuucauuuccaccugaaagaccccaacuugaaaaucaacaaggaacaauaugauaagcagaauauuuacagauauggggaguacauaaccaaaagaucggcuaaaagaauugagcaggaaauagggagaggugggcuggagggccacuguauuucacaaaggcuuugagaaccccugacucuuuagaccacaggcaucccaauguugauaaaggaaaaauacauuuaaaacuauaaccaaggcuggcgugguggcucaugcugguaaucccagcacuuugggaggccaagguggacagaucaccugaggucagggguuugagaccagccugaccaacguggugaaacccccaucucuacuaaaaauacaaaauuagcugggugugguggugcaugccuguaaucccagcuacuugggaggcugaggcaggagagucacuugaacccgggaggcagagguugcagcaagcuuagauugcaccauugcacuccagccugggaaacaagagugaaauucccucucaaaaaauaaaaaauuauaaccaaaacaccucagucauugaggaaaccaucuauucuagaggaacacaacccuacagacuugggaggcucagcugccuucguggagaacccagcaaaaucauguaccuuugacgcauuucccgcuuugagggaccuuacgagcuccccuuguguggcgaugcuguugaacagcuccagcagagaugcgggcucacuguugggcauguuugcuaucucucaggaacuacguucacagccggccugaggucagaggauuuguucagcagacgagucaagacuggggugggggcggggaaggagagagaggaaaaaccagagguuaacacaacaucgcggcuguuuuuccuuuccuguauugaguccuuuuuuccgaaaagguugugaggugaguuacaguaaaggacauagauaauauaauaaaaagagaaccagaaauuuggggccaugaagaagaggaaaaccaucaaaugccagugaugaagacuaaaggaguggcuaggauuuacugacuuaaggugugaaucuacuugacuaggaggggcccuccuagucaagaucaaguuugcaucuggugaugccccugugcccccacccagugcccagaacacaggaggacuccuguuugcucaggguauaaauaccaauguguuuuaaugaacuuaaguucauugcuaaaaacuuuuggcaaauuacuauuugauuuuuuuuuuuuuugagauggagucucgcucugccacccaggcuggagugcaauggugugaucuuggcucacugcaaccuccaccucugggguucaagcgauucuucugucucagccuccugaggcugccugccaccaugcccagcgaauuuuuguauuuuuaguagagggaggguuucaccauguuggccaggcuggucuugaacuucugaccucaggugauccucucacuucagccucccgaaaguguugggauuauaggugugagccaaggcacccauccucuauuugugguuuaucuuaauugccuuggggaugaauucuugggcuuuugcagccauaacuaauauaucgcugagcaaaugucuuccacugcuggucagcugcucucagacaaagugagcucugggguggaggacagggccuuaccuguccuagguuccacaugagguaaggacugucuccagucuguccauuccacgugcugccuuauuuaacuacaagccuuugcagaaggugugucugcaccuccuauuagucaugauucauuauaacccuugcaggaaguggggacauggcagacagagacuguaucgccaucaaaccuuucuuggcucaaucacuuccuaagagucaaguuuccuaaccuauaaaauggcgccaccaggaacuucaucuaccccaggcucuuaugagaacaaaaugagaaaaaaaaggcaugguagcacuuuguaaacuguaaagcaagauguaacuacguuacgagugcuguuauuaaauuucuuguguuucuuaggauuccaaagauuggcugaacuccagcuucauuuuaacuugcuguaaaaccuuggagaaggaaaaugacaaggcuagugccugagcugcuaacuuugaacaccucuguaccuguuauuguucuaagcaccguauauguaucaauucacuuaagccuugcagcaguccuaugaaauagauuuguaaucuccauuuuauagaugaggcacagagggguuaaaaaaaacuugcccauggcugggcaugguggcucauaccugcaacccuggcacuuugggcaguauagugagacucuacaaaaaaaugaaaaaaaaaaaaauuagcugggcaugguggugggccuguaaucccagcuacuugggaggcuauagcaggaagaucacuugagcccaggaguucgaggcuucagugagcuacguuugcgccacuguacuccagcccgggugacagaguaagacccugucucuaaaaauaaaaauaaaauaaaauaaaacuugcccauguuaacaucacaaggaaauggcagagaugcguuauagacucuaguaguuugacucuagagccuacacuuucaaccauuaucuuacaaaugacuuaucuuuaugaaccaaacauauacauuuguggugucauuuauuuuacucuauccuauccauuuguuaaauauuugcuuuaaaaguacguaaauuggcugggugugguggcucacgccuauaaucccagcacuuugggaggcugagguggguggaucaccugaggucaggaguuugagaccagccuggccaacauggugaaaccccgucucaacuaaaaauagagaaaaauuagcugggcaugguggcgcacaccuguaguuccaaauaccugggaggcugaggugggagaauugcuugaaaccaggagguggagguuucagugagcugagaucacaccacugcaccccagccugggugacagaaagguucugucucaaaaaaaaaaaaaaaaaaaaguaggccagguguggugacucaugccuguaaucccagcacuuugggaggccaaggaggguggaucaagaccagccuggcccacauggugaaaccccaucuucacuaaaaauacaaaaauuagccaggcaugguggcauguaccuguagucccagcuacuugggaggcugaggcaugagaaucacuugaaccugggaggcagagguugcagugagcugagaccaugccacugcacuccaaccugggcaacagagagagacucugucucaaaacaaaaaaaauuccaaaaaguauguaaaucacgggugcugugagcgguggcucacaacugcaguccaagugcuuugggaagcagaggcgauugcuugagcucaggaguucaagagcagcuuggguaaugucaggucucugagcccaagcuaagccaccauauccccugugaccggcacguacacauccagauggccuuaacugaugacauuccuucacaaaagaagugaaaauggccuguuccugccuuaacugaugacauucccuugugaaauuccuucuccuugcucauccuggcucaaaagcuccccugcugaucaccuugugaccccugccaccugcccgccagagaacaauccccuuugacuauaacuuuccuuuaccuacccaaauccuauaaaacggccccacuccuaucucccuuccaugacucucuuuuuggacucagcccgccugcagccaggugaaauaaacaaccuuguugcucacacaaacccuguuugguggucucuucacacggacacgagugacacgagugaaagguaacauggauagugagacccugucucuccaaaaaauuuuuauaaaauaaaaaaacaaaaauugaaaaaaaaguauguaaaucaaaacuuauuuaauucaaugaaacuauaauacugaaaaccgggacaggacagcagccaguuucuuucuccuccuugaugagaaccaccucaguucccagaaagggagguuuggugagauaacugacucagauaagaaagcauccaguuuagggaggaaugccggaguacccucugccuagggcuagagagaacucucaggcucucccauucccuccccagcaacaagcugagcaaaucagucgaaauccauuucucucuaaggucucuguccauaucaaauaacgaucaaacucaugaaaauuacuucuagccacaaaucaucaaucaucauguccagaaaccuauccugaauucucccaacucucaaagcuggguguuacucuaugugcccugcaauagcagacaagaggcugauggcuccauuaccagggaguagcuaagccagaaucugauucccaagcccccuugcucaugugcucucucagaaucccugcugcucccugcugccugccugccugccugccugaaaugucucacacccuucucugccugaacucugcugauugauuaucuuuccaauuugaaccucagcucuucacagccucuccugacaccuaugcuucugggaacaaguugguugcuccauccuuugugauccccaaacacuccuuuaguaacuuuaugaaagcacucacacugcaguuuaguuauucaugucuuccccagcagacagcaaagguaagcccuggguuuauucuuccauguaccucuaguaccuggcacacagcuuaucaaaaaauauuuaccuaaugaaugaaucuccuuagucaucuaguucaacuuuuuccucuaagguuuauccuuagaaugucuuuacuuguuccaguugaagacugauucccccagcuggacuuuagauggccucuuguuuaacguccugguacugaguugagcuuucccacaucuaaggagagccaggcuggucucuuggggucuccuccaggucucccaaccuuagucuguuuucuucacccucugcuaacaucugcccaccauccuggucacuauuuuuggaauuccuuuugguuuacccuguccuuccaaaaaauguggugccccgcgugaaggcaacaaggcagcagcaguaagguuuugaagucaaucaaguauaaaaauuauccuuaaaaauuccaggggaaagugccagguagaaugccugagugaucccaggacagccaaucucccacugcaauagaauagauaacuguuucuuugcuagaggaucagcuagauaaacaggacuugcauuuaggguccauguugcagggaaaaacaugugucuauaaauaucagaacuccauuuaagaagcacaugggaaugaaauuagacugaggaaauagcagaugaucaugaucacaaggcauauacuuugcgugggaaucauccacacuauugaaaucuuguguguguguguguguguguguguguguguguguguguguaugaugcaacuuucuguguggucagagacaaggagaauggaacuaccaucuuccucauuucacgcauuuaugaguuuaccccauuuccuguguaaauguucuucuucccccuaccuauugacauccuccuuuauuucuuuguugacuuucagaauugaguugaacuucagagguuuuucaacuuggaguucaggaacaucugaaauuacauuaaugcuugcaaguacauugguauguacaugguuuugagcagucuccuggcuuucuuaccuuucgaaaggaggcugagaugccaaaagguuaaggaccauugucuucaguguuuaccacauaaauugcaaauaggacauugagacuuuguuaagagaaguagauucaccuguuuaacaaauaguacacucugaaacaaagaaaugcaguuauaaccagugaaguacucuauuaucuucccuaaacaaaaguacugggcguguaaagagcaaaacugccuacuccacagcagaucacagcagaccuucaaggagaaagcuaaaaagccucuugaaaauuaacccccaguucccccuuuucaagaacuugaaucuugugcucauucugaaaguuuccacugugguggaggagcauaauaggcacuuaaagaaacuggguauuguauugggaugaggaguggaaaggacuauagaauuguuuaacagaacaacaugauaaagacuuggguugcaucaaaaucaucucacagagaucagggcacgcugauucugcaaucuggggaaggguggcaucaagacagccaauucuggagcaggugagaagagaauguggcccaggaguguuucuggaucccuggaauaccaccaggagguagaauaccauccuuucuaucuuggccccagaguguaggugacaauaccuuuggacuggcaaguucccagaggacaagaaaaugacuucuuuagagcaaggauuucuugacaccuuuugggacccaucauguuccauuuuuuuuaaacacuaaaagaaagauugcuuuccccgccaaauaacagcaugaacauuaucuuaaaaggcaaagacauuaauuucuaugaagccaggcacgagacacuuuugggugucacaauaagaaugacaauacguucugauguugagcacagaaggagggugcaucagugaaaauuaugacagacagcaugacggugcugagaggcaagcuacggauccaagcccgcgacugcucagccaggaucucuguucccuaugggagcagugaaucaccugaacuuugggucaauggaagaaguaaaaugcauaacacccuaauccuaagacacaaguccugacccccuaaaccaagguuuucagcacuuugcuaaaaacacgaacaagcucuaagccuggcaaagauggcaauacauacccagguuguggaagacacugcagagguggccacuggucacgcugggcaguugagcugcugagagugcccugcccagccagaaauggucuuuaauacucuuccccucuuucuuucaguuucccuucugaaaaaagaugcuuuugucuuucguucuccccacccugcauucagcuaaggguuucuuauaaaucacccagauucucagaaacacuugagcucuugaccaaccuucuugaugagacuguccaaucagggguggguugccuggggggccagguugagaccaaugaaacccucuugagaaucga

SEQ ID NO: 192391 - RNA, 41803 nt, Homo sapiens
ucgauucucaagaggguuucauuggucucaaccuggccccccaggcaacccaccccugauuggacagucucaucaagaagguuggucaagagcucaaguguuucugagaaucugggugauuuauaagaaacccuuagcugaaugcaggguggggagaacgaaagacaaaagcaucuuuuuucagaagggaaacugaaagaaagaggggaagaguauuaaagaccauuucuggcugggcagggcacucucagcagcucaacugcccagcgugaccaguggccaccucugcagugucuuccacaaccuggguauguauugccaucuuugccaggcuuagagcuuguucguguuuuuagcaaagugcugaaaaccuugguuuagggggucaggacuugugucuuaggauuaggguguuaugcauuuuacuucuuccauugacccaaaguucaggugauucacugcucccauagggaacagagauccuggcugagcagucgcgggcuuggauccguagcuugccucucagcaccgucaugcugucugucauaauuuucacugaugcacccuccuucugugcucaacaucagaacguauugucauucuuauugugacacccaaaagugucucgugccuggcuucauagaaauuaaugucuuugccuuuuaagauaauguucaugcuguuauuuggcggggaaagcaaucuuucuuuuaguguuuaaaaaaaauggaacaugaugggucccaaaaggugucaagaaauccuugcucuaaagaagucauuuucuuguccucugggaacuugccaguccaaagguauugucaccuacacucuggggccaagauagaaaggaugguauucuaccuccuggugguauuccagggauccagaaacacuccugggccacauucucuucucaccugcuccagaauuggcugucuugaugccacccuuccccagauugcagaaucagcgugcccugaucucugugagaugauuuugaugcaacccaagucuuuaucauguuguucuguuaaacaauucuauaguccuuuccacuccucaucccaauacaauacccaguuucuuuaagugccuauuaugcuccuccaccacaguggaaacuuucagaaugagcacaagauucaaguucuugaaaagggggaacuggggguuaauuuucaagaggcuuuuuagcuuucuccuugaaggucugcugugaucugcuguggaguaggcaguuuugcucuuuacacgcccaguacuuuuguuuagggaagauaauagaguacuucacugguuauaacugcauuucuuuguuucagaguguacuauuuguuaaacaggugaaucuacuucucuuaacaaagucucaauguccuauuugcaauuuaugugguaaacacugaagacaaugguccuuaaccuuuuggcaucucagccuccuuucgaaagguaagaaagccaggagacugcucaaaaccauguacauaccaauguacuugcaagcauuaauguaauuucagauguuccugaacuccaaguugaaaaaccucugaaguucaacucaauucugaaagucaacaaagaaauaaaggaggaugucaauagguagggggaagaagaacauuuacacaggaaaugggguaaacucauaaaugcgugaaaugaggaagaugguaguuccauucuccuugucucugaccacacagaaaguugcaucauacacacacacacacacacacacacacacacacacacacacaagauuucaauaguguggaugauucccacgcaaaguauaugccuugugaucaugaucaucugcuauuuccucagucuaauuucauucccaugugcuucuuaaauggaguucugauauuuauagacacauguuuuucccugcaacauggacccuaaaugcaaguccuguuuaucuagcugauccucuagcaaagaaacaguuaucuauucuauugcagugggagauuggcuguccugggaucacucaggcauucuaccuggcacuuuccccuggaauuuuuaaggauaauuuuuauacuugauugacuucaaaaccuuacugcugcugccuuguugccuucacgcggggcaccacauuuuuuggaaggacaggguaaaccaaaaggaauuccaaaaauagugaccaggauggugggcagauguuagcagagggugaagaaaacagacuaagguugggagaccuggaggagaccccaagagaccagccuggcucuccuuagaugugggaaagcucaacucaguaccaggacguuaaacaagaggccaucuaaaguccagcugggggaaucagucuucaacuggaacaaguaaagacauucuaaggauaaaccuuagaggaaaaaguugaacuagaugacuaaggagauucauucauuagguaaauauuuuuugauaagcugugugccagguacuagagguacauggaagaauaaacccagggcuuaccuuugcugucugcuggggaagacaugaauaacuaaacugcagugugagugcuuucauaaaguuacuaaaggaguguuuggggaucacaaaggauggagcaaccaacuuguucccagaagcauaggugucaggagaggcugugaagagcugagguucaaauuggaaagauaaucaaucagcagaguucaggcagagaagggugugagacauuucaggcaggcaggcaggcaggcagcagggagcagcagggauucugagagagcacaugagcaagggggcuugggaaucagauucuggcuuagcuacucccugguaauggagccaucagccucuugucugcuauugcagggcacauagaguaacacccagcuuugagaguugggagaauucaggauagguuucuggacaugaugauugaugauuuguggcuagaaguaauuuucaugaguuugaucguuauuugauauggacagagaccuuagagagaaauggauuucgacugauuugcucagcuuguugcuggggagggaaugggagagccugagaguucucucuagcccuaggcagaggguacuccggcauuccucccuaaacuggaugcuuucuuaucugagucaguuaucucaccaaaccucccuuucugggaacugaggugguucucaucaaggaggagaaagaaacuggcugcuguccugucccgguuuucaguauuauaguuucauugaauuaaauaaguuuugauuuacauacuuuuuuuucaauuuuuguuuuuuuauuuuauaaaaauuuuuuggagagacagggucucacuauccauguuaccuuucacucgugucacucguguccgugugaagagaccaccaaacaggguuugugugagcaacaagguuguuuauuucaccuggcugcaggcgggcugaguccaaaaagagagucauggaagggagauaggaguggggccguuuuauaggauuuggguagguaaaggaaaguuauagucaaaggggauuguucucuggcgggcagguggcaggggucacaaggugaucagcaggggagcuuuugagccaggaugagcaaggagaaggaauuucacaagggaaugucaucaguuaaggcaggaacaggccauuuucacuucuuuugugaaggaaugucaucaguuaaggccaucuggauguguacgugccggucacaggggauaugguggcuuagcuugggcucagagaccugacauuacccaagcugcucuugaacuccugagcucaagcaaucgccucugcuucccaaagcacuuggacugcaguugugagccaccgcucacagcacccgugauuuacauacuuuuuggaauuuuuuuuguuuugagacagagucucucucuguugcccagguuggagugcaguggcauggucucagcucacugcaaccucugccucccagguucaagugauucucaugccucagccucccaaguagcugggacuacagguacaugccaccaugccuggcuaauuuuuguauuuuuagugaagaugggguuucaccaugugggccaggcuggucuugauccacccuccuuggccucccaaagugcugggauuacaggcaugagucaccacaccuggccuacuuuuuuuuuuuuuuuuuuuugagacagaaccuuucugucacccaggcuggggugcaguggugugaucucagcucacugaaaccuccaccuccugguuucaagcaauucucccaccucagccucccagguauuuggaacuacaggugugcgccaccaugcccagcuaauuuuucucuauuuuuaguugagacgggguuucaccauguuggccaggcuggucucaaacuccugaccucaggugauccacccaccucagccucccaaagugcugggauuauaggcgugagccaccacacccagccaauuuacguacuuuuaaagcaaauauuuaacaaauggauaggauagaguaaaauaaaugacaccacaaauguauauguuugguucauaaagauaagucauuuguaagauaaugguugaaaguguaggcucuagagucaaacuacuagagucuauaacgcaucucugccauuuccuugugauguuaacaugggcaaguuuuauuuuauuuuauuuuuauuuuuagagacagggucuuacucugucacccgggcuggaguacaguggcgcaaacguagcucacugaagccucgaacuccugggcucaagugaucuuccugcuauagccucccaaguagcugggauuacaggcccaccaccaugcccagcuaauuuuuuuuuuuuucauuuuuuuguagagucucacuauacugcccaaagugccaggguugcagguaugagccaccaugcccagccaugggcaaguuuuuuuuaaccccucugugccucaucuauaaaauggagauuacaaaucuauuucauaggacugcugcaaggcuuaagugaauugauacauauacggugcuuagaacaauaacagguacagagguguucaaaguuagcagcucaggcacuagccuugucauuuuccuucuccaagguuuuacagcaaguuaaaaugaagcuggaguucagccaaucuuuggaauccuaagaaacacaagaaauuuaauaacagcacucguaacguaguuacaucuugcuuuacaguuuacaaagugcuaccaugccuuuuuuuucucauuuuguucucauaagagccugggguagaugaaguuccugguggcgccauuuuauagguuaggaaacuugacucuuaggaagugauugagccaagaaagguuugauggcgauacagucucugucugccauguccccacuuccugcaaggguuauaaugaaucaugacuaauaggaggugcagacacaccuucugcaaaggcuuguaguuaaauaaggcagcacguggaauggacagacuggagacaguccuuaccucauguggaaccuaggacagguaaggcccuguccuccaccccagagcucacuuugucugagagcagcugaccagcaguggaagacauuugcucagcgauauauuaguuauggcugcaaaagcccaagaauucauccccaaggcaauuaagauaaaccacaaauagaggaugggugccuuggcucacaccuauaaucccaacacuuucgggaggcugaagugagaggaucaccugaggucagaaguucaagaccagccuggccaacauggugaaacccucccucuacuaaaaauacaaaaauucgcugggcaugguggcaggcagccucaggaggcugagacagaagaaucgcuugaaccccagagguggagguugcagugagccaagaucacaccauugcacuccagccuggguggcagagcgagacuccaucucaaaaaaaaaaaaaaucaaauaguaauuugccaaaaguuuuuagcaaugaacuuaaguucauuaaaacacauugguauuuauacccugagcaaacaggaguccuccuguguucugggcacugggugggggcacaggggcaucaccagaugcaaacuugaucuugacuaggagggccccuccuagucaaguagauucacaccuuaagucaguaaauccuagccacuccuuuagucuucaucacuggcauuugaugguuuuccucuucuucauggccccaaauuucugguucucuuuuuauuauauuaucuauguccuuuacuguaacucaccucacaaccuuuucggaaaaaaggacucaauacaggaaaggaaaaacagccgcgauguuguguuaaccucugguuuuuccucucucuccuuccccgcccccaccccagucuugacucgucugcugaacaaauccucugaccucaggccggcugugaacguaguuccugagagauagcaaacaugcccaacagugagcccgcaucucugcuggagcuguucaacagcaucgccacacaaggggagcucguaaggucccucaaagcgggaaaugcgucaaagguacaugauuuugcuggguucuccacgaaggcagcugagccucccaagucuguaggguuguguuccucuagaauagaugguuuccucaaugacugagguguuuugguuauaauuuuuuauuuuuugagagggaauuucacucuuguuucccaggcuggagugcaauggugcaaucuaagcuugcugcaaccucugccucccggguucaagugacucuccugccucagccucccaaguagcugggauuacaggcaugcaccaccacacccagcuaauuuuguauuuuuaguagagauggggguuucaccacguuggucaggcuggucucaaaccccugaccucaggugaucuguccaccuuggccucccaaagugcugggauuaccagcaugagccaccacgccagccuugguuauaguuuuaaauguauuuuuccuuuaucaacauugggaugccuguggucuaaagagucagggguucucaaagccuuugugaaauacaguggcccuccagcccaccucucccuauuuccugcucaauucuuuuagccgaucuuuugguuauguacuccccauaucuguaaauauucugcuuaucauauuguuccuuguugauuuucaaguuggggucuuucagguggaaaugaagcauucguaccuucacaaccacuucccguccaggcagucuccccaucuguauugcaguuguaguuaggucaguaucuguacacugacauuauuaugaccauggaaauagacguggacagcugaaccaucacggauagaaugaguacucuaacuuucucgcccagcuuuuguuuucucuggaguuaauauuugucuuaauaucuguuugcuugacuuuuuuaugucaaugauacuaaugauaauguaucuccaagcccuuucccuguccagugaaucuccuuucaacacacaucaacuagucuaucaaguucaucuucuugaggcgaucucucccaaaaccuucugccugcuucccucugaagugggggcucuugcuuccuacacugcccaucuuggcgucuuucuucacugucgacccaagggguucuuucaccccugucgauugggugccccguuuccugcuccugcaucuuuauuccucuuugcuuuacucuuugggcagagcaaaucuuccaauuguuucugaaaaaaauauugcaaaggaaauauuucuagggggaucuugcccaucugaaagcguauuuauuuuaccuaaaacaugauugauagccaggcuggguguaggguucuagcauggaagugauuuccccuggaaaugcugaagccacugcucuauuggcaccuagcuucugggcuugcugcagagaagucaguugccauuccuuuguuuuuucuuuuuggaaguuagcaggaucuucuuuguucccguguucugaaauuucaugggaugcagguucaguaugccuuucuuuuuuuuuuuuuuuuuuuuuuugccaccccacccccgccccccgagauggaaucucacucuuucacccaggcuggagugugguggcacaaucucgacucaccgcaaccuccgccuccuggguucaagcaguucuccugucuuagccucccaaguagcugggauuacaggcauccgccaccauaccaggcuaauuuuuguauuuuuaguagagacgggguuucacuauauuagccaggcugaucucaaacuccugaccucaugaucugcccaccucggccuccgaaagugcugggauuacaggcgugagccaccacacucagccugccuuuuagacuagaaacucauggccguuaauucucagaaaucaugauuucuuugaucucuucuguuuucucucuucacagacuuuuuuuuuuaauucagagacuguuucucugauuuucuaacccuccuauuguuuuccauuucugcuaucauuuuuaacuuccaggagcauguaugcucccugaaguuuccucacagcacucugcccugacucauagguacaguaccacccuuuucucucugagauuuuuuuuuuuaaucuuauuuuacuguauuaaaucuuacuaauauucuguaagggacaaaccagacgaguaggcuacagugaagaaaucuuauuuuggagaguuaagaaaccacuaugauacuuccagguauuaucuucagugaugcuucuuaucuuuauucagggacuccagguaauauucagcuccuacagcuaccacaaaugcagcaaauccccauuugaauccuuuaaacaauacaucaaaaaaggaaacacucuuugcaaagccacccauguaucuucaagcuucauuguggccccacggaucccuuagcccuuuuucagccagcuucuucuggauaguuucuaauggugucccuucugucuuccguugucuguaaucuagaaguuccauuuuacgauguccaugcucauguccauguccaugggccaugucugacagcaaucugaccucucaggacacucaacucucucucucugagaucuuaaugguaguuuuccauauguccucuacauccuuuauaaccucaguuucuuccaucuuaauuuguuuucuaccugccuuucauauuagaggcaauucucaacuguuugguguuucuuggcuauuugcugguguuuuggggggugcacugaaagcugcuggaugcacucuucauuggggaagagcuuaucaacauagguuccacuuccuggagagugaccaggcugcuccccuuuuguuggggaaucuuucgugucaaggucuuuagaucuuuucuuuaaaguuaagugagauuccccagagaaagcucccccaguccacuguucagagggggugagucccgcugccagaguucuacggcugagugggagagaagggcugggcugugggauccuuccccgaagcucccuauucucugugugcugccagugccccaacugugcagacugcccccagucuaggcaccuguaacucuguccucucuugacaugaaaccuuggaauggaggggaaacugugacacucccuuggccgaggggagagggauucucaauaacugcuucuugaagagacuucaaccagcgcuccuguuuucauaacccgcuuuccugcccccacuccuguaagugcgcaaggucacuaaggcccgaaccuuugggugauuccguaacaguguacacucggucaccuuccaguauuuccaugaugucuuagcauuuguuuuucucucaugcuguuaggcacugaucauucaucagcuuucuggcuucugaaaccuuguugcugucauccucuucuuguuuccuuuguccuugugggauuaugcuuuaaaaaaaaaaaaaaaaaagaagaucucugcuuuuguuguaguagauuucagaaauaucaucaucaauacgcaucuuuaacuagaacauaagcauuucauuuccuucuggggugacuccacuccggcuucuccaugacuuccaucacuuuuuuuuuuuuuuuuuuuuugaggcugagucucacucugucgcccaggcuggagugcacuggcacagucuuggcucacuacaaccucugccuccugaguucgagcgauucuccugcccuggccucguaaguagcugggacugcaggcgcccgccaccacacccggcuaauuuuuguauuuuuaguagagagggggucuugccauguuggccaggcuaaucuugaacuccugaucucaggugauccgcccgccucagccucccaaaguacugggaugacaggugugagccaccacgcccggcccgacuuccgacacuuuuaacuccuguuaucuguuaucuuuucaaacaccuugcuugucaccagauugugucaaccaucucacauuccccaguaguuuacuuugacuauuugggacccugauuuaaaucauuauuuguguguguguguguguguguguguguguguguguguguauuuuuugagacagggucucgcucuuuccacguuggagugcaguggugcaauccuagcucagugcacccucaaacuccugggcucccaccuuagccugccaaguugcuggaauuauagaugcaagccacugcacccagcucauauuuuaaaugaaauaaauaguacugaaagaaaguaaugucaaaaaaaaguuacuuuuuuacagaaagagauuuacucaccagguaggccucaaacgauuaaaccaaguuguuuuaaaacaaaauuauaaaauaaauaaaagacccagugggguuauguaagcccaucauuuugggaaguugacagugguauuuuuguccauuuaauauuaaauuugaauaacauuuaguaaauguuuuuaguuaguaauucuuagugacugcaguuauguucauuauuuuagucaacuuaauacauuuuauaauaacucuuccaaguguauuauuugacuaaugcaauuggcuggcacacguugaagacaucagagguugcacaaugagaccagaguuaaguggugaaaaauucagaaguacauuuguaucugacccugaaaugucuugguaguagaagcacuugauguuuuggaaauuuuaaaaauuaacuuuuagcaaaauagugugagccacauugggagugccaguucuaagagagggcaccuugagcucuuucuucuccugccauuuaucuaggccauggaccuugaaggucuuuucugcuccaguguaucuaaagaauaagauccacauccuucaguagcagcagcucauuaaagcggcaaguuuccuagggggaaauaagucagcaucugagggcugugaggggaaauaguuugagcaggacuaaagaagcaaugcuaggucuuagguauuaagaaagagagcagagccuuuuucuucuucuccuuuuuguuuaaguaacuucuaaaaucaaaauauaccauucauauagaaaaacaugcugaucauaagcacaagcaggcaccucacugaauuuucacaaaaugaccacaccuguguaaccagcacccaaaucaacagcaagcagagagcaccuagaagccacccucacgcgccucagccucugccaugacuccucccaccagggguagcucuaccuggguuugaacuguauguaauacagucuugugucuggcuuuuuuuucugaacaucagcuuuuggcgaggcuccguggcucaugccuauaaucccagcacuuaggaggccaaggcaggaggaucgcuucaggccaagaguuugggaccagccuggauaauauagugagacccugucucuacaaaaaauuuaaaaauuagccagacaugguggcacacaccugcagucccagcuacucaggagacugaagugagacccugucuaaaaaaaacugauguucuggguuuuuugugggguggggaucucacuucaucacccagguuggagugcaguggugcaaucucggcucacugcaaccucugccucccuggcucaagcaauccucugacuucagccucccgaugagcuaggaacacaggugugugccaccacaccuggcuaauuuuuucuauuuuugguagagacaggguuuugccauguugccuaggguggucucgaacuuaugagcucaggcgauccgcccgccuuggccucccaaagugcugggauuacaggugugagccacugcacccagcuaacaucagcuuuugaauccuguuucaguguccugguucagacacugauuaagacugauuauaagaaaauagacaagguaagccugcuugucuuauuuuggugcuauuccaaaaugcagaugguccuugagcagggacauugguuaaauguuugacuuucgcagagccuccuaguuacaagcagaauuagaccagauagaguaugaaaugucaacaaagcuaguuauuaagugauauugacugcaguguacuucaaagcaagguaagccuucccauagauaauuggauagauuauacguacuaaacuguuauuuuuugcaaguacugagccuagguacuacagaaaugagauggguggaacauacuuaacuaucuaaccugggcaaacaucucaucuaugaaucguauccauuggguuacugauuccacaaaucuggcucauuuuaaugaugagucucagauaauuuuguaguuugaaacacagauuacuccagaaucacaguccuuuauggcccaagugcuauaucugauggaauaguuaucucugaauggagguugguguuuauagaacauucuguauaugguaaaaggaauuuaaggagauuuaaaagaaagaauguucuguauaaacuguaaguggaaauguuuguauuucccuugguaagcaaauugggcuguguauauucuuuguuugugaucuaauccagcaaggccaauuaccagaauagagcuuuagggcauagcaugacuaaucagcuuaauuaggccugcuuuucuaaacaccaggcuuccagggguggccacuauggacuccugcaaaagagucuuuaauacauuuccagacuacccaaggguacauuuuaccuuuguuuuuuuuuuuucaagauaguuugauaagacuccaaaaugugaugauguaacuauuucccagugaaucccuccuuaauuuauaaccugagagccuacauuuuuuguccuugcuuuuaucuguuuuaguugcucuuacuauccuuaguggcaucauugguuaaguuaacguaaauauucaucucaaccugugugguauguaaaaacuaguuccaaugcagaacuccaggaaucucaauuaaaggagcuugucacacacguucucuggcaucagugguguuugagaaaucuuuagcauaugaacuuugucauaaaugacaguguauauugugucacugcuacugucccaaaguguucaugguagcacuagaauaacagauaaaaaugaaguguuuucgagccaaugacuugcugugauucuauggguaagcuccucuaccucucugagucucagauucuugagcuggaaaaggacagugacaacaauaccugccuuguaggguugugacacuaacuaagguaacacguguaaaagcauuuaacacagugccugccacagaauaggcauucagcacauaucagcuauuaguaauacuuuuagccaucccuuuuauuuccucucucaggaugaaauugauucugcaguaaagauguuggugucauuaaaaaugagcuacaaagcugccgcgggggaggauuacaaggcugacuguccuccagggaacccagcaccuaccaguaaucauggcccagaugccacagaagcugaagaggauuuuguggacccauggacaguacagacaagcagugcaaaaggcauagacuacgauaagcucauugguacguccucugcuuucuucccagaaaaagcugcaacuuuuagaaguggucccauugaguugauuccauugauguuuuuaaauuuugaauuaaucauaaauucagugaagcuucaaugccaagaaaaaauggauacuaaaaucuuuugguugugcauuauauucccaaaggauuauuuuaaaauaaaauaacaauauaaaauauauuucaaaauaaugaucuauaguagacagcuuaauagaagguuuucccuuuuuuugagcacuucagaacuugggaaaggucuauugaaauggccauuuauaacauuuaguggcuacaagucaaucauagauuacuuagguuucaccuccagugauacugacuauggaccuagaaggcuggaagucagcuuaagagcagugacuucucacaucgggcaaguucuuacugucaugcccuuccuugagggccuuccugcucaggaaagacuguugccauuccauugaagucuuuacucugagaucauugcuaauuaucagagaagaaacagaacugaaauguuuucaucuaagucaaagccauuuuccaugauuucaguauagacuaucaaugagggaaaauucacuugaagaccgacauuaauucaguucaacaaauaaagaaugugagaaaucaugguugucaaugaauauaaauuuuaccuuaauaaacaaauauauauauauauaccuauuuauauauguauauguuuauauuuuguugucaaaaguugcuagcuggacugcauucugaauauguuucccaucagaacccagucucaggcaaaacagcauuuuguguuguaauuuauuuccuguuuuguugguuguguugaucucagcuguuguuuuaauccaaagaccuuuuacuucauguuggggguaaggaccuuuagcagaaggccuaaagagguuuguguucauuaagauugugcauggaucacucacuuuucaucuucauuucaguaauaucugaucacuaaaccuccugccaccuaagaaagucaucuuuucuuuuuuuccaguucgguuuggaaguaguaaaauugacaaagagcuaauaaaccgaauagagagagccaccggccaaagaccacaccacuuccugcgcagaggcaucuucuucucacacaggucaggggcucuucaccacaggccuucucaccuguccucuucuuuuaguucaaaaaaaucguaagacacucucuucauaagccaccugguacugugggaaaagugauggccagcugugguaagacugagauccauccucuguccugucaguaacccacugugggaucaugcuuguccaucacccucaggcucuuaguuuuuucauuuguagacugcccaccucacaaggugggaaucauauuaauagcaggugagauucuucccagauuacaggcuguaaagaaauuauaaaaugucaugaaaacaaaagagaauaauauguccaagaucagcauuucccacaugacaaacaguaggcuuccugaaauuccaaacccucuuccuccuauuguauugacuugcucauaaacaauaccaacagacaaaccaacagagaaugcauggaacagauuaucuguaccuuaggccguaaauuccacgcagauaacgucaagauaugggcagguuccaaaagaguuucugccucucccaaccuacaguuaucugggcugaggcagcccccuuuuugaagcuguguccauggaauuuaugaucugauguaggguuguucuguucuacuggcacuucacgcuuacaggagaacaaccccaggacagagcccagcagucugcccaaacacuucaaauucuaccugcaaagaacuccaggccuugcucaacccacuuucuggguggaauauaauaaaaaauuuuccuuaauucacauacuauaaaacuuauuuuuuuaaauguacaguuaaguggguuuuaguauauucacaagguugugagaccaucaagacuaucuaauuccaaaacauuucaucaccccaaaaggaaacuucuacccauuaacccauuuaugccagaaguuguaaaaauuuuuugugaaaaaucagaccuuggcaaucaccuugagcaguaagauaucaauaacucccacaaguuuagcauuccaauuuuggaacaguagguaggcauaaauggguuaacagucaucccccauuucucccuccccacuggcaaccauuagucugcuuucucuauaucuagauuuaggcauuuuauauaaaugggaucauguaacauguggccuuuugugucuggcuucuuuuacuuggcauaacauuuucaagguuccuccauguuguagcauguauccauacuggauuccuuuuuauugccaaauaauauuccauugaauggauauaccucacauuuuguuuauucauucauuaguugauggacguuugaguuauuuucacuuuuugguuaucaacaaugcugcucugaccauuuguauacaaguuuuuggguggauauauguuuucaauucucuugggcauauaccucgaaauagaauuaauggcuuauauaguaauuccauguuuaacucuuugaggaacugacagacuuuucuacagcaacuguaucauuuuacuuucccaccagcaacauaggaagcuucccauuucuccacaucuucacccacucuuguuauuuuccauguuguuguguuuuauagccauccuaauaggugugaaguaguauuucauugugguuuugauuguauuucccuaaugacaaggauguugagaaucuuuucaugugcuuauuaacaauuuuuauaucuuuagagaaaugucuauucagauccuuugccuacuuuuuaauuggguugucuuuuuauuguuaguuauaauaguucuuucuauauucuggauacuaguuucuuauucaaauauuacuugcaaauauuugcucccauuauauagguugucucuucacucuacugauaguccuuugaaguaugaaaguuuuuaauuuugaugaaguccaguuuauuuuaucuuugauugauuguguuuuuggugucauaucugagaaaccacugacuaaucgaagguugugaagauuuacaccuaugguuucuucucagaguuuugugguuuuagcucuuacauuucaguuucugauccuuuuugaguuaauuuuuguauauuugugagguacagcuccaacuucauucuuuugcuuguggguauccaauugucccagcacuguuuuuugaaaagacuauucuuggcugggcgcaguggcucaugucuguaaucccagcacuuugggaggccaaggcaggcggaucacgaggucaggagauugagaccauccuggcuaacacggugaaaccccaucucuacuaaaaauacaaaaaauuagccagguguggugaugggcgccuguagucccagcuacucgggaggcugaggcaggagaauggcaugaacccgggaggcggagcuugcagugagccgagaucgcgccacugcacuccagccuggguggcagugagacuccgucucaaaaaaaaauaagaaaaugugaguacucaaacaugguucuuuuucaagauuguuuagguauucugggccccuugcauuuccauaugaauuucagcuuuuccauuucugcaaaagcagcagcuaggauuuugauagggauugcacugaaucuguagauucauuuguggaguauugccaucuuaaaauauuaauucaucuaauccaugaacaugggaugucuuuucacuucuuugauuucuuucauugauguuuuguaauuuucaguguauagguuuugcacuucuuugcuuagauuuauucauuagaauuuuaucuuuuuaaugcuauucuaaauggcauuuucuuaaucucauuuugauuguucauugcuacuauauagaaauacaacugauggccgggcacgguggcuuacaccuguaaucccaacacuuugggaggccgaggcggguggaucacuugaggucaggaguucgagaccagccugaccaacauggugaaaccacaucucuacuaaaaauacaaaauugggcaggcaugguggugggcgccuguaaucccagcuacccaagaggcuaaggcaggagaaucacuugaacccaggaggcagagguggcagugacccgagaucgugccauugcacuccagcccgggcaaaaagagcaaaacucccucucaaaaaaaaaaaaaauacaauugauguuuguguauuaaucuuauauccugaaauuuugcugaguuuauuagcgcuaaugcuuuuuuucuuuuugcagauucgauaggauuuccuacauauaggauuguaucuccuaugauuagagacaguuuuacuuccuccuuuccaauuuggauuuuuuuuucguuccuaauuucucugacuucaacuuucaauaggauguugaauaguaguggugaaagugagcauccuugucuuauuccugaucuuaggggaaaaacuuucaguaaagacugaauauacaccauuuaguauaauguuagcugugggcuuucuauauacccuucaacauguguuuuuauuaugaaaagauguuagauuuuaucaaaugcauuuucuguguuuauugagaugaucauguggguuuuggccucuauuuuauuaguaugguguaucacacugauagguuuuugcguguuuaaucaaccuugcguuccuggaacaaauuccacuuaaucaugguguugaaaaucaauuuauuuucaaucauaguguauaaucuuuuuuauauguugcuggauuugguuugugaguugcugaggauuuuuacaucuguguucauaagggauauuggucuguaguuuucuuuuaaugucuuugguuugguaucaggguaauacuggccucauagaaugaguugggaaguauuucuuauucaauuuuuuuuggaaaagcuugggaaggauugguauuaauucuuuuuugaacauuugauagacuuuaccagugaaaaugggguuuugggcuuuucuuuguaggaaguuuuuugauuacuaauucagucuuuuuguuuguuccagaucuguguauauuuucuauuucuucuuggguucguuucaguaguuuguuucuaggaauuugucuauuucaucaagguuaucuaauguauugguauacaguuauucauaguauucccuuauguaguaauccuuuuuauuccuauaaggucaguaguaauaccccuucuuauauuccugauuuuggccguuugagucuucucuuuuauuccacacccccccccacacacacacacacacccagucacuuugguucaaaguuuacuaauuuuguugguuuguagucagcauuuuuuaucuuagcauggcaugguucuucucacugccuuugugacuuauuuauuaacugcaguauaguaauacuguagccucuuggcuuaggaaagcauaggaccugagucauuugcccauucucaaauuucaaacugccccucugucuaauuuugucaucuguaaaauuggggauuaaaugagaucuacuaugcacagucaagcuucaaguggugggcagguaacuggguucccuuaguagcugaaugagucucugcuggaauccauccucauaaaacaugaucucaaaauuggaacccaguaaauuucugcacgcuugucaggagcaccucaccccaggaccgagcacacagugaguucucagaugcuccacauaaacacaagaaaagcagcucguggcacaguuacauuuuuuucucuucuguaagcccauaugguuaguugugagaaccaaagaaggauucuuuccuuccaaaauuauggguuauuuucuuuccuuauuucaaaagcaguaugugagcauuucauggggaaaaaaaaugaaaacuaagcccaaaaaccagaacacccacaauuguaucuguccagagauaagcaauguugacccuuggcuuggggaauauaaggagaagucacuuucagaauacuguucucuagauucuccuauccagaccucuggaaaagguaguuauuccucuuguauuuggggacacuuuacccagaaacaaaggacauucauccucgagcguugguuucccacccugcugaacauuggaacuccucacggagcuuuuuaaaaauacaaauucccggccaggcgcaguggcucacaccuguaaucccagcacuuugggaggccgaggcaggcaaaucacgaggucaggaguuugagaccagccuggccaacauggugaaaccccgucucuauuaaaaacacaaaaaauuagcugggcauaguggcaggugccuacuaugcccagcuacucgggaggcugaggcaggagaaucgcuugaacccaggaggcagagguugcagugagcagagaucacaccacugcacuccagccugggugacagagugagacucugucucaaaaauaaauaaauaaacaaacaaacaaacacauucccagagagcaccucagauccauugaaucagucucuggagguggggcgcaggcagcugugauuggaagcagccugguagggagggggaugacucuugagugacuugcagaugaagauaccuagucccaagcuggcugaggggcccagauagaucuccaacugggcacuugaccucugaacucccagaggacaauucuuacuuucccugcuaagccaggacugucuggucccaugcaguuugccugguauuggucugagaguccucggggcugggugauucugagcaaggaucauaugguguuggccugguauccccagggaaguguaccaagcucacaguaugucggcacugauguuuggagggauuccaggagucccaguaacugcauagcuggauccaucuuuuaaacacauuauuccaaaccuacacaucuugucuuuuaaaacacucacaggagaaaccauuucaguagaaguuuccugucuauauuuauaucauaagcaccaaagguaacaaauucuaguuauuauccauguuguuucgucucugucuauauuuuccauuuccaaaagugcauuagugccuugauauuuuucucagaaaaucacacucuuccucuucuccuuuuuccuuuagagauaugaaucagguucuugaugccuaugaaaauaagaagccauuuuaucuguacacgggccggggccccucuucugaagcaaugcauguaggucaccucauuccauuuauuuucacaaaguaaguauuggaucuuauggcuuuucuuacucucuuagugaauugagaauguugcuuauaaaccauguuuagaacugacaagaucaugcuaguucauuugcugagcaaccaagaugucaagaguuggcacuuuuuuggcuuccauucacuuuguuccugggcucacuuuagaggaccauggagugauggggagagcgcagcuuuggagucagccaggccugcuccucuucucauccugcucccugucugcauggccaugggccugcuacuucucugagccuaaguuuccacaucugcaagaugagaaugaagauaccuaccucauagaacuacuguaaagcuucaaaacaaaguguguagagcagcuaacacagagcacacagggccaccuggucgauaaaugguaguagaccuuaucauuauccauagucaaauucauaucacaauucaaauugugauuuuguaggcaaggaaguuuuaacauacguuguaaguaggagcuguguuuucagaugcacgauggcguuccuccacaggggagaugagacgucagcuuucucccccuguguuucuuuagguggcuccaggauguauuuaacgugcccuuggucauccagaugacggaugacgagaaguaucuguggaaggaccugacccuggaccaggccuauagcuaugcuguggagaaugccaaggacaucaucgccuguggcuuugacaucaacaagacuuucauauucucugaccuggacuacaugggguaaggagaaaacgucuggcugccuuuucaauagguagaggaggaugucaaguugucaugaccacagcuaaauucgaaacaacugaaauggucuuaaggccuaguaaauguucuucuuccuuuauuaaaugcuaugaguggccagccaugguggcucacaccuguaaucccagcacuuugggaggccgaggugggcgggucacgaggucaggaguucaagaccagccugaccaacauggugaaacccaucucuauugaaaauacaaaaauuaguugggugugguggcacgcaccuauaagcccagcuacucagguggcugaagcaggagaaucgcuugaacccgggagguggagguuacagugaguugagaucacgccauugcacuccagccugggcaacagagcgagacuccaucucaaaaaggaaaaaaaaaugcuaugagcugguuuauugguuuuauuuaccaauaauuuugaaagugaaaagcuguguauguacauagaaaggauuaagugauaucaguaucuuaaagacucgauuauugucuccauaauuacauuuacagaaauuuaaaauaugggcucagccacagcaugauggcaucucagaucuucauccucagcugugccaggaaguccugccuugcaguuucuugccaaggauagucagucuuccagaguuaugucuuccuccuuuucaacgcaccuuuuccucacagagaaaagacucagugguuacacaguuuccucagucuaguucuuuuaaucagccauuuaauaaaccaaaauauuucauucugaaaauccuucaaguuucaucccaaaugauuaccaagaaauguguuagaaaaauaagacuuuggucaaccaucacaagaaggauacuaucuagcucaacaaauauuucuugagcaccugaguugugguacuccccuaaggugagauacucuucuaagucauaguacuccccuaaggcguggucucuccuaaggcaugguacuccccuaaggcauguuacuccacuccccaaagacguguuacuccuccccuaaagugauuccccaggaggaguggguucauugcuaugcuccugcagcccaggcugggcucugagcaggcccucccauguuagcucaccaucagggaccaugccgaggcaggauaagagggacacuaaaggggcaggugagcagugagcacaggaggacuugcuuagagccgcauccccagaacguucccucuuauaagaccuuaaaacugaguaguggcagccaggcgcgguggcucaugccuguaaucccagcacuuugggaggcugagguggguggaucacaaggucaggaggucaggaguucgagaccagccuggccaauauggugaaaccccaucucuacuaaaaacacaaaaauuagccgggugugguggcgugcuccuguaguugcagcuacuugggaggcugaggcagaagaaucgcuugaaccugggaggcggagguugcagugagccgagaucaugccacugcauuccagccugggcaacagagugagacucugucucaaaaaaaaaaaaaaaaaaaaagaaagaaacugaguagugguuuuauauccauugagagcaauguauacccugauaggaaaucucgcccuucuaucagccaguaaaacuguuagcuuuuucuuuuucuuuuuuuuuuugagacggagucucgcucugucacccaggcuggagugcaguggcacaaucucggcucacugcaagcuccgccucucagguucacaccauucucuugccucagccucccaaguagcugggacuacaggugcccgccaccauguccggcuaauuuuuuguauuuuuaguagagacgggguuucacuguguuagccaggauggucucgaucuucugaccucaugaucugccugccucggccucccaaagcacugggauuacaggcaugagccaccacgcccagcaccuauuagaucuuuuaaaauuacuucucuugguucagccaugugagcauggaggcccuguggcauccuugaaggaaggaaaauagacagggauccagauccuggcaccuggguuuaguggcugugugucauagcagccguguccaugaaaugggaucaaacaagaacauagaugucaucauuagcauaauuuucuuuuuuuuuuuuuuuuuugagacagagucucacucauggguuuugccauguuggccaggcuggucuugaacuccugaccucaagugauccuccccgccucagccucccaaagugcugcgauuacaggugugagccaccaugcccagccguguuaguauaauuuucauggcacuuuauuuccuuauucucaccccauuccauacaaugauucaacugauugaaccucugcagagacaacuguggguucugcuucuccuuuuccagucaggcagugcugcuggcauugcccaguagcugcuauccucuucccacaccaccacugcccccaccagccagugaucucccuaaaacucagagcuaaucucaucuuccacuugcgggucuuucccagcucuccuccuuagaugacauugagaauucucaccuuucacuuggcacacgagcccuuucgugauuggcccuguguuccucuccagcgucacugcuaccuccagcucaguggaacagcuugcaguuccacauccuucuccuuuguacaugcucugugcugcccagaauucccacccacucuccugacccugccacccccagcuuagcuaauuccuacacuuucuuccaaaggcaugaucaagcaucaccuuuuccuaggagcuuucccuccccacagccaaauuuagaugccccucucugguccuccaucaggcugggccuuaccucugccacaucugguacaguguggcccucuccccacuagcugaguaagacacauaguuccugaauuugugcucucuguggcccauccccuccugggccccacagacacagcagaagcaaagcugagccgcuucguugauggauauaaaugcugguggugagacaagagcaagugccuauaauaguccaugaagcugauucagccaauagaugcacgaugggguagaugaacuuuugaacaguccaugugaaaagaccaccaccugagcaaccccacuuucagcgcucucugaacguggagugaggccgccauuccucgugcugucucuuuggcaacugcgguugcagcuccugaccagccuccaccuucgcuaaauaagaacuuccuuuuuuuuuuuuuuuuucuuuuuuugagauggagucuugcucugucgcccaaacuggagagcaguggcaugaucucggcuuacugcaauaucugccuccuggguucaagcaauucucaugccucagccuccugaguagcugggauuacaggcgcccgccaccacacccagcuaauuuuuguauuuuuaguagaaacggaguuucaccauguuggccaggcuggucucgaacgaccucaagugauccacccgccucgaccacccaaagugcugggaugcgugagccacugcaccuggucgggaacuuccuuuuuucuuacaaacaugggguaaagaugaaacccagacaguaugucaaccaaaagggucgaugauaucuuuucuugaaaggcauuuuauauugaaccuaaagugaggagagacauuuuaaaggguaaauccucuauucaaacauuuuacuuuaagaguuucuucuaaacauuugagcauuuuacuuuucuuucuugaauuuaacucaaaaucuauaucuuuggcuuaauaaagcuccuuccugguguuuaggagcuggaaauucaacaaagccagccaucgcccucuuugagugggagggagguggugaggccuccaugagggaggaggccagugcaguucccccugcacauugcacauggccccagaacggccuuccugcccagggcccugagggaugcaaaggcacugagcugggagucugaaaacuuguguuccagacccagcucugccccugccuggucuuguucccuugggcaaguccuuaaaucucugagcuuccauguuccugugaggaagggagcugggugcuaguggggggcagcauagcagagguugcaagugcucugcuugacggccguccgcuguguggccugggcaugggaggagccuuccacuguguggcccgggcaugggaggagcuccucucugccugcuuucuucacucugcuccuuuguucuacaaauauuuauuggacaucugcuauaugccagacucaugguggggguacagcagggagcaaaaccauuaucucagcagcuguguaaagccucucuucuaauggggagaaucagcuaacaggugaucaaucaggugauaauaaguucuauggugauaauagggacaaagggcagggguagagaagacuguggucaggagaugauagugccugcacugcauauaaagugcuucaagccacgccuggcaccuggggagugcucaguaaauguuguaaucuaaaaucucuucccacuuuaaacccugucugagagugaaaagcaggugcccucccugggguaacuggugguucagccacaugugauauacaguuagguguguucacugcagccagugagaagccuccaugugccggcacuggcauggcugcuuugcgugauggguccgucccagcugugcagggggacagccgucccuugaggggaggaucacacgugcucacggugcagcaccugcauucacccugcagccagcacaguggcagcagcuugcagcaaguaaugaccagucuucuaagaaagggcagcgugcucuaacucagaaauaccagucagacgccgugaagcuacaguccugccacaguuuggggguacuggagacuuucccuccuuguagggguuagggugucccaggugccucaaucccaagggcgcauggagucuuugcugcagcccaucuccccaggugacagacagcugcuguccuuacuggcugugaguccugcugcggugcccaggagggacccucccugccugcgguguucuuggcuugcuuggcaggaggacaaaggccgcaucuuuccaggcagugcugcuguuggcugugcucuugcucucuguuguuuccauugugcugagugggugacacagaugcuggguucuccuggcaugccccuucacaguacugcgcccgcccucuccagugccccccagggccugaaacucagccggcugcuaggcgaaagacacaguccaucccucacgugcugccucugcucaaccuggacaggccuuggcacugaccuugaccguuacaggccucccagcauugugcuucgcccagcacaaacggccaguguuccugcacuccugacaccccaccccaccugcacaaagacauucaguaguucuccacccugccccaaaagucuaaacucuucuaaaggauaagauguggugagaaaagcauaggcuuuggggccaggugaaucuguguugggaucccagccccuguacucacugggccugugacuaugacccugaacuucuuugagccuagucuaacuguaagguggaggcaaugcuacuacuuugaaggggauuuuaggaguauugacacauacgcagcaucuagcacagcuccugccacauggugcaaacacuuaaaagacaccagccuucccccuuuucccucguagugucuaacacaugguagggccuagagaaaaagcuacugaauauaguaauacaaagaugcaauauaagaagccacuuggcugggcgcgguggcucacaccuguaaucccagcacuuugggaggccaaggcagguggaucaccugaggucaggaguuugagaccagccuggacaacauggugaaaccccaucucuacuaaaaauacaaaaauuagccaggcaugguggcgagcagcuguaaucccagcuacucaggaggcugaggcaggagaauugcuugaacccaagagauggagguugcagugagccaagaucaugccacugcacuccagccugggcuacagagugagacucugucucaaaacaaaaaaaaagaagccacucuggguucugccaaaccccuacaccccacuguguuugcuucuucuucagccuaguuccuucugguaguggaauggaugccacacauucaggccugguacccacaccccucaccauccagaagagagaguuggguugcuugaaucagccacuguggccuagcccuguugcuguggauaggguuaguucugcccaaacagcaggggggagcaguggccagagacuaggaggaccagcugcacugaaacaggccuuccuccuucucgggccguggguuucuauccauacgcucauccgacaacaagcagauggucucccacaacacaguaugucucagcuaagaagcuccugggggcucccagacuugagcuccacagcccacugaacugcugacccuggcagaauuuaaauuuuucaugcuagcugcaagucucugaaucugcuuguguucuugccuuguuuguaugucugcuucacgucgguuucacacugguuucugccuuucccagucaacuccacagguaaacgugugucugcuuugccugaugcagguaucuuugccuacagaugacuuccuggcaccuucccagugcuuacguguugaccacaauguggccccgagucuggcccaugccacuacucauuggcauccaauuuuaauaacugugacuuugccuucagugaaggccgcccuccguuugggauuucauucucguugucuuugcaggaugagcucagguuucuacaaaaauguggugaagauucaaaagcauguuaccuucaaccaagugaaaggcauuuucggcuucacugacagcgacugcauugguaagaggcccacugcugcuguggaccacucccugcacccuucaaaaaggagcagaguucuggaggagacacaugccugguuuaaauaucucugagauguuagcguuugcaacugucucuuuaaguaggaugcccaggcgugggugggucaucguuguccuggaaucugacuagcuaguguaaugcauugagcagcuucucuggguugggugaagcugcacuucaggaugugagucugucccucucuugucacccgucuuaagguuuagaagaaagaaaaaucuaaggaugacuuuggaguuccaacagcucuggugggaccccagucaguguaggguggccuuggauggaacccaggggugaugaagaaggacagcugggucugcugcccaugagagggccuuugagucuuugucucccugggccucaguguccccacauguaagaugaggggcuugacacgaggucuucuggagccuucccaccccugcccugcucuccuuccauggcuccaccccagcagaugugcaaaugguuugccucccacgugcaugccuucauggcccucuccauaaauuuccaugugucuuucagaugcauuggcuucguagacuuuuagacuuuugguccuugagacuuguggcugggccuucugauccccuccucuacuugauguuuggugcguggcuucaggcauagcaggcccuugaggccuucagucagcugccagccgagccagcucccugggaugcgcugccggggcucuccgugaggagcguucacccugcuuggagccagagccacagcggcgugugcuccacagcgucagggucacgcugggccagccgcgugcccagggcccggaaaccucugcgcucacccaagggucuggguaccgccacuuggugggggcuggcguggcaccaccugucgggccauagagaggucaaaaguucugcuucugcaggucuaagcaaauacuaaugacaguaauaacagcaacaacauccaaaacacuaaacacuuuuaaauaucaaaauacauucaucauaacuucuuuuuuuuuuuaauuuauuuauuuauuuuuauugaucauucuuggguguuucucgcagagggggauuuggcagggucacaggacaauaguggagggaaggucagcagauaaacaagugaacaaaggucucugguuuuccuaggcagaggacccugcggccuuccgcaguguuugugucccuggguacuugagauuagggaguggugaugacucuuaacgagcaugcugccuucaagcaucuguuuaacaaagcacaucuugcaccgcccuuaauccauuuaacccugaguagacucagcacauguuucagagagcacaggguuggggguaaggucacagaucaacaggauaagaauuuuucuuaguacagagcaaaaugaaaagucucccaugucuaccucuuucuacacagacacggcaaccauccgauuucucaaucuuuuccccaccuuucccgccuuucuauuccacaaaacugccauugucaucauggcccguucucaaugagcuguuggguacaccucccagacggggugguggccgggcagaggggcuccucacuucccaguaggggcggccgggcagaggcgccccucaccucccggacggggcggcuggccgggcggggggcugaccccgccaccucccucccggacggggcggcuggccgggcggggggcugacccccccacuucccucccggacggggcggcuggccgggcggggggcugaccccccaccucccuccaggacgggguggcugcugggcggagacgcuccucacuucccagacgggguggcugccggguggaggggcuccucacuucucaggcgggcgguugccgggcggagggucuccucacuucucagacagggcggccgggcagagacgcuccucaccucccggauggggucgcggccggguagaggcgcuccucacaucccagacggggcggcggggcagaggcgcuccccacaucucagacgaugggcggccgggcagagacacuccucacuuccuagaugggauggcggccgggaagaggcgcuccucacuuccuagaugggauggcggccgggcagagacgcuccucacuuuccagacugggcagccaggcagaggggcuccuuacgucccagacgaugggcggccaggcagagacgcuccucacuucccagacgggguggcggccaugcagaggcugcaaucucggcacuuugggaggccaaggcaggcggcugggagguggagguuguagcgagccgagaucacaccacugcacuccagccugggcaccauugagcacuaagugaaccagacuccgucugcaaucccggcaccucaggaggccgaggcuggcugaucacucgcgguuaggagcuggagaccagcccggccaacacagcgaaaccccgucuccaccaaaaaaauccgaaaaccagucaggcguggcggcgcgcgccugcaauugcaggcacucggcaggcugaggcaggagaaugaggcagggagguugcagugagccgagauggcagcaguacaguccagcuuuggcuccgcaucagagggagaccguggaaagagagggagagggagaccguggggagagggaagagggaagagggaagccaucauaacuucugauaauuaaagguggaagguggcuagagaaugguuaaaugauaugauacauugacaggauagaauauacuuaguaacaacauggauagucauuacaaugaaaaaggcaaggaaggccgggcgccguggcucacgccuguaaucccagcacuuugggaggccgaggugggcagaucacgaggucaagagauugagaccaugcuggccaacaugaugaaaccucaucucuacuaaaaauacaaaaaucagcugggugugguacgcaccuguagucccagcuacucgggagccugaggcaggagaaucacuugaaccccaggaggcagagguagcggugagcugagaucgagccaccacacuccagccuggcaacaaagcgagacuccuucugagaaaaaaaaaaggaaaagaaaaagccaaggaaagaccaaauauaguguaaucacaacaaaaaugcauagaguaaaauauauaaagaaaauggaugaaaucagacacauugcaacuguacagcuuguucuuucuacuuuucuguauuuuuuagauuuauuuuaaugauuguuuuauaaugggagaaaaccuguuuuuguucauuccuuuauuaacuaagcagaacaggaacucaucucacguguaaaaauacuuuuucucauuuucagggaagaucaguuuuccugccauccaggcugcucccuccuucagcaacucauucccacagaucuuccgagacaggacggauauccagugccuuaucccaugugccauugaccaggucagcaggcagaaaagcaaggcucucuaagucuggggcauugacagcagguuccucuuacucuucagcggggagagguauugaaagauaugaugggcagccaggcaggguggcucacgccuguaauaccagcacucugggaggccaaggcaggcggaucacuugaggccaggaguucaagaccagccuggccaacauggcgaaaccccgucucuacuaaaaauacaaaauuuagccacaugugguggcaggcgccuguaaucccagcuacucgccucgcuugaaccccagaggcagagguugcagcgagagcgcaucacugcacucuagccugggcgacagagcaaggcucugucucaaaaaaaaggaaagaaaguuggggaguggggcaaggggagggagagcauuaggacaaauaccuaaugcaugcggggcuuaaaaccuagaugacggguugaugggugcagcaaaccaccauggcacauguauaccuauguaacaaaccugcguguucuguacauguaucccagaacuggaaguaaaauuuaaaaaaaaaaaaggaaaagaugaaggggaggagggagugaauuucuuugguuggaagcaugagagccuucugggaagaugcucacagggacugcucauggcugaaagcuggcauguuuucuggccgcccucaucaggguccuuacucuccccacaggauccuuacuuuagaaugacaagggacgucgcccccaggaucggcuauccuaaaccagcccugcugcacuccaccuucuucccagcccugcagggcgcccagaccaaaaugagugccagcgaccccaacuccuccaucuuccucaccgacacggccaagcagaucaaaaccaaggugagcaguggcccaggcagagggcagccagcgggaucagaaacaugcccuggggggcacacgcacacacacaccacugcgcagugcuuugggccucagccacccagccaccguagcaaugcugaacuccaggauugccaacuuugcucccugcagaacucaaggcagccuguccuucccacaugaaucaggugaauuuguuuuguguccuuucauuuagguaaaauuuugaauuuuuuuucuuuuuuuccuuuucugcuuuucuuaucagcacuguucugcaggcaaagucauggcaauuuccuuaaaguuauaauuaguguggauguuauuaaauaauggaaaagauuuguguauauuucucaucaucagcuguguuccagcggcuggacccggugccuuauuuauguuuucucauguuucauucucacugggaggugguggugcuauucccuuuaaagaugagaugaugaggcuuagagaagcccagccacuugaccaaguuuccaccaccaggaaucagcagcacugcucuccuggcccugagcagccauuaccaagcagggguuaugagcuggucuucucccagagagcguucucacugagagacauagaacggagaaacguccauccacgggacaguccugcuggccccaggagggaugcaugcagcaggcauucagcaaacauuugacaaaucacuagagaaacuaaaaggagaaguuaguuugagcuuccuuauuuugcauggccccaguucuguugccugguuccucaacagccaguguauauauaauugccucacuguuacacaaagcaguugacauuuucuuuggaaucaaguguguguuugcaggcuagaagauugcagugggaaugcugggaacuguauuugaggcaugucacaugcccucugagucacugccccugaccguucuggaaagucccaagcagguucugguugacaauggggaagccuuucauaucaaaacuuccuaagacaugcccuccaccaacucuccccacucaguuggaagcugguauaauugaagacuuuucuuucccuuucacuucuggccaaaacuuccggagcacagggugcagaguggggagggaagcgccauuggaaaaguccacuguuuuauuuugcuucugagaaguuguuuggaaaaaguuguuuauggccaggugcgauagcucacaccuauaauuccagcacuuugagaggccgaggcagguggaucaccugaggucaggaguucgagaccagcguggccaacauggugaaacuccugucucuacuaaaaauacaaaaauuaaccaggcuugguggcaggcaccuauaaucccagcuacucgggaggcugaggcaggagaauuguuugacccuggaagacagggguugcagugagccgagaucgcaccacuguucuccagccugggcaacagagugagacuccagcucaaaaaaaaaaaaaaagaaaagaaaaaagaaaaacuuguuuauggaucugggacauuuaucauucacuuagggaccaguagagcccucgaggugagcaguuagcaugaggucaggaaaaacagaggccuacagacggucacugggccugcaggcuucuuguggggcagaacagggcccgcccaggcccucacucuaaauccccgugcccgacuucagcuccaaaaucagaaucuccacacuagaaaagagagggcacaucugcuccagccuccuaaaaauaacagguucaggcagggcaguggcacgugccuguagucccagcuacucaggaggauggcuugagcccagggauucaaggcugcagugagcuacuauugugccugugaauagccacugcaccccagcugggguggcacagugaggccccaucucucaaauuaaaaaaaucaaaauaguagcacagugcugacgacucagguggcuuugcugagugaguaccugccaccugcacacaguaagccuguguuaucuaacuuuauuccaacuaccacccuagcuggcuguguccauucggcaucauuuccugucacacagagucacacuggucacccacuuccaucaucuuaguugcuggcagcagugcuccauacccacccccaagucagcccuccaucuguuuuccuguaagucaggccugguaggcugguuccugcaucacugaggacugaucacgucaaggaggcagaacugagccccucaguucucgagcuccacccagaagccuggugucccaggagccagccugguccugccaaucccugucacauauggcagguuccugacacucugggccugauuuccuucaccuguaagauagagacaucacuacagaggucauuggguuguuggggauaaaaugcaugucauaacccuaacagccuccacggauggcacaucugcugugugccuaccgugggaaaagccuggggagggggagugugcaggugguggugacgccagcacaucuugaaaaacaugcagcagacaccaguuuccuuguucuccucucagauaaaguucugggaacuggccuuucaauauccucuucaaacugccccuggaagccaggaccuguguucucagacuuucuuccugacacugaagcuucuuccccaaggcccagcagggagggcuauggccaccacauagcagugacucuaucaggcacuuagaugcuaggagacaccacuacuaggugguuuuuuucuuccuccuguuuauugguauuuuccauaguuuuucauucuauaacuuuuuuuuuccuuuuuuuuuuuuuuuuuuugagacggagucucacucugucgcccaggcuggagugcaguggcacaaucucggcucacugcaagcucugccucccagguucacgccauucuccugccucaaggcucccgaguagcugggccuacaggcgcccaccaccacacccagcuaauuuuuuguauuuugguagagacgggguuucaccguguuagccaggauggucuugaucuccugaccucguaaucugcccgccuuggccucccaaagugcugggauuacaggcgugagccacugcgccagccccucgcaugggccuugccugagccucucgcgugacugcugcuuucccugcccagccucucagcaaugcccugccaaaauggagacaggcgccuuugccccaacacucaucugcuccuuuugcacaaucccaacuuaucuaguuaggacucugcucuagaauucuguguguguguguguguguguguaugugugugugugugugugugauggaguuucacucuuguugcccaggcuggagugcaauggcacaaucucggcucaccacaaccuccgccucccggguucaagcgauucuccugccucaaccucccaaauagcugggauuacaggcacaugacaccacgcccagcuaauuuuguaguuucaguagagacgggguuucuucauguuggucaggcuggucucaaacuccuuaccuccggugaucugccugccucggccucccaaagugcugggauuacaggugugagccacugcacccggcugcucuggaauucuuuuaaggaaacuuacuaaacauaacaacuuagaauuuauugacucugcccaccuuuuuucccauuaaaaaaaaguuaagacugggcacaguggcucaugccugcaguuccagcacuuugggaggccaaggcaggcgaaucaccugagguugggaguucaagaccagccuggccaacauggugaaacccugucucuacuaaaaauacaaaauuagccgggcauggugacaaaaaaaaaaguuaaggggcugagcacagugacucacaccuguaaucccagcacuucgggaggccaaggcaggcagaucacuugagcccaggaguucaagaccagacuggacuacacgacaaaaccuggucucuacaaaaaauaccaaaaaauuagccaggcugguggcacacaccuauacuccuagcuacucaggaggcugaggcaggaagguaaccugagaccaggaggucaaggcugcagugagccaugaucacaccacugcacuccagccugggcaacagacuggagauccuaucuaaaaaaaaaaaauuagggugacauuuucucagaugcucacugaaagaauguugaaggaguuucaccuauuuguucuggcuuuuauuagccuuaauuaccccgugauuaucuuuaacaauuccuaaaagucauuguguuucugaguuuuucagcucugacaguguugccuguuuguaagugaagaccugccugcaggccccucucccugcacagcacuucucguggguuugccuucccuuacugccuuacccugugccuucuuguuaugcuuucuguguggggcuggccacugcuuuccuguccccauuaacacugcaguaccuaucccuaagagaggcugcccuuccugccaucucccuuacucugaggaugacuuacucauccuuuuucuuuuauuuauuuauuuuuuuaguuuuuauuauuuuagaaacaaggucuugcucugucgccgaggcuggcgugcagugaugcaaucacaguccacuauaaccucaaacuccugagucugagcgauccuuccaccucagccucccgagucgcuaggacuacaggcgcacgucaccacaccagcuaauuccuuuuuuuuuuuuuuuuuggcagagaggagggcucacuaaguuacccagacuggucuugaccuccuggccucaaucgauccuccccccucagccucccaaaaugcugagauuacuggcacaagcuaccaugucuggccuuacccauccuuuuucugacgcuuguuaccugaggaacuugucugucccagguuucaguucaaucagugccuuggcuuucccaacucuauucuccugugucuccgaggaugggggguucaaagcucaucugcccccaccucuccugcagugagccccacaguagcucacacccaagccucacaggaagaacagcagugggucccccacuggcugugcgcccccaaccggcugugcgccuuggccuuucccggguccagaaucugacagcacucacaccucugacuuccacacuugggcuucuagccaguguccaggcacaggaugagcaggacugaggagcgugucuguguccucuucuggugcaggucaauaagcaugcguuuucuggagggagagacaccaucgaggagcacaggcaguuugggggcaacugugauguggacgugucuuucauguaccugaccuucuuccucgaggacgacgacaagcucgagcagaucaggaaggugagcagggaaccccaagggcccacagccgccuucugccacccacuccugcccauggggccuggaaggcuccaacagccaggcaugaaggcuuggucggaggugcucaacugaaacaaggugaaaacugaguagacucgcccucaugguuuuuaggccugggcucagaagccucaugaacaaaucucgaaagagcagauacaaaucacuauucauuuaggagccacccaaaacagucuugcuuuauuagucaucagagaaauguaaguuaacgugaucaaagcuaagacaguugaguauagaauuaguaggggcuuuuguguugccauugacuauuuucagugauuaugaagcagaugcuucaaggcacacucaagugagcagaguguuuaucagcacagccucaggaagcaguuugguacuggguacaaagagcccaaaaauguucagagcuucuccucagguuuucucauucuuagauuuuuuccaaggaaauaauccugaguaagagaaagcuuuccacacaaagauguuaaaaaugauaauagcaaaaaguucaacacagacucaguacaacagaggaaacguuaaauuagaauuguuacaggguggauuauuaugcgggcaugaacuauuuuaaguguucauaugcagggcaugguggcacacaucuguagccccugcuacuugggaagcugagacaggaggaucccuugagcccaggaguucaaauccagccugggcgacauagcaagacccucauuucuuucuuuuuuuuuuuuuuuugagacagaguccugcucugucacccaggcuggagugcaguggcgcaaucucggcucacugcaagcucugccucccggguucacaccauucuccugccucagccucccgaguagcugggacuacaggcacccgccaccaugcccggcuaauuuuuuuguauuuuuaguagagacaggguuuuaccgucuuauucaagauggucucgaccucccgaccucgugauccacccgccuuggccucccaaagugcuuggauuacagcugugaccaccgcguccagccaagacccucauuucuuuuaaaaaaaaaaaaguuuuagugacacaggaaaauaugccuaugauagugaaaaaaggauaccaaaugaaaacucagggaggaguuaacuauguuuaaaugaaaugcacagggaaagaaaugugaagaaaaucuaccaaauguuagcgggagacccaccucugggcauuuuucaggugggcaauuuguaggugauuuuucuuuacuuugcugcugcuuugugguuuggguacuuuauuaaauuugcuuaaugagcaugcaguacaaucagaaaaagaaaaaauuagcaagauuuggcugggcgcaguggcucacgccuguaauccuagcacuuugggaggccgaggcagguggggggaguggaucacgaggucaggagaucgagaccagccuggccaauauggugaaaucccaucucuacuaaaaauacaaaaauuagccaggcgugguggcaggcaccuguaaucccagcuacucaggaggcugaggcaggagaaucacuugaaccugggaggcggagguugcagugagcugagaucaugccacugcacuccaaccuggcaacagagugagacuccaucucaaaaaaaaaaaaauuagcaagauuuuacagaagccauaaggcugccaggaauuguuguuguuuagugccugggggaauggccccuagcaucgguagggguggggacugcccuccccauuggcccuuucacugugagaggccaagucauggcuaucgucagagccagguuucuagccguuuuaggaaaaguguagcugaagguauagguuauuguugugguaacaacagaucucacuucugagugccacccacgugccaggcucugcauggguggugugggcugagcuggugcccgaggcaggaaggagccacucaggacauguggagccaucucucacguggcugucucccuccgggcaggauuacaccagcggagccaugcucaccggugagcucaagaaggcacucauagagguucugcagcccuugaucgcagagcaccaggcccggcgcaaggaggucacggaugagauagugaaagaguucaugacuccccggaagcuguccuucgacuuucaguagcacucguuuuacauaugcuuauaaaagaagugauguaucaguaauguaucaauaaucccagcccagucaaagcaccgccaccuguaggcuucugucucaugguaauuacugggccuggccucuguaagccuguguauguuaucaauacuguuucuuccugugaguuccauuauuucuaucucuuaugggcaaagcauuguggguaauuggugcuggcuaacauugcauggucggauagagaaguccagcugugagucucuccccaaagcagccccacaguggagccuuuggcuggaaguccaugggccacccuguucuuguccauggaggacuccgaggguuccaaguauacucuuaagacccacucuguuuaaaaauauauauucuauguaugcguauauggaauugaaaugucauuauuguaaccuagaaagugcuuugaaauauugauguggggagguuuauugagcacaagauguauuucagcccaugcccccucccaaaaagaaauugauaaguaaaagcuucguuauacauuugacuaagaaaucacccagcuuuaaagcugcuuuuaacaaugaagauugaacagaguucagcaauuuugauuaaauuaagacuugggggugaaacuuuccaguuuacugaacuccagaccaugcauguaguccacuccagaaaucaugcucgcuucccuuggcacaccaguguucuccugccaaaugacccuagacccucuguccugcagagucaggguggcuuuuccccugacuguguccgaugccaaggaguccuggccuccgcagaugcuucauuuugacccuuggcugcaguggaagucagcacagagcagugcccuggcugugucccuggacggguggacuuagcuagggagaaagucgaggcagcagcccucgaggcccucacagaugucuaggcaggccucauuucaucacgcagcaugugcaggccuggaagagcaaagccaaaucucagggaaguccuugguugauguaucugggucuccucuggagcacucugcccuccugucacccaguagaguaaauaaacuuccuuggcuccugcu

SEQ ID NO: 192392 - RNA, 166194 nt, Homo sapiens
gcggccgcgggggcgcgacggccggggcgggggcgcugcugcugcgggggcaggcggcggcaggggcggcggcggcggcggcggcccgcuccagccaugccgaauaaaaacaagaaggagaaagugaguccgggcccggccgcgggacggagggagcagggagggacugccgggggagggcgcgacggcaccgggguccugcgcccgggccccggcucaguuccccgccugacgccgcgggcuucgcguccccgagggcggccgagccaggcauccccgggcuucucucggccucaugcccggugggggcggggagcccggggaucgcgccggagccgcggggcgcaggcccgggccgcugggaccuucgugaugggccggggcugggcguggagggagggcgcggcccggggagggggucggaggggcgcccguuuccgacagcgcgccgugggcuugggcgggcaggugcggccgccgaggggguucgcagccucgcaggcucccggaaaggagcuucagggaugggggcuguagacgccuggggagggaccccuguacgggggaaagggagcgagaagggaccccgcugagagcugguaaggaauucucugccgccccggagggacgcucuggggcucucgaacacuauuauuauccuggguggcggcggcggugagggcugcgagcaagggugcugcguuugcauucgggggggcggguauguuucugcuucagguggagcucuguagcguuucauuaucaccccagaaauccucacucauaggguuuagggugggaggguagaaagggaugugauguggaucucaaaaugccagaagcacuguauaaaauuggauuuaucuguuuucugcuugaaguuuucaaccucaaaugcagauaaaacgaaaagaaucugaauggggguuggggggcauugcacuguuggaauccuaaacgguaugauauagaauuuccuaaugguaugaauuaaaaauaucagaagcuguaguuguauaaaucacuuuuaaaacugcauuuggcuuaucugauguuuaccugucuaaaaagugagaagacuaauugacuuugcuugauguuuaccaggaaucaccaaaagcagggaagaguggaaaaaguucaaaagaaggacaagacacaguagaaucagagguaacugucaucaaauauugacuuuguauuuuauacacagcuuuuaacuucagguagaaaaaccgagagugauaaagccuagaaucuucuaaaauguuucccuaugugagguuuuuuuuuuguggugucuuuuauaacccucaauuuuaguuguuuagguauuuacuguuuugcuuuggaaaacuauuaaugauuuuaugaaaauugugcuugccuaugggguuuguuugugggucuuuugggguuuuuuuuguuuuuuauuuuuuugagacggggucucacuuugucacgcaggcuggagugcaguggcgcaaucucugcucacugcuaccccuugccgcccaggcucaagugauccucuuaccucagccucccaaguagcugggaccacaggaacaugccaccacacccaacaaauuuuuuuuuuuuuuuaauagagucucacucugucacccaggcuggagugcaguggcgcgaucuuggcucacugcaaccucugccucccgaguucaagcaauucuccugccucagccuccugaguagcugggauuacaggcacccgcuaccacgcccggcuaauuuuuguauuuuuauuagagacgggguuucaccagguuggucaggccggucuugaacuccuguccucgugacccgcccaccuuggccuccuaaggugcugggauuacaggccugagccaccgugcccauccuggaucugguauuuuuaaguucauuucccacaccucaaacccagcaacccuccuguauagauuggucuuaugcagucuaugguguugcuauguugcuuuuagcuuuagggucaucuccccaccgccacuuccauugcaagcugccaggcaacucagugguuaguucuuuuucuuccaucaccuuguuuuccuucaaaccaccucugcuacugacguccugggcuagcucccuauuucuguugacggucccuuggccucuuucuccaauaauguugguauuugaaaaaauuuaccuaguuuugguauuuuauuauuguucacauugugugugugugugugugugugugugggcgcgcgcacuugcgcgucggccacuuguaaauuucuuugcuucuuggcuuuggccucauugaggaacagcuggaaugccaagugagcauugcaucuacuugaccaagguugaugcuguuccuucacaccgugaagugccuucagaggauuugcagagucaccacuuuccuuugccuuuucuuccuugugacuaauuguugaacuagagcaccuagggccaaggguccaggagcugcguggacccaggcagagccaguagguccuuuugaauccauggguagcacauaauuggguuaauagagugucaguuauccagaacuggaucauugaagccccagucuuaucacaaaugacguuuauuugccagugucagacuucuuccuguaagccaaauuagaaugaguucaguucugucugggaaacacaguuaacuggcgaugaucugcaguggacuuuuuuuuagcccugcauucucucuuuucuaucauuugguguauucugaaccucccuccucuucagcaggugguuuauuccagcaaaucuguugcccuccccaaagcaaaaagcagaaauccaaaagauuccuuaaaugucaauaguuaggaucauuugugccagucugucccucccugucuuuauagcagacaacugagguuuacugugccaugcugggauuugacuuguuucuuucuucccugucacccuuuugacuaaauucauuucgaugaagaugaaauguaggugcuuuaugaagguauaugcuauaugccuuuuuuuuuuuuuuuuuuggucuuuugaucuuucauuaaaacugcuaagauuucuucuccccagagcuuucuugcuaaugugccuauauccucuuacuuuagcuauauuccuuauacaaaggagcaucaguguguauauaucauuuauuucuauuuuuagugggaagauccuggcuguaaggaugaauaauguuaaguuuaaaccugaaaaaucucaguaguucaaagauaccaaaaucacuacuaugugaaauguguguuuugaaagcaguuugccagccgugugagaccugcgguguggccugcagugccugaguaugaugccccacuugucuuuuuguauuuuuucuagugcuacugucuaagagcuggagcuacagagcuugaaauuaccacugaaaacacugaaauguugggcccuucacugcuuccucauaaggauaccagaggcaaccuggcauauuaagcuugacacuuggcagaucacuguguaaauuguuuuucaggaauacaaguugggacacuucuguucauuugaccuuugaguugacccuuaaauuuuauuauuguuuuuuuuccccucagucuucagcucacugcuucacuucuaguuccacccacuuaccaaauaugauugacucaugcaggugaauuaaaccauuauugcacacuuuuucccucuccucucucucaguauuacucuuaacuugaauauuuuaaccugaacaauuuaaauaggcuugacauucccaugcugcuuucaagccuuuuuuuuuuuuuuuuugagacagaguuucacucuuguucccuggcuggagugcaauggcacagucucggcucacugcaaccuccaccucccggguucaagugauccucuugccucagccucccaaguagcugggauuacaggcuccugccaccaugcccagcuaauuuuuuuuuuuuuuuuuuuuuuuuguauuuuuaguagagacggaguuuuaccuuguuggccaggcuagucucgaacucgugaccucaggugauccgucugccucagcaucccaaagugcugggauuacaggcguuagccaccaugcagccccuuucaagccuuuuaacaucaugucaccuucacaaugagcaguugcucccauuacccagugaacucaccuucugaugggacaguuacccuaguuggggcuucucagccuugagagaugugcagagcagggaccuguccagggcagagcagccagacagcguggaaauaauccaaacagagaaagcauucaagaacuuggccucugguugacuuaacacacuacuucaaguauauggcaggucuguauaauaaacuccugccugucuagucuucagccucauagaaagcaagaaagcagguggcguauguugcagaacaauucuuggguagaacaaggggacauuugaugguuuggguuuuucaguaagaaagaugaaguccuggaguauaggguagagugguacaguggaaaauauuucagcuuggggguuagaaaauaaacaugccgauucuugcuuugccauaaaugaugucaccuaacuugugugacccuguuuucucaucccuaaaaugauuugauaaguuuaagauuaggcuauuuuuaaauguauggaagaaauuggguguuacccuucuugaaagacauuuucccugcaaguauggcaggcuguaucuuucaguguaacaaaguucuauuaaaggucauaacugcugcccuguaacuuuugccuuauucuagaaacuucuacuccuugaaugacauguguugguacauguuucuucucuuucagauagaaugguuaauuuugacuuguugcuucugcacacguguccuggaaauaaaaguuucuucccacuacuuauugcugauuuauuucauaggaagucuuaaggaaagaggcaaaaaacgggcucaugggucacuugaaguuggaaaauucuguggagauugacaaaggagacucacuuuugagcaucuguucucaguguaaccuucaaaucuguggaaacauaacuaggcacauuuuaugauuauuuagaauguuaauaaauugcucugaguuuccucaaguccauuuuguaagaucagaccauagguggguguuguuucuuuuaaguguguguacuguguccaauguuacauuuuuagaaguguucaugcuuuuuguaaagugauucguuuuaagcacauuaaaggucguuugaguauugucauguauuuuacaccugcuucagcuuaguuuuguuugaaagucucuacagcaacucuuacauaauaucuguugcugaagagaaagaacaauccucucuccaacucguuagcuagcuuugccaccuucuaccuuuaguaaauuuuuuccuguuauaaucugucccuuuacauuccagugccaccacucccugauggucuagaccuagggagacugacagucgccucaggucgcauaggugcuaggcggaaggguaauuuuuuuagaaauuaaaauugaaauuuuaaaaauauuuaauaauacacccauuaaauguuaacaacauuguuaugaaaaauaucuuugcaagaaauacuccuuuucacagucucuguagcaagaguuuuuaccugaguaaggaggaggacaaggacagucauuuuguucggcacaacuccuccaaggagagccccugacaccccuguaggcucacuucugagcuuggggcuuucgcuagaaccucccuaugccuuagcuuccaucagucucuucccaccuuuuuuuccauacaacccuaagcugaacuugagugaaagagaagaccaagagaaguaauacuuuaaaaaucuuuuugaaauucauauguaaugauuauggaguaaauggaaucauuugcuuuuaauugccacgucuuggcucccucuucccagcgccuccccauggucuuuccuuagagcccaggggcaucagaaagagguucugcggggaggauccaucccuggcagccgcagccucagcucccgagcuuugggguuguuaggaggcagauguccugagcuugcugcccuugaggcuugagggagugguggguucuuccuuaggcagcucccuucucuagcccccauuccuguccuacaucacaagcugcaaggucgguagaccccagguaccuccuuugugaccuccacugcucuagaccaaggguucccaucugaacacuugacuguggggcaagauauuuuguuguggggcugcccagugguccucuacuuuguaggacauucaccagcaucccuggccuuaccccuggaugccaguggcccacugcccccaccaacugugacaaccaaaaugcauccagacauugucuggacauugucuaaugucuccuggaggaucaaaucgcccccuguugagccacugcacuauaaagacaccuuuccaaaauauguacauuugcuuacaaaccaugccuggcacauauucaucugagcauuauauuuccuuuagaacagcagugagugcucacacagaagggagaucacuccuuuauacucuucacaauuaucaagcaccccaaagagcuuuuauuuagugaguuauaucuaucuaccgauauuuuuccuuagaaauuaaagcugaacguuuuuaaauaguucaucuaauaauaacaguaacacccauuacauguugacauaaaaaacauuuauguggaaagaauuuuuuuuuuuaauuugcugagaaaaguggcauggcucuguuuuugcuaaucuguuuaacguccggcuccaucgaagguagcugucugccccugcacgcaagcuguucugauuucguauguguagccugugaaaaacuccccauaaugacgcuuuaaagggcaaaucacaucuucauguuaucauaaaaaccguuuugaccuuguggaccccugaaagggucaagggacacaccccagaccacacuuugagaaccccucuuuuagaaugcucuacccccauucucugcuggccaucugaauccuuucaucuuuuuuuuuuuuuuuuugagacggagucuugcucugucacccaggcuggagugcaguggcgcaaucuccgcucacugccagcuccgccucccggauucacaccauucuccugccucagccucccgaguagcugggacuacaggcgcccgccaccacgcccggcucauuuuuuguauuuuuaguagagacaggguuucacuguguuagccaggauggucucggucuccugaccucaugauccaccugccucggccucccaaagugcugggauuacaggcgugagccacugugcccagccccuuucaucuuuuuagcuccaacucaagcucaucuauccagaaacuucagcgaagcuguuucucaccaucuuggacugugugucuuccauauuuuaaaugcuuauagcaauuacuuacuagaccagcggcuggcuguaugcaguucugugucauguacacuguguuagaugaccuucguuccccugugacuugccuuccuagcuagaugcaguccuugaaggcaucaguugagcucgagucuucuuugaucuugccauauauauuagggccuagagucaagaaguauugaguugguggguuuuaaaaguacugaaaaggagaccuugaagucaguuagguugcugauuuuucugauacuguaaauuagcaacaacaauaaaaaacuuguuuauuaagaggcuuauuuaucacuuuuuugauccaauaagggaacucuaauguagaauuuuuauucaguguaauucauuuuaaauaaauaacaguauacuaaagcagaagauuaugguacuuagguuuuuuucuaaugucuugggaaaauuuuaaaaaguagaguauuuugguuuuuuucuuaguuuucuuuuacauauucaguggaaaaaaguguagucucauaagaucuugguuaaaaggucagugguaaaaaguauagccucauaagaucuuauuuuaauuaaagcacuucaaaauaagauuuccauuuaaauacaguuaugcaucacuuaaugaggggguacguucugagagcuguguuguuaggcaauguuguuguuuuguaaacaugauggcaugugcuuaacacaaaccuaggugguagucugcuacacaccuagggcauauggaauagccugucacuccaggcuacacaccuguacagcaugucauuuaacugaacccuguaggcaccuguaacacaauggcaagaauuuguauaucuaaacauagaaaagauaccauaaaaauaugguguuacaaucuaaggcaccaccaucauuugugcagucuguuguuaucugaaaugucauuauguggcagugacuguaaagguuucucugugaucuuuuaugcuuuguguuucuuaauuuauuuugggaauguuucucaguagagcauagcuacauauauauuuaauauguuuuauaagauaggguuuguuuugagcaugucuuguucugugcgagcacuguguugaggauugaggagauaaagaccuguuaggaacugaaguaguggcuguuuccaucauuuuugaaguguagcaccuguugcuucuggacauccaguguacuugggaguaacuuggcccccacucaguuagaucuuauuguccuugaguggaugggacaagauggaacccauuucauguaaagagccaccuggagcuuugggugagaaaaucagaugcuuuaaagcgucuagggagacacgggcuuaccauaaaauuauggaguuccagaaagcacauuggacccuaggguguguaucaugguuaaagccaauagauaagaucagcauuccucucccucuucaguaaaagcuucgcuacgguauaugcaauucuagaaagagcucaucaagcaaaugauaugaaaucuaaaauuuuccaguucaagaaagaagcucaaaguuccuacauuaaagcaacagcagggugaauggcaacuuauagcccugccaugugaugguggaaagguuuccaccugcauccuuagcggagcugagugagucagucugccaccaacaugaaaugcggugauguuuuccuaaaucacagggaagauucaucuggaauauuucaauucgaagaugggucuccaguguuuccuuaaacacuggguaccugccaaagggcagggcacagcggugucugguuuagcacaguguccucucuaaucaccucacacguuccuaucaguauguuguuuuaagcagagacucuccagugcuccugcagugaaggaagugcugcuucccaaauccaaacagcguugucaucuucauguucuccaccugggggagugagagaacaagccuagaaauuaagcucuccagaaggggaaaaaaaugcuuuauuaagggcauuuggcuuuuucuucaucucguguguguguguguguguguguguguguguguguguguguguauuuuuuugagacagagucucacccugucgcccaggcuggagugcaguggugcgaucuuggcucaccacaaccuccgccuccuggguucaagcuauucuccugccucagccucccaaguagcugggauuacaggugugugccaccacacuaucuuguauauauuuccuuaauauaagauugagcagcugggcacgguggcucaugccuguaaucccagcacuuugggaggcccaggcggguggaucaugaggucaggagucaagaccagccuggccaagauggugaaacccuaucucuacuaaaacuacaaaaauuagcugggcuugguggcaggcaucuguaaucccagcuacucgggaggcugaggcauaagaauugcuugaaaaccugggcggcagagguugcagugagcugagaucacaccacugcacuccagccugggugacagagugagacuccaucucaacaacaacacaaaaauggcccccaagagauuaauuucagauacccugcagccugcagguguuagcucugaccaagggcuggcauggcccggugguaauaucaaauuacuaaggggcucugaagggguuagaccugcccuggccaagauguuuguuguuugcugcauauggcuauuuuaaauuuaaauuuaaauuaaugaaaauuaaaauuauguaaauaauucagucccucaguugcacgggccacauuucaagugcucaguagccacauguggccagcagcuacucuguugaccagcagauguggaacauuugcagcuucacagaaaguucugcuggacagagcuacuucagacccuaccaguauuuuccaaaauaauucuuaugggaguguauuuaauuuaauugaacuuauuuuguuaccuaucaaucuucuuaauaugaaauaucaaauuuaagguuaaauuuaaaggaagagaagacuuauauuggcaaaagagaaggaaguagauaaaauuaaggaaagaggagggcaagaagaagagggaaugcauggugagacgagagggaggcccugucuacugcuuggucugugguuggccuacaccugauacccacacgagaaagacuccauugcccauaggagcgggacuuggacagacccaagagcagucacgaccuuuuguccuccuagucuuucuuuauagacauuuucucuuauuuauuuauuuauuuuggguucaaaacacaaaauuuauuuuggguuaaaaaauaaaguaaugcggcugggugcaguggcucacgccuguaauccuggcacuuugggaggccgagucggguggaucaccuaagaucaggaguucgagaccagccuggccaaaauggugaaaccgcaucucuauuaaaaauuuuuuuuaaaagccgagugugguggcaugcaccugcagucccagcuauucaggaggcugaggcaggagaaucccugaaacccaggaggcagagguugcagugagccaagauugcgccacugcacuccagccugggugacagaaugcaacuccgccucaaaaaauaaauaaguaaaaaauaaaguaauacggaaaucaagguucucccuucaccuuccucccauucucagaccugcuucacagagcacagccacuuuguccugcugauuaugaauggggccacuguccagaacacggaagcugugcaauguggcagaggcugggcucuggagucaggucccccuucuguccccuggagggaucauacccucucucgguaucauguuccuguuuaucuuggccgauuucucugacauugcggcuucccuccaggggauuccuucauucucagucauccagcagguucauucugagaccuggcaugugcugagcaccauugcgggugcagaguuccugcacucguggaguuugccuccagugagggcacagaaguggaguguggagcugcagguguuuucugcggggcacuagugacauugggcgugagagcgucucaccuuugcagagcaauggcccuggggaucucaauaccaugaugacaaccaaaaccacucacauagcuccacacaccacugguggacaggacccucuggcagccccucugcuggagauugggaggcugcuucagguggucaaggauggucucaccaagcagaugacaugaaaagugaaaugugaaugucaagaaggaggccacagugcaaagaucuagggcaagauauucauucagccagaggcagcagcuagugcaaaggccccauggaggaagugaguuugccguguccacugccagguguucaguugacuaaggaaaagugaggguaggcagagcaggagggauggagguagggagccgagcacagacaagguaggguaagaucuuauaaacagccugccuagacaggguuuugggauuuuggcagggagggggaguuguuuugggguuuuguuuuuagagacagggucucacucuguugcccaggcuggagugcaguggugcaguccuagcucacugcagccuugaacuacugggcucaagcaauccucccuccucagccucccaaguggcugagauacaggugcacaccaccaugcucagcugauauuuggauuuuuuuguagagaaggggucucacugugucagccaggcuagucugaaacuccuggccucaagcgauccuccuaccucggccuuccgaagugcugggauuacagacaugaaccacugagucugguugggcuuugaguuuuuauucugagggucaugggaagccacugggguguuuugaguagggaaguaagaggaucuuccuagcugcuaugugggaacgaggggcaagagcugaacaaggagaccaacuggaagacuuugcuucucagaugaaggguuucuuuguucacacaggcaaagaugaggcacuggcacagcuggcugugggugggcuugucaucugaccacuugcuuuagaggccuuggcugggagcuggcucuugugacuuuuggccccuagagacuaaacugcagagaauuugcuuugaggugccagcuccuacauuagcagccuuaguuuuuccuagacagacugguuucuuuggagaaucccuuuuucuugucauaaccacucaguuuaccaauguucugcagagaagguguguggggauaagguggcuauggagagaucaguauucagaccuaacaucaaucuccuuuucagcugcauaucucacuccuauucucugcuauacccagucucugagugcguggccucggggggauucuguagggacagagcaccugcuuucucccuccagccccacgcugcuuugugguugccagauggaaguugcaucuguugaauauugcuaugcugagaugcaccagugacugccuccgcaaaucuuuuuauuacuggaggucguaacuugccucuuccuucacucucacuuguaaggcaggcucaggagguuugcugauugugagugcaucaucgaccuugaucagggaaaucuguccuguuuuccuuuauuucuuccucucauccagaaauuguuguccuggcacgagaaucaguaaaccuuuuucuguaaagggccagauaguaaauauucaaggcuucagggggcgcguggucucuacugcaacuacuuaacucugcuguugcagcaagagagaagccacagacaacagguggauaaacagacgugaguguaugccaguaaaacuugauuuacaaaaauaaccaggaggccagaugugguucaugggcuguggcuucccagccgcggccuacuggaauccaaaucggguucagcacuuggagaagcugcuaguauuggucccugggccuguaucugaaaccaguacuagccauggucuguggaagagguaucuuuuuuguuugacucuauucaccaucuaagagauacugagagaucagugauucggcccugcccaacugaacaauaaauaucuuauaucuaguugugaauuuugagaauugcaguguuuaaaugaagggaaagagcugcuuguuucauuugguaaaucccuuauaugauaaaacaucuaggagagaggcuuugucacaaauccaguugcccauuuugcuguuuccaugaaauauuucaaaguagagaaacuaauagacuuccauguaucugcugcacagauugccuuuuacucccaauauacuggggugcuguugccuggcugcacggaagguuguggggugugagggcacuuggacauucgggcuugcugugucucuguuagaaacuaauggggcguugucccugagcgugagggacaccucuggcaucuuguuuccucuaccugaggaagugcagccaugcuuguugggaagacuugggagaggaccauguaccacugaggcagguaacacccuuugccucuguaccucccugugggccuggcaguggggcugggcccagggccagcaguccaccuacccuggcuaggaaccugaacuccugcauaauuucaaggcccuucugggcaacaccuugccuugccauguggacuggccaccucaucuuuccuugucuccagacacccccaccaccuccuucccccagccagagacuccagaaucccagauccucacagcaagacacauccucccccagggaccccgugucuguucaguggagaggcucugggaaggggagggaacgacuuccucuuuauucccguagcuuccauuugaguggccgacaagugucucaaauagcauuucagauugugccccccccccacuccacccccgccuuccuccuagaaaaugcagcuggugcucgugugcagccacuguucagacacguggaggccacagugcucgcuuggaacccucugggaccaccgacuuucaguggcuucuacugaagggaagggccgacuauuuugauuuggguuugacagauaauacugaguuugaaaaauaauuucccaucauuaagccagacaucaagaggccaaaguaaauucuaggucaucucuccccucacugagugaguucccuguaaccagcauuccagaagagggcgaaaggggaagaaucaaguccuuuuuuuuuagauguugcccaaaccagaucgcuaaacaguaucauaccuuuuuacugcgauuucuuaucauuuuaagauagauacccaguuuuuauuuuaggaguaaacacuuaaacugaggaagcacaccuguuguuucucacuuccuauucagccaacacuaaugccuucucuguacugagaacagcugauccucccaaagcgugugugucucccugucuucguggggcccuugcuguucucaccauaagcccagaagacucaaggaugcucagcgggucgugcagcccucuccaccaccuauuccagaaaguccuccucacccuaaaaggaagccccauucccaccagcagucacuccucacuccccuucccccagccucuagcagcuaccagucugcucucuguagaugugccgauucugaauaguucauagaaauggaaucaugcaauauuuguccuucugugucuggcuuccuuuacuucgcagaaugcuuucaagguccauccauguuguagcgugcgucauaccucauucccuuuuuuuuuuuuuuuuugagauggagucuugcucugucgcccaggcuggagugcaauggcgugaucucggcucacugcaaccuccaccucccggguucaagcaauucuccugccucagccucccgaguagcugggacuacaggugcacaccaccaugcccagcuaauuuuuguauuuuuaguagagacaggguuucaccauguuggccaggauggucucgagcuccugaccucgugauccgcccgccucggccucccaaacgcucguuccuuuuuauagcuaauauucuauuguuuggauauagcacauuucauuucaucaguugauggauauuugaguuguuucuaccuuuuggcuauugugaauaaugcgcugugaacauuguguaccgauuuuuguuugaacacuuguuuucaguucuuuuggguauaugccuaggagugagauugcugggucauauggauggucauuuuuguuuguguguuuaagacagagucucgcucuguugcccaggcuggaguauaguggcgccaucucagcucacugcaaccucuaacuccuggguucaagcgauucuccugccucagccucccaaguagcugggauuacaggcaagcaccaccaugcccggcuaauuuuuguauucuuaguagggaugggguuucaccauguuggccaggcuggucucaaacuucugaccucaggugauccacccaucucggccucccaaggugcugggauuacaagcuugagccaccauaccuggcuuuggaugguaauuuuauguuuaacuugccgaagaaccaccaaacuguuuuccauaucagcugccccauuuuacauucucaccagcaauauacaaggguuccaauuguaguuccacguccuuuaugacccuuguuuuuuguugagacagggucucauucugucaccuagacuggaaugcgaugguacaaugauggcucacugcagccuugaacuccugggcucaagcuguccucucgccucagcuuccugaguagcugggacuacaggugcaugccaccauaccuggcuauuuuuuuuuaauguagaaaaggggucucacuauauugcccagacuggucuugaacuuacgggcuuaagcaauccuccugccucagccucccaaagugcugggguuagaggcaugagccauggugccuggccaugcuaacaaguuauuuuucaguuugaaaaagaauagguaucccagcaggugugaaguaguaugucauuguaauuuucauuuacauuuaccuaacaucuaaagguggugagcaucuuuucaugugcuuguuuggccauuuguauaucuuuuuuggugaaaugccuguucaaguccuuugcccauuuuuuaaucggguuuucuuuuuguuauugaguuguuagaguucuuuucauauucuggauacuagacccuuauauaauuugcaaauauguucucccauucuguggguuuuuucacuuucuugauaguauccuuugcacaaaaauguuuaauuuuuaugaagucugguuuaucuguuuucuuuuuaguugcuugcacccuuggugucauagcuaagaaaccauuaucaaauccagggucaugaagcuuuaccuuuguauucuucuaagaguugugugguuucagcucuucuguuuagguuugugauucauguugaaaucguuuuuuuccuguggugugaggggggauccaccuuuauucuuguccauauggcucuccaguugucccagcaucauuuguuaaagacgcuguucuuucccuggugaaugggcuuggcucucaauuuuauuccaucaaucuguaugucuguccuuaugccaguaucauacuaccuugagccagaugcacuuuuaaaagauccaaggcugggugcgguggcucaccacaccuguaauccuagcacuuuugggaggccacagcagauuggauugcuugagcuuaggaguucaagaccugccuggacaacauagugagaccuugucucuacaaaaaauacaaaaauuagccagaugugguggugagugccuguagacuaagcuacucaggaggcugagggaggagaaucauuugagcccagcagguugagguugcagugagcugugguugugcaauugcacuccagccugagugacagacagacccugucucaaaaaaauuaaaaauaaaaauaaaguaucugaaaagacauacaaaacuagguuuugucugggaggacaaguaguuugguauugcuggaacaucaagugugcauggaagugguugugugaaggcuggaauuaaggacgugagagacagugacugugugaaggagacgcagcaagcuccggagccugccugaguguuggcagauaacggggacaugagauguguccaugcucucaacaagcucagaaucucuuuguagaagcagacaugggauuccaagccugauggaaguguaagggaacccccuuaagaacacugaggagaugguggggccuggcugcguguaugaguggggaaaacauuaaagagaauggcauuugagcuagaacugaaggcugaguagaucaaaagcuuugugugggggugagaguuugggaacgggaagagggcauuucaugcugaagaaacaggcauugaaacagggcagggucagagaacauuugagaaucugagaguggcccagcauuccugaaauaaaggagagacucaucucucccauacauugagagaugaguccuggaaaaauaagugugggggagacagcggcugagcucaaaccccaugcuacggaguuugaacuuucucccgcaggcaguggggagccacuggcaucuugugagcaggggaauggucugauggaccuuuagaaaggucaguccaauaacaguaugaaaauaugauuggaggcagcugugcucaccacuguaccaccaacacugaaaauacgauugggagaaagaugagggaagguguucugauugucuggucuauagaggcugggguuaaugcagggaggaauaacguguucauuuggacuauuuucacauacauaguagucgagggaaucauauagggaagccccagguccccauugcccagccuuggccaucauccacugcaacccaucuugucuuauccaggccuccuccuccauaugcauggcccucucuucacacuacauuauuuugaagcaaaucucagucaucguauuuuauuuguaagucccaccugugguauccuccaacaaggacuccaagaaccagaacgugauugccucaccuaaaaauauuaacugcaauuccuuacucucaggaguaagcauuaaaucuccccuccccuccucccuuuuucauuugguugguuuggguccugaauugaauugaguccugagauccaaaucagguacacacauuacacuagguugugauaugugcugguuccuccucuccuuuuucuccuugcaauuuaauuguuaaaucagguuguucccauacguuugagagauaugauagucaaccaagggugauuuugccccccaagggacauuuggcaauguuuggagacgcucuuaguugucgccgcuuggggggaggggcugcuugcauguaacagggcccacagcagaggcucaccugggcugaagugugguggcucgacugcccggugcugcgggaggacaccuccugccauucccccacguucccugguucccugcguccagaucgcuuugcuuuugguuaacacacuccucucucucuuguauuuuccuaagaacuggugguuagaccucagggcuugaucagguucaggcuggacuuuccggcauuaaaaauacuucuuaaguggcauaucacuuaguccuuggcacauaagugguggcaguuuguuccguuuacgauaaaauugcagaaagggaggauuuugagaggcacuggagcauggaauugcuccggugugagguguaagggggaaguugggguccagcauuuggcucaaccccagacccagaguccagggacugaggcuggggcuuggcugcagcacugacugggugauuucaggcgcucaccccacagccugagccuugcuuuccucucuguaagcuaaggaugcgccagcucggccugaaccauggaaugcagcguggggcagccgcuccccagccuuccucccuagccgucucccuccagcuacaggugccuugcggugccgccacuggaggagucuuugcagguuuaugggacaucagagcagggagggagccgggugucggggcugcggcaggguccccaccgggcuguccacgaaccagcgaaccagcgguguugguggugucuggugcccaggaggagggcuuguuuacagcugccguauuucccgggacccuggcuucuguccucagggaccccuucagaccuuccccacccuccgaagccucaacccgcccugcgccucccgguggcacagcgaccuuggcggcuuuggccccugagccgcuaggcugccaaggcgcgcugugcgcguggggccaggcucgaccucacuccuguugucgcugcagacccgcgugggcucccgccgggcccuccugccgccccccagccuccccgccccugcccuugccagccugcgccuuccugggcgccugacgcaccccucugccccaaccacguuuucucaagaguguugucugucccggccuuccaaggagacccuuagcucccgccggccgccuccggagccuccggcaugggccccaggccggggucccgccuuugccccggccuccgcugccucgccccggagcccggaggaggggagccggccacccggggaagaagcggaggacgccgaucuggccuccugcguugcgcgcuccaacccucugcuuggccgcccgcgaaccgcgcucucccguuuccuuuccgucccgucucgggggcuucauccuccagccguggccguggccguggccagguguaccggagcggcacccaggagcccgcccuagcacccgcucccgcucccaccucgucugcgcccacccgcucugggcagcugcucccaagggagccccucgcccucucucucuccuucccucauucccuucauccuucucucccugugugccuccuucccucccucccucucucccccuucucucuuucucccucucccacucccucucuccccacccuuucuuccccuccccccucccccucccccuucuuccccucccccuccccaucccucucucuccccucucucuuuuucccccucccccucccucucuuuccucuuucucucucccccucccccucccucucuccucccucucucuuucucccccuucccccucucucccccccuuucuccccauuccccucccucucucccccuuccccucccucucucccccuuccccucccucucccccuuccccucccucucuccccuucucucucucuuucuccccuucccucucucuccccucuggcucuuucuccccuucccucucucucccccccuuucuccccauuccccucccucucucccccuuccccucccucucucccccuuccgcucccucucccccuuccccucccucucuuuccucuuucucucucccccucccccucccucucuccucccucucucuuucuccccuucccucucucucccccccuuucuccccauuccccucccucucucccccuuccccucccucucucccccuuccccucccucucccccuuccccucccucucuccccuucucucucucuuucuccccuucccucucucuccccucugucucuuucucccccccuuuccacuuucucucuuucuccccccuuccccucccucucucuccccucucucuuucuccccuucccccugccucucuuuccccuuucucucuuguucucccccuuccccucccucucuccucccucucuuuuccuccuccccccuuccccucccucuuucucccccucugcccucucccccuucccccuccccucccucucccucucucuuucucccccucccucucugccccccucucucccucuccccccucccuucccccucccccucccccuccccucucucuuucucuuccucccucucuccuccucucuuugucccucucccccucucucuuucucccccucuuuucucucuacccccucuuuuucccccucccccucucucucuccuccucucucuuucuccccccuucucccccucucccccucccccucccucucuccccauuucucuuucuccccucccccucucucucuccccccccuuucucccccucucuuucccccucccucucucccacucucucuccuucucccccucucugagcccagguucuugguggcaucugcuuugggcagcucugcagcuccuuccucagggagaucaccucaccuucccagggacagacaaugucucaugcggagaggcccugcccuccugagcugaugucccaucggggaggaagaugcccccucagaguuggugggagcaccaggucacgguguuguggggcaggcagcugguggcugggcugggcagagcaggcagacuggcuccucucucuggucuuggcccugacgagagaauggaguggggcaugguggccaaaaggccaagggccccuuuggaacugugcccgagggcugacuuauuuucucaggggcagaagccuauccucaguguguccccauggcagucaagacccauggacuugcuucccagcccccuaggcugggccaccuuccaugcagccgaccuuccagcgggggucagaagccacgggggagcccugucauuggccucuacccaagguccucgcugugagugcugggcuggcacuauagugaaauaaaaaggagauggagaacauuaucuacuggaacacgcacguaugugacugaacaucuaaagccaggacagcuccuaggagcagcuccuccagacuguggaaucaaugccaggggcacccagagaaggcggagcagaaaccugucuaacugggggauucuguggaggagcugguuauggaggggcuuuuagggaagaaagacccaggcuuucauggcaaaagauugacagaugucaagcucagagcccaagaaaguaccuuuugaggaaaaagccacagacugagggagagaagggaaccgagaccccugccucccaggucagaggcugccugcuguuccgggcagucugucacaugagacagcucuuuccaggcauuccuaagcaccuuaguagaaaguaaagcagcucuuauugcuuaugaaaauuucauucaaggaugagaacaaauuaaugucuggggcuggaguuggugugucugcucuccuuggcccuaaacuagguagguuugugucuccaggauggagucuauauuaguucauuuucacacagcuauaaaaaacuaccugagauuggguaauuuauaaacaaaagauguguaauugacucacaguuucaccuagcuggggaggccucaggaaacuuaccaucauggcagaaggugaaggggaagcaaggcacuucuuacacggcagcaggagagagagagaaaguggggggggggaacugccaaacacuuguaagucaucagaucuccugagaacucacucacuaucacaagaacagcaggggggaaacugcccccacaauccagucaccucccaccaggucccucccuugacucguggggauuacaauuugagaugagauuuggguggggacacagaagcaaacugucucagagagugacagccuuuuuaaagagcacauaugcagacacagacucccuuucuuugggcagaaagaagggugggcaacgagcacauuauguaaaucaucuugacgguggacacagcagcuguuggcugucacugcuggauaguggucgcagcaaacagcugugggccaggucacugcuugcuaccuagagagcccuucagcuggggggcccagagcacagcugaacuccacgggcccccuuggugagcuccuuuggccucuguggaugacaggggaccccugguuccucugcuucgugcaucuucagacucuucuccaccucugcugaguaguucaguuggcagcguugcagguuggcugcagggguguugaccagcccuggagcuauggugcagccugggaaugagcacgcacaccaggagccuaggacaauggcagcagaacagcuccagcggagcguuuccuggggcucaaggggaggcacucagauggccugcuuuggguguucaagacugaguggugagccagcagggaacaccuagcauuuugugagauacucagccguauucaucuccuugcaccacuguacaaguuacacaugcaguggcuccaaagagcauaaacuuacuauguuaccguucuggcauguaggucugaaaugaggccaaaaugaaggugucagcagggucgugauggcucuggagguucuagaggagaaucuauuuccagccuuucccaccuucuagaggccaccugccugccuugguucauggccacuucccugcaucuuccaacccagccauguagcaucuucacaucucucucugaccccugcuuucauugucccauugccuucucuugucucccuccugccucccucuuguaaugaccugugugauucccuuggacccaccuggaugauccagaaucaucgucccaucucaagauucuuaacugaaucccaucugcagagucccugucgccaagcaaggucccauauucaccaguuccaggaauuaggauguggacaucuuuaggcgucauuauuuagucuaccacaucaaccuaugugguaaauauuuagcaaucaaaaguuugaaggaagauacgagaaauuaggcaucuuugaaucuuucagucuaauauugcugaaggugggacauaagccccauacuccagccacucuaaggaaugaugucuuccauggagugaaggggaaugccccagaguaagacucauguauauguuuuucuauauuuuaauagugcuacaaaauacaaccauuguacauauucauuuguuuuuguuuuuguuuuggaagcaaauuuccgucaggaaaaacagccuuguugcugucccgucuacaguaucugcuaaaauaaaaguaccagucucucagcccauagugaagaaagacaaacggcaaaauucuucaagguuuagcgcaagcaauaauagagaacuucaaaaacuaccauccuuaaaagguaauuuuuauuugucuuuuaaaaguuaaauuguggcuguuggagugaaggagcaauguuuugauagugugcuaauuuauuccuuugcuguguuuguauuuuguggggucaucuuuucuguauugagggguuuuuuuuuuuuuagguugaaugucauuaacuuacuuacucaauuaacauuuuaaauuccagagcuauucaagauaaaaguuuaacaacacaguauaggcauaauacacuaaggaaacaggaaaagcugaacaucuuuuuauuuaugguauuaagcuagccaguuuuucuuuuaaauuaauuuucauuuguuugucuuagaacuguagcaauuccgaaaggaauuacuccaaguacaguaauuguaaaaauuauaguagaaguucccuauguuucuaaaguaaggacuguagcuauaguacauuauggacuugcuuuguuaugagucauuugaggauuaccucuacucaagcauuucuuauaugaaauuaggaaaaagugcucuuuacuuugaauuuccccccaaaugacacagccaucucuuuccaucucagguuguuuaaucccuaaaagucuuccuuuagauuuugagauugaggugcuuaaaaccuuaucaaggaaaacagaguaaggaccguaaagucaaaugugaaccucuuaaaaccuuuauaauuacuaaaauauaagacagauauacuaaauaaaauaacauuuuucauaccuuaaauuuauaauaauggaucuuuuacaauuaauuuccacugaauauuaauucagcaaccaguccaguggcucgcgcuuauaaucucaucacuuuaggaggcugaggcagaaggaucacuugagcccaggaguucgagaccagccuaggcaacauagggagacuccgucucuacaaaaaaauaaaauuugcugggcaugguggcacacaccuguggucccggcuacucaggaggcugaagugggaggauugcuugagccugggaggccaaggcuacagugaaccaugaucgugccacugcacuucagcguggaugacagacugagaucuuguucucaggaaaaagaaaaguaaauaugaacucagugagagcaggcagucugucauguuuauagcuguauucccaggcuuuccacacuguaaagcagauagcagauuugccagguggaaggaggaagggaggaagggaggcuggguggaugguggauuuauggguggguggauggguggguggauuuacggguggaugaauuuucuugcccccuacuugcuagaaauccagguucucggccgggcgcaguggcucaugccuguaaucccagcacuuugggaggccaaggcgggcggaucacgaggucaggagaucaagaccauccuggcuaacauggugaaaccccgucucuacuaaaaauacaaaaacaaaauuagccaggcgugguggcgggcgccuguagucccagcuacuugggaggcugaggcgggagaauggcgugaacccgggaggcagagcuugcagugagcugagaucgugccacugcacuccagccugggcgacagagcgagacuccaucucaaaaaaaaaaaaaaaaaaaaauccagguucucgcuugcauuuucuagagcuuguauuuggcuuauauuugguuuaccuuugugguagauaauaugcaugcuaagucauuuuuuauuauuagucuuccucuucccaaauaggauauaccuuucucaugcuauucauucauucagcaaauauguguugagcgccugugaaagcuauucuagguacuagggguacagaauuacacaaaaccaagccccuauucuccuggagugagcaacccauuggugagacagcaaggaaagggauagguaucaacuccuccuuccaguacccuccggaggcccagagucagagggagggaaaaggcuuuguauaaccacuguugggccuucaugucccaagcccugccccuaaugcccaucacagcuggggcuuggaucugccaugguacagaagguuggccgugugccccauuuuuccaugcaugccccgccucagccagugcaugcuggguguguacugcugcugaauuuggucaaaugccauaugauuuuucuccuuaagauguuaagauuauaauugcuguguugauagauuuuucugguuuugaaccaucuuugcauuugucaguuuugucgccguauauuauuccaugcgcggggcagagcccaugcaaguaccggugugugccggccucuagcauacuuccuuuaccucuucugaggagucgcugcacaagccucuuucuacaucuguucuacaucuguuuucuauucucaaccuccguuuccuucguuuuucauuauaccuaguaagaauggcaugcaauauacuuccacugacgcuuacauuuucacuuuuccccaaaaugguaaauucuccauaguaaauccacauauccaggagaauuucacauguaucaagccaguuccccucacuggucuuguuugauaauucucucuuggcuguucuaaaacauuaaugccucuguauauauacuaaaauaauuucaccuaguucagaaaaauaauaauugauuggaauuaaaguuauauauuaauuuggugaaaauugauaccuuuuuuccaucuaggaagaugguauauaucccccauuuuucugggucuuguuuucugacuuauaaaauuuuaugguuuucuuguaaaucucuaacuuuccaguaaauuuauuucuaaauacucuauagcuuuugucacacuugugacuggguuauauuuuuucccauuuccacuucuaauugguuuuuguuaaucucaugcagagcuauugguuuuuaaauauuuucuuuugccgucaccuuaccacauuuucguauuagucuuaauuaauuuuuccacuacagucugcauauauaguccuguuguuugcaauagauucuuuuaucucucuuccacuauuuaugccaacauagacuaguuauuuuaauuuuauucugccacuaagaaggaccaauaaaaccuggaacagaggugauagcaggcauuccuguuuucucccauuucaguaaauggcuucagcguuuccuaaguugaugggaaaguggcucuugguuucugguaagcagccuuugcaaggccgcuggugcuccggaguccaagcucacaggacucuucccggacccaugcaggcugguuggcgccaugccagugcaugcuggguggguacugcugcugaauuuggucaaaugccauaugauuuuccucuuuaagauguuacuauuauaauugcuguguugacagauuuuucugguuuugaaauaucuuugcauuuugucaguuuugucacaguguauuuucauaguguuuggaacuaauuuucuuuagaauauuugcuuccguauuuacuacauggagcuggucuguaguuuuguucuuuuucauaaaccuguauuuuguccugucuaagauuuguugucaccagcacuuugugaagguuccugggguggccuggagcagcuuuucccgcagcucccucacacugccaccuuaugacagggauaaugagauggacccggauuucagaaacaauaaaauguggaauguguccaugaaauaggguugaaaguuugacuuggaacucagugggccuguugcuuuucucuaugaaacgucuguagcuucuuagcacagugcguccauuuagaaaggggggucuguuaacuaguacauggucauuguuuaaugcaccuuuuaaucucuuccuuaucaguggcgguuaugucuccuuauaaguucauuuauucuuuugacuguucuguuuguguucaguauuauucaucuguacuuuuaucuuuaauuauccuaugucuuuuauuuuaaccuuuucuucauuuauuaaguugaauagagaguugacuuauuuuuaguuugcuuuuuaauaauaaaagaauuuaaagccacguauucauucugaguguaaccuucagcccuaucccuagauuuuauuuuuuccuaacuuuucaagucauagguuuuucuuuuuuagaguugaggcauaauuuacauauccuaaaacucacccauuguaacuggaaaauuuaguuauuuuagcaaauacauagaguugugcaaccgucaccacaauucuguuuuagaauguuuccaucugccuccaaaaguuaccucgugccauucaccauuaaguuccccuccgggccccagcugcaggcacccacugaucugcuuucugucucuagacuuacuuucuuccggacacuucauauaagcgaagucauaccauagguagucuuuuacaccugcuguaagguuuuugagguucaucuguguuguuucuuuuuaaugccgcaucauauucagucagauggauacaccacauuuuguuuauccguucaccaguuaauggacauuugggcuguuucuuagcugguaugaguaacagugcugcugugaacauuugcauagaagucugugcgagcagauauuucauuucucuugaguagauaccuaggaguggaauuccuggcuugugugguaaauuuauguuuagcuuguuaagaaacuguuggcugggcaccguggcucacgccuguaaucccagcacuucgggaggccgaggcgggcggaucaugaggucaggagaucaaggccauccuggcuaacacggugaaacuccaucuuuacuaaaaauacaaaaaaucagcugagcaugguggcacucgcuuguagccccagcuacucgggaggcugaggcaggagaauugcuugaaccugggaaguggagguugcagugagccgagaucacaccacugcacuccagccugggcaacagagcaagacuccgucucaaaaaaagaaaaaagaaaagaaaagaaaaagaaacugccaaacuguuuuccaaagugguuguacuguuuuacauuuccaccaacaauguaugagggcucugauguggccacauucuugccaauaucuauuauugucuuuucgauuauagcuuaauucuuguggguguguaauggugucucacugugguuuccauuggccuuuccccaaugacuggaaauuuuaagcaucuuuucauaugccuguuagccauuugucucucuucuuugaugagaugucuuuuuuuaaguugguugucuucuucuuguugaauuguaacaguauguuuucccagauaugaguccuuuauuuuaacagaaaauaaaauacaguaaaaauaaauuauuacagaagugaaguacaaaauacacuguguauaaaauaguguuuuuauuauuauagucaguagacauaagauuacccuguuaaguugauacgaaaguuuugaaacgcuuauucucaauuuuuguuauucguuguaaaucuucagauuugucuauaugugucaaacccuucuuuugagcuuuuaauuucaggguuuuuuuuuucauuuaugaaaguucuguuugguucuuuuuucagucugcagugccauuuuaaaauauuuuccuauucucuugaacauaccaucaaaacuuguaugguauacaaguuuaguauaguauacuaaauaaguauaguaaacgcagcuguuuuauagccugcgucaggucacacuaguaucugagguguuugacacauuuuguucaugaugucuuauuuccuuguguaccugauuuuuuuuauuguauauuggucauuguauucagauaugugaaauaaauugaaaccuagaaucaaagugucuucuucaauagggauuuguuuuugcucugccagacaccuggaggcacugccaaucugggagugccuuaaaccacaacacugguuuguuaaaucaaccgacccaguuguucugcaauauaucccacuuaccccacugcgguuccuguaaauggaaaccuuuuuuggcugaaauacaucagaggcaacgcuuuauaacuuaggagauagugacauuauugugagagaugcauagccucugguugccuaucaucagaagugaugcuaaauuuucaguuuuacuagugaauucaguugaugacagauugauaucucuauugaacaauuacauauuucccuuuacaauucaaaaaguacuaguaauagucugcaguguauauuuuggcauccuaccaauguguauucccugucaaccaugugcuaaugucuugaacaacaguugauaauccuugccugagucaguaguuucaguuucacuagcgaauucaacauuuacucuaacguucuucugaaagcagugauuuuucuuaccaaccagagauacuugguuaucuugaaauggagcuccuacugaaaaagaaggauaagcuuaauucuuugucuuuuauuaccaguucccucuaauggugacagcugaagcuuuuuucuagcuuucucuuuguuuuaauaucauuguggacuaauauauuguugauuucaguguguuuucauguaccaaaagcauuagucuuucugguguucagauggcauaauugcaaucauuaagugcccuuuaggguagcucguguguuuuuuuguuuguuuuuguuuuuuuacauagccucauuuauuuuugauuccuugauuucugacacagugagacaucccuugggcucauuuaauaccuucucuuccccagacuucaaaucagccauuuuucuuuucuuuuuuuuuuuuuugagacagucucauggucucauccaugcuggagugcaguggugcaaucuuggcucccugcagccuccgccucccacauucaaaugauucuccugccucagccucccaaguagcuaggauuacaggcgugugccaccaugcccagcuaauuuuuauauuuuuuguaaauaugggguuucacuauguuggccaggcuggucucaaacuccugaccucaagugauccacccaccucggccucccaaagugcugagauuacaggcaugagccaccacaccuggccaaaucagcuauuuuucaaagagcccugguuccuuucaguaguaaauauauuagcaaccaaaaucugggucagagggauguuuauugcuacuggucugacauuacuuuuaaaugcuuucaauggagggagcgaggauauaaauuuucugaaucguacauucauauugauauuuuaaauuuaauuuuaacauuauaguguuuuugaagcaggauauuucccugaccacuucacgggcaggaacuggacugcgugggugugggaacuagcuggccccuucagcgccagcaagggcgaucuccacuuacucgcugcuccaccccucgugggaggggaagugcaggugagcuggugcaggagcacuuuugggcaccagcaggagcaaaccccauaccagccccauggcagcgucuucaggggucccugugaucccugaagccccagagaaaguguugcaguacucuuuuagcucugccauccauggaugacuuaaguguuaacagcucaguggagggucagugggacaaccuuuuacacccauacucauggcacccaaguuguuguccagcauccaggaggaaugagguugcaugaaggaauugaagaugguaaaugcaggggauuuuauugccaaugaaaguggcucucagugggaagggaagcuaaaaaggagacagagugggaagguaaucuuccccugaagucuggcugucuccagccagauucuucucugaaguuacgccaucaaguugucccucugaagucaagccacuucuuuccaacauccaacucuagucuccuauguccaguugcuucucuucucucuaccagcugagccugggguuuuuaugggcacaggauggaggcacggggcaagccaugggugguuuuggaaaaggcaacauucgaguggggaaacaggaaugcauguucucacuuuggaccaagguuccaggcuuuucggcuugaggcuagggcccucacaagggacgugcccucuucugcccagaacuucccugcuuccuguuccuaucacuuucacuuauuucuuggcuuucauaguuuuaucucugucuuacacugaaaauguugauuucuagcaucacuaauguaauuauggguauauucucuuaaacaguucccaaaaacaauauugauauuacugcaaacaguuggaacuuugaauugacccauagucauugcagaaagaaacagcuguugacuuuauuuauuuauuuauuuuagagacaguuccaugcgauguugcccaagcuggucuugaacuccugggcuuaaaugauucuccugccucagccucccaaguagcugggauuacaggcacgcaccaccaugccuggcuacuguuggcauuuuuauugggauccuguuacauuuugcaaauaucugagggagggcuggcaucuugugaugugugccuccucuaagaguaugcuaugacuauuuuccaaggccacuuucauguccuuuaaggcuguuuuuaaguuucccuuguagguuuugcaugucucuuacuaagcuaaugccuagauaaucauuaucaucgcucuuguaaauagagucuuuucuuccauugugucuucuaguuauuaguuguuuauaugaaggcuauugaauuugggggccuugcuuucauaaccugcuuccuuacugaauuaccugauuguuugcaucaguuuuucaguugauucuuuugaauauucagguauuaauuagagcaucugcacauaauuucaccucuguuuauaauuguaaacucacaugucuuucucuccaguugacuaauaaauucaguaaaacaauuucaguaaaauguuacauagugguggugagagugggcauacuugucuuguuucugacauuagugggaacgagaggcaugauuuuuagcaaccguuuauuauuucauucuguggauaccccaguuuuucagcuauuauaaaugauacuguucuguuaaucuuuuguuaucguuguuguucacaucuuugaaccuuuccuuaagcuugaugaaggagguacuggaucaaagagcaggcauuuucaaaaacccuuaauagauauugucuacacacuuuccagagaguagcaccacauacagaguaugugagaugccuguccaucauaccucuccaaugcugagaucauguaaaaguuguaguuauuugauaaguagaaaaagguauuucauauuuuuauuuuuuuuuaaccagugagguugaauauagcccucagaccuguucauuguaagauuauucugaauuaaugccuucauuuaacauuuuuggacuggaagguggaaguguuaaauaaagagaccuuuuuuuuuuaagauacuuauaggaagaguaaauuaaucauggacuuguuuuuugaggccauuuuuagaaaagaaaagacuaggagaagucaaaguuauagcagaauaauguaggacuuauuaucggcuaacuaacuagagacccuggggcaaaagaguugccgaguauuuggucuuuugugaaagaagucauuacauuauuguuagaauuuacuugaauuguuuaaaauuggcuuuugaauaccaguuaaauauuuuauaucucuugcucuccucucaugcaaauacaauacuucacccucauucaaagcaguuuauuuucuuuuuugagacacgguuucgcucugucacccaggcuggagugcaguggcacaaugucagcucacugcagccuggaccucccaggcucaagcaguccucccagcucagccuuccaaguagcugggaccacaggugcgcaccaccacgcacagcuaauuuuuguauuuuuaguagagacgggguuccaccauguugcccaggcuggucucgaacuccugggcucaagugauccacccaccuccgccucccaaagugcuaggauuacagccaugagagccacugcgcccugccuauuuucugauacaauugaaagcuuuaccauaaaaguagagguuuaacugccuacaaaugaauuaugcauauauuuacaggaacuuuggcuucuugccuguuaguugaagaauaauaaaaauggacugugcggaaguuaucggagugccugcugcucuucuagucagcuuagaaagagccgcgcagggaaucucugcuuucauuagucuuuucuucucuugcauguuuugauuuuugugucuucucgugauuugccaugauaucuuaaugagaggacacagucccuggauugcugaggcaguucacacuggccaucugugcuucucagagcaaggggaagguguucagagcgaugacccaagguggcccuugcccucagggaaccagcgggcccggagucacagcgguguucuagcuucagccccucuaagccacagagaguuaccaccagggccacucccucuucagaacacuggggagcccguugccugucagacagccugagcccagccagccagcccagccccuccaggguacccccucuccauggcccggggcuacacacaugaccuuggccguuacuccauggucagucucagcucucucuggguggcacccaugggguuuaguuuccagcugccagcuguaaucucggcucauuaccgcacacagagaccacuucuuggacauucccguccucugucugguccagcgcccugcugccucugcuccucaaguguuuccugaacugcccuggcucaagccguccuuaucuaaaaaaaaaaaauuuaaaaacugaggugaaauacacauguuaaaacauaauauuuauuauuuuaaccauucauaaguguacaacucggugguauuagauacauucaaaaugcuguacacccaucacuacuaucucuacccaaaacuuuucaucauccccaacaaaaacuccauuaaacaguaaguggcugucuccccauucugcuuucugucucuaugauuuugcccacaguaggagccucuuagaagcggaaucguacaguaucugucuuucugugccuggcuuauuucccuaaacauaauaucuuccagguccccccacauuguagcacgugccagacccucgcucccgucgaaggcugaugccauccuucagugauguguggacggacacauuccgcguaucccccaaucaguggauggacgcguggguugcagagcacgccacacacauucagucaguacacgaguuaacaguugcgugcuugucugccugugucauccauucgagcaucugccaaggacccaggaaacacacagugugucuccugaaggaaugaaaagcccuccuggccccucugcccucuuucuccacccucuccauuuucaccgagaugguuguggugucaccucucgugggguggccaaaaccccagccagggccaccuaucccuucaccucccuccaccucggauuuccucuuggaaaaugaggcuccugacucacuugaccuacugcguaggcuccuaaaagggugucggcaaguuggcaaguuaaaaaaaaaaacaaucagcaugaaagcacuccgauguaugcauacuuuuacuucgcguugguucccuacguucuuagaacaaggaaggagugugaguacuugcuuuggauugaaagguuuuccagacuagcuguaggaaguaugaaaguaaccaaggucucacacacagccccagcacucuggguggauuucacuucaucuacuccacucaccuacgcugagcuucccuguggacaagcucguccauccucuuuaaucacucccaggccucgcucacacagcaacaagugccugucccuguguccuugcuguuggcaagcagaaguucccuggcagccuuugaacauagcugaauguuagguaucuuugaucugucuaaggaaaaagucuauuuuaaacugugaagugaagccaauuuuuuuaggucagauucuuacccaacaaagcauacaucauccgugcucauauaguuuccaguuuaaaaaaaaaaaaaagugcuggccagcgcagugugagugcacugugcacaugaugccacuguucucuagguucagaacaccagccuucuguuaauuacaauaaaaugucuucacuaaaauagaagcauauuuaauuugccuacaaaauugcuuggagagccuuaaaaaauaaaaccuucagcugaaugauguagaaaugaaaauuugaaaguuuuaaucagaaauacuaccuagaaauaaaaucaguaggauguauuuacagguaguuuguuuuuaaguaaagaauaaaacagugacagagggaucaaagaauaaagaauaauuccuuuucaagccaggcacaguggugugcaccugacuucucagcuacccacuaggcugaggacggggagaaucaugaguucaagcccagccugggcaaaauagggagaccuugucuccaaaaaaauaugaaauaauuguuucuucauuauugucuaguacauagauuauuguaguuauagcauuugaugggagaccauauugagcacuguggccuuuuuggcccauugggcuguggaagguaugcuaggugggcugggcccagcaaagcgcccuuccuugguccuugcucaagcccuucacaggcagcugcagucucaggaaagguucagaaugucacugcgaggccagcguagaaggcagguaggcaugucacaggaggugaguggaaggcauccacuccuuagcaagugcaucaugggggaccuggaauggggucuguguucaggggagagggaaaugcuguucuugagaugauuugacagcauaucccucuuaauuaugugcuaccuggaagagguguaaaggguagcaaggugguuuuguaagaucagaauugggugcaacugcuugauucauucauucaguacauuugauggaacaccugcaugccagccauucuguaggagcuggaccaaggaagagcuugugguccaagccacagaccgggagggaagaggaagccugccuggaugaggguggucuaagccgagauuccucagguggcucugcugcauccccacgccgcagcugaagggaucuuucuguuggcagauggcccauguuuuuccagugggacaaugcccacugcuuccugcauuuugcucugauggccggagcuguauuuaguuguguccugccucagucccucccaagcuguccaccucaacucagcauggggagcgcacuccauaucugacgcuggcuucucuaaacgugaggggauagggagaugacauauaugcccuuuuacgggugaggaaaggaccagcggggauuuauugaaggcagccucgcuccccaugcugagcgacagcucugucuagccccucccugagcaggugaugaaaaccuggcccagugcgagugacaugguugcauuaugagccucuucuggguugcauuuacuuagaguuuguuucaucagugaggaaaguacucuggagacccaguugaacucugauagcuucagugagccuacagacucaaugcaaaggugacaggcuuacaggagaagguccaggcgguucaaaauugauuugagacagggagucaaccuccucuaaucuguguugguuccauuuuccaugccucauuucagcuaauuuuuguuuguguuuuuuauguaccugaucucauuuauccagauuuccuugguucagacuuucuugguucucaucacagcccuuucuuuguuccuagccugugccuaagagacaguauucauuaagggauucucccugcagugacuuaaucuauaucucuuuuuaaaaauuauuuuuaugccaggugcaguggcucacgccuauaaucccaguaauuugggagaccaagacggguggaucccuugagccuaggaguuugagaccagccuggacaaccuugucccuacaaaaaauuuaaaaauuagccaggcaugcuggugcacaccuguagucccagauacuugggaggcugagguggggggaucacuugagcucaggaugcugagguuucagugagcugugaucgugccacuagguuccagggugguagagugagacccugucucaaaaaauguacguauuuuuuuaaaucguuacuuuaggccaggcacggugggucaugccuguaauccuagaacuucgggaggccgaggcaggcggaucaccugagcucaggaguuugagaccagccugggcaacaaggcgaaaccccgugucuacuaaaaguucaaaaaauuagccaggcgugauggugcaugccuguaaucucagcuacucaggaggcugaagcacaagaauugcuugaacccaggaggcagagguugcagugagccaagauggugccauugcacuccagccugggcaacagagcaagacucuaacucaaaauaaaauaaaaauuaaaaauauauauaaaauaaaauugucacuuuuaauuacucugaaaguaauguaugcuuguuuuagcaauaccaaaaaaaaaaaaaagggaaauuuuagaaauaaaaaacauccauaugauccuacagccuuacugcuggguauauauccaaaagaaagaaaaucaguauaucacaggggcaccugcacugccauguuuguugcagcaucgcucacaauagccaagaaaugaaaucaaccuaagugucaaucaguggaugaaugacuaaacaaaauguaggacauauagacaauggaauauuauucagccauaagaaagaauagaaaccugucauuugcagcaacauggauggaaccagaggugauuguguuacgugaaauaagccaggcacagagagacaaauaccaugugaucuuacucaugugggagguaaaaaaauaauggaucucauggagguagagaggagaauggugguuaccagaggcugggaagggaagauagggagagagggugguuaagggcugcaaaaauacagucagaaggaauaaguucuagaauucaagaguacaguaggggaauuguaguuaacaauaauuuauuauauauuucaaaguagcuggaagagaagaauuguaauguuuccaacacaaagaaaagauacaugcuggaggugauagguaucccaguuacucugaccuggucauuacacauuguuaacaggcaucaaaauaucacauguccccuccaaauaugcacaacuauuauauaucaauuuuaaaaaagaaaaacucauacccauaccacccaaugaugacacuguggauauuuggggagugauucuuccuaugaucauuuuauuucugauuacacacugccucuuucacuuauauuuucauuuuauacauuuauaaguauuucugauggauauguaauauuucacuagguaugugggauaaucccuuuggcauuaaaguaguuuccaguauuuuagaaccauaaauaaaacaugaugcccucaaaaagaguaagauaguuagaaaugaaguuaucaaggagagaaaagacuugcacacugcaaacuaugaaauguugcugaaagaaauggaagaauacaccaaucaauggaaaaacaucucucguuuaugguuuggaagacuuaauguuguuaagaugucaguacugcccaaagcaaucuacaaauucagugcaaucccuauuaaaacuuuuacagcauucuuuuccagaaauagaaaaguuucauccuaagauucauagggaauaucaaagagauaagcauagccaaaacaaucuugaaaaagaacaccaaaguuggaggacucacacauccugacuuuaaaacuuacagcaaagcuacaguaaucaagacuguguaguacuggcauaaagaugagcccagaaacaaacccucacauagguggucaaacgaguuuugacaagguuuccuagaccauucaauggggaaaacacagucuuuucaacaaaugguguugggaaaacuggguacucacaugcaaaagaaugaagcgggaccuggccgggcgcgguggcucacgccuggaaucccagcacuuugggaggcugagacgggcggaucacaaggucaggagaucgagaccauccugaccaacauggugaaaccccgucuguauuaaaaauacaaaauuagcuggguguguuggcacacaccuguaguaccagccacucgggaggcugaggcaggagaaucgcuugaacccaggaggcggagauugcagugagccaagaucgcgccacugcacaccagccuugugacagagcgagacucugucucaaaaauaaaaauaaaaauaaagaaugaagugggacccuuaccuucauaacacauacaaagauuagcucaaaauggaucaaacaccuaaaccuaagaguaaaacuauaauguuugaggagaaaacauaggagaaagauuucaugacauuggauuugacagugauuucuuggcuaugauaccaaaagcucaggcgacaaaaauaaaaauagauagauuggacuacauaaaaauuuaaaacaucucugcauuaaagggcccagucaacaagaaaaggcaggccacagaaugggaggagauauuugaaaaaucauauaacugauaaggaguuaauauccagaauaucuaaagaacuccuacaacugagcaaaacagcuugauuuuuuaaaugugugaaauacuuaaauagacguuucuccaaagaauauaauaucugcaaaugaccaauaaaugcaugaaaagauccucaacaucucugucauuaggaaaaugaaaaucaaaauuacagugagauacuucacacccacuaggauggcuacuauuuaaaaaaaaaaaaaaaaaaaaaaaggagcaaaggcaggcagaucacuugagcucaagaguuugagaccagcccggacaacguggugaaacuccaucucuacuaaaaauacaaaaacuagcugguugcaugugccuguggucccagcuacucgggaggcugaggugagaggauugcuugagcccagagggucaaggcugcagugagccaagaucaugccacuacacuccagccugggugacagagcaagacccucccugucucuaacaauaaaaauagugcucgcuucagcagcacauaaacuaaaauuggaaugauacagagauuagcacagccccugcgcaaggaugacaugcaaauucgugaagcaguugcauauuuuuaauaaauggcguugggaaaacuggauauucauaugcagaauggaacuagaccucucuuucucacuauauacaaaaaucaaaucaaaguggauuaaagaaaucuaagaccuuggccgggcgcaguggcucacaucuguaaucccagcacuuugggaggccaaggcagguggaucacgaggucaggcgauugagaccauccuggcuaacacggugaaacccugucccuacuaaaaauacaaaaaaucagccgggcgugguggcgggcaccuguagucccagcaacuugggaggcugaggcagcagaaucacuugaacccgggagguggagguugcagcgagcagacaucgcaccacugcacuugcacuccagccuggacagcagagcaagacuccaucucaaaaaaaaaaaaaaaucuaagaccucagacugugacacuacuacaagaaaacaauggggaaaaucugcaggacauuggucuuggcaaaaauuccuugagcaauaccccacaagcacaggcaacuaaagcaaacagggacaaaugggaucacaucaggcuaaaaagcuucugcacagcaaaggauacaaucaauaaagugaagagacgacccacagaaugggagaaaauacuugcaaacuacucaucugacaagggauuaauaaccagaauauauaaggagcucaaacaacucuauaggaaaaaaaacuaauaauccgaucacaagaugggcaaaagauuugaguagacauuucucagaagacagacaaauggcaaacaggccuaugaaaaggugcucaacaucauugaucauuagagaaaugcaaaucaaaacuacaaugagauaccaucucauaccaguuaaaauggcuuauccaaaagacaagcaauaacuaaugcuggagaggauguggggaaaagggaacccucguacacuguuguuaggaauguaaauuaguacaaccacuauaaagaacaguuuggauguugcuuaaaaaacuaaaaauugagcuaccauauauucagcagucccacugcuggguacauaccacaaagaaagaaaaugaguauaucaaagagauaucugcacuccuauguuuguugcagcauuguugacaauagcuaagguuuggaagcaaccuaaguguccaucaacagaugaaugaauaaaaaauauauauauauacacaauagaguacuauucagccaugaaaaagaaagauccagucaucugcagcaacauggauggaacuggagaucuuuauguuaagugaaauaagccaagcacagaaagacaaacaucacauguucucacauauucaugggaucuaaaaaucaaaacaauugaacucauggacauagagaguagaagaaugguuaccagagacugggaaggguaguaguggggguuggcgggggggauggucaauggguacaaaaaaaguuagaauaaauaagacccacuugauagcacaacagggugacuauagucaacaauaacuuaauuguacauuuuaaaauaacacuaagaauguaauuggauuguuuguaacucaaaggauaaacgcuugaggggaugaauaccccauucccauucuccaugaugagcuuauuucacauuggaugccuguaucaagacaucucuugugucucuuaaauauauauaccuacuauguacccauaaaaauuaaaaauaaguuuuaaaaaauaaguguuaauguccucguggagaaauuggaacuauuguugugcacuguuuuuuguuuuuuagggucuguuuguuugagauggagucucgcccugucacccaggcuggagugcagugaugugaucuuggcucacugcagccugccucggccuccugaguagcugggccuacaggcacgcaccaccaggcccagcuaauuuuuguauuuucaguaaagaugggguuucgccauguuggccaggcuggucucaaacucuugaccucaagugaucugccugccucagccucccaaagaaagcgcugggauuacaggugugagccaccacacccggcccugugcacugucagugggaaugugaaauggugcagccacuguggaaaacaguauggcaguucuuccaaauauuacacauauaccuugaaacuguguaucgcuauuaugcaucaauuaaaaauaauagaaugggaaaaaaauaaaaauagaacugccauaugauccagcaauuucacuuguuggauauacacccaaaagaauugaaaacagaggcaugagcagauacuuguagccccauguucauggcaacauuauucacaagugacaaaagguggaagcaacccaaauguccguaaacagggaagagugaauaaacaacuucaguguaugccaauggaauaucauucagcccuuugaagguaggaaauuuuggcacuugcuacaacauggaugaaucuugcggacauuaugcugagugaaauaagccagucccaaaaggacaaacgcuguaagaucuccuuaugugaaguacccagaguagacaaguucauagagacugaaaguagagugaugguugccagcacuggaaggagggagaauggaaaguuacuguuuaauggggacagagugucaguuuugcaaggugaagaguucgguggauggaugguggugaggguugcaagacacugugaaugugcuuaaugccacagaacuguaugcugaaaacaguuaagaugguacauuuuguguugauguauauuuuagcacaauuuuuauuuuuauuuuuuuguuuuuauuuuaccuuaaguucugggauacauguguagaacgugcagguuuguugcauagguauacaugugucauggugguuugcugcaccuaucaacccgucaucuagguuuuaagcccugcaugcauuagauauuuguccaaaugcucucccacccccugucccccaccccccgacagguccuggugugugauguuccccucccuguguccauguguucucauuauucaccucccacuucucagugaaaucauuuaguguuugguuuucuguuccuguguuacuuugcugagaaugauggcuuccaguuucauccaugucccuacaaaagacaugaacucauucuuuuuuauggcugcauaguauuccaugguacauaugugccacauuuucuuuauccauucugucauugaugggcauuuggguugguuccaagucuuugcuauuguaaauaguggcacaauuuuuagacaauuguuuuuuaaucaauuauaauauuauuaacuccuuguauuuauagcauuuauauuuccuuuugcuugcuuuuggagagaacauacagaaauuugugauuuuaagaucgggcaugguggcucaugccugcaaucucagcacuuugggaggcugaggcuggaggaucacuugagcccaggaguuaaaagacuauucugggcaacauaguagagaccucaucucuacugaaaaugaaaaaaaugagcaguuguggugauucaagccugcggucccagcucugcaggaggcugaggcaggaggaucacuugggcccaggaggccgaggcugcagugagcagagaucauaccacuucccuccagccugggugacagagcaggacccugccuccaaaaaaacaaaccacagaaauuugucauuuuuaauaugagcgcuauuccugagggguuuguucagagguauuuacauguuauuuuuuugcuugagaauugauuauucacuuucccuuucuucuaaaaguuauagggauuugggggggugguuuugauugauuuuuauuuaacuguuuaagccacgucaaauuuuauucugguaugauguuaagacuuaaauugacuuuuuucugcauauaguuaaucaguugucugccccaagauugccaagcaauuaucuaauucuuccccuuccacugauuugagauauacucuuuauuauauuacauuuaugucaacauauuucucaguuuggggcuguggcuucuguuccauuaaucugccuuuuuugccccaucacacugucauuaauucauacagcuuuauaguugguaggacuugccuuucucauuaguaguguucucauucuucuuguucuuuuauuuuuugcaggugaacuuuagaauacuuuugcuaaguaccuggaaaaauagaggcccaccugaauuuuaauuggaaauacuuuaaaccuguagaucaguuuggggggaaauuaucagcauagcugcaguauuuauauuuuuauauuuccaauucagaaguacaccuuaccuuuauucaagucuucuuuucuucccucauauuauuuguuuauuuauuucuaucuuagagucuguuuuaucaaugauggccagaucagccuuggguucuuuaaagaacuacuuacaugcauaggguuucaaaagagugugggguaaaucacuaauaaaggcaagauccuuugaucugagaucauuaggaaaaauacaucaaaaagugucuucacuguuucuuugacuccuauuccguauauuauauauaaagcucuuaggagccuuucccccuuauuucuguauucccacucaucagcacaguuguaggauaggcacauuuuuucaucuuaucucguaugaaauauuaaaucauuggagggcaggucucugucuccuuaaagcccagaucuucaauaagcaucugcuccugggcuccuuccugagccccugaacgccucguuccuaauugugucugaguucaucuggcaucacucagaggaggaggaggaggaggaggcugggguguggggcagugagagucaucaacacugcuuccuaguggucguuggugaucgguggccauccccuccagacagacaacccacaggucagcagugaaggcuuagaggcaggagggcagcuaagaucuaaauuccucuuacccaacugaaagcacgugcucuuuaaaaaaaaaauuaauucugcuguucagauagcagcaaagucagagcaggugugaggccggcagccugcucagguggugcgugcccacugcccacuuguguuagaaaucacaucaucuccuggccggccauggaauccagcacugucugucagcucuggggaaagagggggaagggugggauuugguuugcuuuuaucuauuuauuuuaguugcuauugauacacacaauaaaagcuacauucuugugagggaggacuugauuagcagcccugaagggcgguagcaguucccuuacucauugaauguaucuggcgcuaaacccucagcuggaacugcgagcccuagcuguauuucagguguuucuuacucuacugugaauuauguuuaggaacuaaagggcuuuuguauccuucacaaguggggggaagagagcaggggaauugugugagaaacuauuaaaaaugaggagccaugguuuggacaaacuuccuuguuggugugaagaaaggaggaauuuuuuucaguuccaccugccgaagaggcuuuucuuauaguucguuuucauuuggaacuacuaauaacacucauuuuuguagggaaucaucucaccgcacccccucaugggauccugcaauacuccauccaauucagaaauaauguuuuucuccuuggaauagcuuuuuacauuaacuguauuugaagauagaaaauuuagaucugaauagcagcuuuuaauagccccauaaaaauaagugaaaauaucuuuaauuuuaaauuuaaacaaaauaucuaaaacuuaaaagguauuuaauaugucagcauauuugcaauacaaaaauaaacaugcuccauuucauuuuuuugcuuucuuacucccacggccaggugauauaaauauuucaauuugugucacuuucuagcuaucgaauuuauaaagcggcuuucauuuucuacguaaguuuuuaagcuuaauuuuuucagggaaaaaauagaucucaagaaaaaaaguguuugggaucauaaguuaauaacucauccuauugguaagggaaguugaauaagaguccaaacuaauggauuagaauuguguaauauuugcuuaaccauuuguuaaaaaaaaaaaacaaaaaaaaaacacuggguugccagaauccuaccuaagaugcagauauuaauuagaacuagcaagucgaaguugcacagguggguauaaaaugaauuugggaucccucacugggaaaugcuaaaguucacacagacauauacacacacuuuuuuuuuuuuuuuuuuuuuuuuuugguggcucccucgaaaucauuuguuuacagucuggccaagguuguggccuccaguauucccccuaagagaugggaucuuugccuaaaaguuacugagaaacgaaggcugcaaaaagccggaaaauaucccagcuuuuaaggcacacugacagccaaacagaacgcucuuuccguuugcaguuuuuuuagugucauuuuaaguugcagcuuccggccaaucagcgagcuucaugccugcugacaucacgaaccagccaguucccuccagcugcagagagcuucaguuugucuuuuuuuuuuuaaacuaaaauggaggcugguuucuugccuuaaggagcccauugccuuucccgcugaagucuagauguugacauguaauaaagcgggcagcaggauggugguggaugcggccaacuccaaugggccuuuccagcccgugguccuucuccauauucgagguaaguuauuguguguuucacugaaucggaaccuuccguggguaguuaauaaauggcuauugugcuucagauaagaaaagcaggaaguccuuucuagcagaauucaccccauuucgcugcagacuuaaccagaggagguugggugugucacugcaguuuggcauuuuacgaacuacuuacagaauuugaggcuugaaagaggccuugcaugcauaguucaaagcugguuuuucugcuuucugcucgcucucccaucccccuuucaaagcugugcugaugucaaaggaugugaagucacugcccagggaagguauuggguggggguaggaaggagaggcgggccugucgcgccuggccaaguuguucguacgcagaguuucuguuacauauguguggcuuaaugcugcaaagguuuugucgaggacacaucucagaauuaaagaugaauugcagucagaaaauaugcacaauugauuggaaaagaacuuccuuuaaaaggauuguuuucauucuugccguggagccugagagagaaauaugcuccacuuugaaauauugaaaucuaucgugggucaucauuuuugaaauguuagcguuuucguggaauauuaggaaauauuuugcauuuaaauaggcucuguguugccaguuggcuuuuaaaauuuuaaauggcaacaaguuuucaagguauauagagaucacuguuuuaauaauuaguuugcuucuuuuuaugcauauuuugguuucaaaacuuagccuaaaagcacaacuacucuaguaauuaauagcgguuauauugaacuacaggcaucaggguaguagccuacuuauucuugguauuuuaagauauaugaauuuuuuuuuggucauaauugggugaaauagaaaaaugauuuuaagcuucaucagaucacuuuagaauuuauaguaucagagcugugccccaacaaaacuguuucucagaaucucuuuuaaggaagggugggagcaagauuucuaggugacuaauaaucucuaugacuaaaacgccaggccagacuuuucagauccuaggguguacccaggcacaugcagacucaaucuacuggaauaaaauggguggugcuuuucucuccaaacuaucuuucaugaagguggaaaucagcauucaaugaccaaauuguaggacaggcugugaauuuauuguuuuuguagugcacccaguaaaaagcaaagguugccuacagguaacauucagguauuuuagcugcaagaaccaaaugggcaagaacaaaauguaauuguuuggauuuaaguuagauagcuuuuguuuguuuuuugggagacagggucucacucuugucacccaggcuggaguacagugguaugaucacagcucacugcagccuccaccucccgagcucaggugauucucccaccucaguuucuugaguagcugagacuucaggcacgcaccaccaugcccagcuaauuuuuuaauauuuuuuguagagaugggguuuugccauguugcccugguuggucuugaacuccugggcucaagcgauccucccaccuccgccucccaaagugcuaagauuacagguaagagccacuguaccuggccaaguuaguucuuaaaaacgaacuaguuagcaguaagauaaauuaacugcauauaaaauguaaauuuuuauacuuuuaagguauccacuuauaaauaacauaaaucuuuuugguuuguguuuucugguuuuuauuagaugccuaauauacuacucaguuuuugaauuaugaacuuauucugaaauagaaucauuucacguugugucuugaaccacauugauuuuuuuuuuaaaauuccaagaccuuauuauggccaguuuguauuuguugcuguugguugggugguugguugcuugcuguauaauuguggagggaaaaagcagugaaguguauuagccugaaagagacuugaguuuuuaagaagggauaacuuuggagaccuaagacuaacuucugacucaaacaguggggguaauuucuaacuucaaaauuugaagaacgcuugauuuacucauaaagacuuuucuggagcgagcauguuaaugugagauuuagcaaaauuugauuuauuuauugggccuuagagucuuagcuuaacauccauugagcagcuccggugugccaagugcugagcgucauuacagugauuaaguugcagccccugucccaaaggagcgaauggagagacccagcauaggagcucugccacgagagggcuaaagcaagaacacaccggcagggugcccgggagagcaggggcuggugucaggagcagaaggaaccaaggagggcugcacccugggcuacccugcucacucggauggggugggcaugcgcuguccuucccguuuauuuaggaaggaggggucuuucccacugaaggagaaauaacuuacccaaggucacacagccuggaagugguggagccagaauccaaacccagacuguuguguuguuuuguuuuggaucuuuuuaaaaaaaucauuuuaaaauaggaauguuggcugcuugaagaacauuuugcuacaggauuacaguagugguauuuuccccaaugccuuaccauuuauuuggcucgguagccucuuuuuguauaacaguuuuguaccuugggcucauuuauuaaucauuuuacaaauauuuauugauccauaccacaugccaggcaggguucuaauguggauaugagcaggggcuauggcccagcuuucccaguuuaccauccaucaggguggggaccaaguaaguaaguaaggaaaaugaucaccugauuuguugucacgaucgcuuugaccauuauugucuaccaaguagucuggacuuugcgauuaaaauggugaauuugcacauccuaauaaguuugagugugaaagggacauauuuuugagaguuaguguaagcccuucugucuguagaaggagagucaccuggaacuugauggcugugaauguagcuuggugacauaaauccucacucucagcuguguccaggagaacugucugcugugguggaaauguucugugcuguccucugcagcagccccuggucaccugcgacugcugagcacuuaacauauacagcugagaaagugaauuuuuaacuguaguuauuguaaauuuaaguggacacaccugucuuguggcuaggauauuggacagcacagucguagacuggaauuguucgacuuuuuuggaaaaggaccagauuguaaguagcuuuggcuuugugggugaaagcagccauagacaguaaaugaauaggcauaacugugguccaauaaagcuuuauugacaaacaggugacaggcuggauuuggcccauggaccauaguucaccaacucuguucuagacuguucuuugacuuucggaauugccuguuaaggauaggaaagcauguuuccugcaggccuucagucuagugccuccucccugugcugggaagcugggccagccgugaugcugugaggcguggugggugggcccacuucccacccugcagcgcaugcucacuucaggagccagguuuaaggcagugacagccaagccggaaagaugguaauggccagagaggaagcacacaguuugagccuuuuccagcuggcccuuauucugggcuucaagaauguuauuaacugcucucaucuuguucuagucauuagcaaacuuauccaguggaugagucuguccuugaaagacucaggaguagcuccagccuggugggauguuggagaacaaaccauucuuuugauguaaacccauuuuuucuugggaaguggaagucuaauggaaaaguuuauuuucucacaaguacuuccugagucaccaauuuguugaaggucuucaccuuuccaauaaaaacucauuaaaaaacaugcaagaagcaagcacagaacucaaacccauggcuuucauuuccugcugcgcuaaaucuggugacuuaaccuauauuaauaauaacaauagcuauacauaaugcacauggguugcuaaauuaguaacacaccugcauggugugaagucaguaaguacuagugagaaugggugcccccuguuaucuuuauucccuaaaauuaggaaggaaaaauguuugaaugaugacuaaacaguucuucaaauaauuaaaccagugauccucugaacagugccucagcucaagauuuuuacuucacaaacaucucuuuacuauguaacugcagcucucugcaaagugacuuuauagaacuacagccuuaaccuuacccauauccuauccuguauccaauccuguauccuaggugugaaguuguuucuuucguauuccuggugguguggaagguaaccaaaguaacagauaacucucugaggaaacagggguggguauguuuguguaaagucuguacaccuuuuuguuccuuaaacacacacacauuuaugcucauaaacacacucucauccaccucccucauccauacgcucucaaucucagaggcaaaaacaaaagcuuaccauccagcuugggucuaaugucugcucaggagguuuugccuugcagcaaaagcuaucuucuaaaauuuucucauuaaaguauguuguguagaggaaugaaagaaaaauagagguaagguuauuagucaagaauaggguguguguuuuuaaacccaggaaaagaauagacagaaacacaaagacaaagugguuugggauacauccuaacuuuugguuccauaugucaaauaaaauugcgaggugguucuuuuuggauccuacagcacuuugccaauugugacaagcuguugugaacacucauguacuucuuccucacagcacuccugccuggcaggugagcaggacaauccuaguauuucuccuccccaaggucacccagccuagaggguccaguccagggcuguuggcagcaccaaguacgaggucccgaagcugcugcugguggcugucccagaggagaagcagcauacguugagugccuucagugugcuaggucacagcugaaacccuguaccucuguucucucucugaaucugcccaacacugugaggcauuauaacccucccccacucacuaccgccccugccuuuuuuguccccccgggagaaaaaagggagccucuugcccagggccacagagaauguagugaaacaagauuugagccucagucagucugauagcaaagcucauguucuuugcucugcagacaucagaguguugagagaugcuggugaaagcucccaccucauagguacuuuuugauuuuuacuguuuucuguacagugguaauggauuugagugucuggaguucaaaacucauuucaggguugaauaggaguuuguuaaagguuuacaugcguauguucuuggugugcagggagaaaguugauaaucuuaccugcugucccaguucacuuaccaaaucugccagcuaguaacuguugacuuaccuccuccacaaaaucaggaguaucccgaggacaguccuguugaacuuguucucuggugacacugagcauuauuccuagaguagaggcaucaguuagugucaguggauuaaaaauuaaaaguuaucucugagugaucacucaggaaauagcuaucuacuauauuucuuuuuugaguuggagucucgcuuugucacccaggcuggggugcaguggcgugaucucggcucacugcaaccucugccucccagguucaagcgauucuccugcgucagccucccgaguagcugggauuacaggugcaugccaccacgcccggcuauuuuuuguauuuuuaguauagacaggguuucaccgugauggccaggcugcucucgaacuccugaccucaagugauccgcccgccuuggccucccaaaguacugggauuguaggcaugagccaccacacccggccuaucugauguauuucuuagcuaaauaccucaucaguggaaugagaagcucaugagaagcuguacuuuauuuuucuuucaauccucuauacgcuguaguuaacguauuucaaugaaaaacauauaggagauggcuuuugcugcaaggcaaaaaccugcugagcagacguuauacccaagugcaagaguaagacuaccaaaaaggugacagacuuuacacaaggcggcugguugaaagagcgacacaggugcccacuccacucuaggccuugcucaggcgcuguuuccgcucccugucacacuggaaauaggaccgccaaguggucuaaacgugggauaaaucauuucucucacucacaucuuggaaagacgcuggcuaaaaugcaugggggaaaccaguacucccacagcagguagaagucuggcuuuauuugaggcccuugaauuacacauaaaucaaaaacucuucuaguuuaaaaaagaaaaaagacuaaagagauauaacagguaccgugagugaaucuagaucagauccuuguucuaaaaagugugaaaucaaaccuauuagagacauuuugaaggcagcuggagaaaguggagugcagaaugauguuggauguguggaauuacugcgaacuuucuagguguaaaaagguguccaacuuuuguaagggacuuuucuuauucuuagggaaugcagaaugaaguauuaauaagugaaggaucgugaucucugcaacuuuaaaugguaaagagaaaaguggguaaaaagcaaauaugucaaagcaugaacaguuguugaaucuagcugaggggauauacaauauacaauuauucauugaaauucuauggagauuuuaacuuuuucauaauguuugagagaaauaaauauauauauuuauuuauauauauauuauauauauauuauauaaauauauauauaauauauauauuuauauaauauauauaauauaaaaauauuauauauguauauauauuuuuuuuuuuugagauggagucuugcucuguugccaggcuggagugcaguggagcaaucucagcucacugcagccuccgccuccuggguucaagcaauuccacugccucagccucucaaguagcugggacuacaggcacccaccgccacaaccagcuaauauuuuguauuuuaauagagauaggguuucaccauguugaccaggauugucucgaucuccugaccucguguuccacccgccucggccucccaaagugcugggauuacaggcgugagccacugccccaggaugagaaauauauuuuuaaaaaauaaggcuguuucgcucucuuaucauuucaauauucucuggugaaggaaauaucuuuaaaaagggucugcuuuggaaaaaauguacaaagaaaauguaauaacuuagcuacuguuuccuaagccaugagcaguggccuuucauauuugagucuuugccagccaguguugguccucugguuguaacucacaguagcugcacagacggccacaccaucugacaaaacagcguuuuuggggugcauaaccguuuuugauguuuauuggcauuuuuauuggucuuuuggaguguaacugccuuugagccacacuagaagauaagauaaaaccaaaguuuccuccgcacuuuaagaggcaggguguuugguggcugaggguaggaccuggagccacacgccagggucagaucaccccccaucccccaccccgcccaccccaggcaagcugaacugucuagggcaugugacucacucucuguuucuagaaauggaacgugaaaugggaauaauaauacaaccuaccucuuugggguuuuuugaaaguuaagugaaugcacauaaagaacuuaaaauggcgccuggagugucgugagacucagugcucauggugucugugguugucucuuucguaggucacguaugguacucuagggccccgccacuuagccauaaucuguuuucuuuuucuccagcuguauuaucuguauuuguucaucucaaagcucaucugucucucucucucucuuuuacccagccuuuucaucucuugcaguuugcuuggcauuucaccauuuggaagaaauuaguaucaucaguaccucuggaguuugcacuaugcucugcuuauagauuguguauaguuaccugcuaagaugguccuaagcacauguccacggccucaguucagaguauacuuaaugcucccuauucagucuuucuguucccgugcuccaguccgugaagucuagaguaaaauaagaaauuggcauuuauauacaucuccccuccucaucuuuaacucuuuugaagaagagaguuuuaguaucacauucauaagaaauuucaucuuuaaaaguugguauuacaggcgcagugccucacaccuguaauaccagcacuuugggaggccaaggugggcagaucaccugaggucaggaguucaagaccagccuggccaacauggugaaaccccaucucuacuaaaaauacaaaaauuagccagcgugguggcgggugccuguaaucccagcuacuagggagguugaggcaggagaaucacuuaaaccuggagacggagguugcagugagccgagaucacgccacugcacaccagccugggcagcagagugagacucugucucaaaaaaaaaaaaaaaagugagcaauaucugugguuaaucucaaauaggguggcuuuccgugucauuucccuuuaguuguuuuuaaaugcagauguugcuuuaauuaaauaauauuugaaauaaguggggucccaacuauaaccuuauaucuuauuguuuuuaaauguugauauuuugguguuuucaguagaauuugagcuguuaacagugauuagguuuuuucaguuugucaucgauguaugugaccucguuauaauacacauggauuuuugucugcugguuguguuacucaugagcaauguguucuaauuaugguauuuuaacuuauaacuuaugaaaaaguuauguuucacucuagggaacaaguccugaagaacccucaagcccuaaaguaccaccuccacuucuuccugaguugcugguucuuauuuuuggugggcuucaaggaagagguggguggugagggugucuguauauguguguuuacauuuguagacaguuucuguacauguauaauuaggaauggguugucgguuuugguuuuuuucccagcuuuauguaauuggucagacuucucaaagggggguagcacuugauaaucgcucucuuggaacucugaagccuuugcauggagcaguguucacccugggcagccuguggccccuggggucacagagcugcuuuccaggggguuugcaaggccgucacugccucauaagauuaccaagaucuaauuuaccucucacuguguggacguuugcccugguggugcaaaggcaauggugaggaauauggcgccuuucuuucaucgagcaggacagcgguguucagcuagcaacacaccagucugacccaagaauguccucgauaaagcaugaaguuacugguuuuuuaagucucaacucuuuuguauaccuuuuuaauuuuguuuuuguuuggguuuguuuuuaguuuuguuuuuguuuggguuuguuuuuaguuuuguuuuuguuuggguuuguuuuuguuugguuuuuugguugcucaggcuggagugcaauggcgcaaucacagcucacugcagccucaaccuccccagcucgagcauuccgcccaccgcagcauccuguguagcugggacuacaggcaagcaccaccacacccagcgugguuuuuuguuguuguuguuuugguagagcuggggucucacuggguugcucaggcuggucucaaaccccugggcucaaaugauccuccugcuuuggccucccagagugcugggauuagaggcgugagccaccgcacccagccuccuuuuuaauuuugcgugacgaaaugcagaguucacaugaagccguucuagcaugcuggagugugauggccgucucgaagaaaagcgcccaugugaugugugaguuaugagccaaaauagccacuuuuuccaggaacuuuaaauuaugagaauaguaauguaaaaucauuuuuacuugacagaacaaaaagcagacaaacuguggauauuaagacuuaaauauuuggcugauauuuucuagaaaaucuaugaagugagcuuaucaauugaggggaaaacaacugcgacacuguuuuuggcccaugguaaaauuugagcuuucaagaaaaauuugaacuuuggagaacuuuuaucugccaguguaaauguggcagcucccagugccacagacucuucugcugagagggguggugacauuagcaagugggguuucuugauguauacgguggaaggucacacaccacaugcagcaguguguucucagugaccaacgaacgaugcuacaaacaagcgugggugaagagccaccaaaguguaagacacacugccggguguucauguaacugacagguucaucaacaugguuucagauuccucauugcaacuaaucuuuaaggaacuaucacuuguugaauuuuagcauaggcaaagaagaacaucggcaauuuuuugagaagcauugaaaccucccuuuucccaccagacgugucugucugagccugggguguuucuuuacauauacuugaaccagaauagcauaucacagcaaguugaacacagaagcaugucggcagauccgccugucuucuguugaguauugaagaaacaugcaaaaauguacaacauggccauuuucucgcugguuucuuuuugaaaauaagguuauuuucauaaaauauuacuuaacaugaagugaaccuauugcuaauuuaaugaauaaguaaauauuuuuaaaauuuucaaguauggucaguaucaauggauauaacccccauaaucaaagcucuuuaggguucuccauacuuucuaagaauguaaauaggucuugacaccaaaaaaauggaaaacacguggacuuggaaguuuuucucgaaugggcuggaugugacccugacccuguuuuuaccaagccuccuugguuuuuucccucuuuucucuaaaaaaaaaaauaaaauaaaaauaaaaauaaaaaaaaauuaaguagucaguggaaucaucuaaacuggucucugggaccaugagagcugagagcauccggagcccaccuaacccugagccuuccucuugccuuggucaguuuccuucuuuguuuuucaaaucuuuuuuuaaaagccauuuucaaguaaucaauuaauaugugaauacggccccauuuacauuuuuucuucauugcaaauaaaacugaaauuuucccuaaccuuauccccugagauuggucuaccauccccacaucucaaagugacugcugccuggaguuugcugugugucauuccagaccauuuucucccugugggggguggguggguggguguguguguguguguguguguguguguguguauuuauccacauaaauaauauaaauauguauuuauucacagaguauauagcauuuuuuguuucauuucuuuaaaaaauugacaugagagcaguuuuaguaacaaaaaccuuuuauacguuuuuaggaucuugguggcgcucucgguucauaaugcucugaguugguguuacgucauauuauccuguauuguacuguguauacauacguuacguaaaugcuuaauguggucucgcauguuuuucugugaauuuggcuuaaacuuucagacuaggcaucuaggagguggcggcaaguggaagguggagcugucacagacacucggcccccgcagccugugcauaggugcucuaggcuaauuuuacaggugugaugaccgggccagagugaaaccauguugucugauuuuagaacagaggucacuuaugcuucaccaagcugcuggaaauguggaauuuuguuucucaauuauuggaccugguccugaggagauguuucccuuuagagaacaucauugacgcuuuuaagaguauuuuacuagauguugaaaacguugaggucuuauuaauguagugaccccaccaccaccacccccugccccccccccacacacacacaucccuugcuaaauuauuacaucaaaucauacaggaaucuggcgcuaucagagccaggguuaaggccuaauagugucacuaguuacugagcuucuugauuaagucaccuuacuuuccugaaucuccaaauaaguuacauuaaaaaugcaucugauuaaauuacuuauuuuagagggaauuggaagaauucugugauuggcguuccgaucuaaucccccaaagagaaaaacacgaacgagaaugaacacauuucuccuuuuauauuauucuuaguuaagagaaaugcucugccaggagaaaacuuaaaugacuauccaauggguaggguuuuuuaaaagaaucuaaccaauucagauacuuuuucuuuuuacacagucacaaaugauguuauguugauguguuuuuaugacuuacucuuaaacaacauuuaaauuuaagccaaaguuaaaguugugauuuugggaaauuuuuuuacuuauccuuccucucuucccgacuuccuucccuuaagaaccccauucuuauuuucucauuuauauccuggcugaggcuaucagguauugaaacuggccuuuugaagacauauaaacuucuggggacugacuuuucucauucaaauagucuaauaucaguggauaugaauucugcauuuuuuuacuucuaaaucuuaugcgucauuuaaauguuaacuuucaaaauauuaaucuugaauuuucacauuuuugugugaguuggaauuauuauccaauuaaaugaacauaaauuauacugccuacauagauuggaaaaauaucuuuuggugggccguguguguauaugcacccauguguuuauguaaaaccaaacaucaacuuacaaaaaccaguucagucuuauagccuuguauaguguaacauacgggcugagacauuugcuuauuugagccuuuucacccuuuauuuguaaaaaggaggagagccuuuaagugaaauguaaacuaaacuuggaaccccuaaaacgauuuugaacacuacuugacauuuaaauguuuauuaaaaauaaagcaaaguuuaagaagcauguuugguaaagaguucuuuggcaggaaauggggaccuaucagccaagcuaauagccuuagcuauggcauccauaguaacuaagacacgcugccgauguaaauauuuaugccagcaagcagugcugcagaacccgggccgagcaguucagagcagugaaauuaaagcaucagccgccaauguuugauuuauuuuguauuauccgguauuccaagcauuaccaucauucaucucuucuaggguuuuucaaaauaguuuagcccuaagaacaagaauccuagaagaccaguuuacucggaguaauucgguacccucucccccacagcaugauagauacccaaaugagaauagagaggcuguuauuguuugucauuagcacccuggaaccuuuuucaucuucaaagcuccucgcaaaaggguucauuaaccgucgcccucuuuccugugagagaguaaacaaguaugauuaguccuacuuugacagcgguggaaacugaagcagagagguucuccaacuugucugagguccaagaaggagcuggugacagagaccagauaccggaccagcacuuggguuuucugacucacgguucugggcucaccccucucugagcaugcacugagccugcucuugcagguuucuuuaucacagggaucuaucuacacgguacuuucugcucucagcuuuuuacagugguguagagugcagugcagcugaaaccagguuaguugaucuuauggugucaucuagaaaaacaagagaugcagauucugggucacgaagguaagguuguacuuuuaggguuugugguuauggaugaaauuaacuuaucugagccuuacauugucucacuaggcacagugcccacuuguuccguggcacagccccagagcuccuguugaaggaacagacuccaggacugacuuuccacuugauuuucggagcucgcacaucccgagagauucauguucaagcugcauuuuagacauagcuggcaagaguauuuucgugguaaacguaaacuuacuauugguaaagauucuuaaugaguaauucuuaggauuuaguacaaaauuagauauauucuuuuuauucguaaugauauagcaugaaguucuugcgggguaggagagagagguauucaucugaaaacuggcucuguuuuaguguagacauuugucuacggggaaacaguaggaaagcaucaagaaauauuucuugauguguacaauugaagugauguuuacaauguagugaaaaaaaaaccuaugcacgcauguuccugauuuuaauaaagcucugcaaagauuuccuuccucauucuuugcuuuugauucagcauaugugcuguugcuaaguuaaguguugguaacccuguguccuuuguugggccaaacaagguuaaaauuaagacgaaaaaaauuucugaguucauuucaaauggaaggacaacaugauaccuaacacagaagagaacaaauuuaguuuugacuuucugcccuauguccaccuaaagcuguauuucacucacucacuaauauuuagaaaucacccacuuggugguuggcucugugcuuagugcuaagaacuggucguguuauaggugcugugggugcgugucugcgcuggcuucaggaggagggagcaggcccuguggggcccagcaaggccucccaggagaagcaguguguuagcugaaguuuaaugaacuaauuggugguccugggaugcaguugggaagaugggaugauucagccuguugggguauguguugggggugguuguugcacuguggugagaaaauuccuggaaaaggguguaugucaaaaggguguaaguagcaucccuuuaugacugaugaaaggagagcagccgagagcaguuaaguggaaggcaagacgcagcaguggcuucucacgccaucuucgucacuacacaaggggaaguugggcuaagaauaaauuuguuuugguuccaggaugaaacucaagagauacagaagaaacugaaagugauacuuuuggcagagggauaggauaagaggguuuucagcguguguguguguguguguguguguguguguguguguguugaugaauuuauuacuuauuaaaaaaauguaaagaaggcauagcauuaaaagugggagacauauacugauaauggaauccgggcauugcuaucuuucugugucuuagaaguuacugcuaugauuuuagccacuuaacuggcuagaacaguuuugaaaggccaagaucauggguuuaagauuugagacuuggccaaaagguagcuuuccuaguccuuaucguagagugcacgcucccagcuuuugcccagccuauuuggggugcacacgcucaucgaugagggcaacagaacacagcaugcaggcggaacugugcaggucagucaccacuccaccuccuagccagggugucacuccaauuccaucauucagguuucacugaacuuucauguuggcauuucauuuaguugaaugaaccaguuuuguuguauuucagauauucucacuguguaguuagccuguucaguuuuuguaggugaaugguaaagcugucaaaaccagaucugcugaaaaccaaaauguucagugucaucuucagcagaggggauuaucagaaacuucuggggcaguaagggaaauuuaagaaggaaguuggggaagguaggaccucauggcuuugguuuuucuggugguccaagagaggaggccucuagagaauugagggggaacaauaagugacaagcaugaagaaugaagagggaacugaccaaggaucggugagaauaggagguggcccagagggcauggucagauguggcuaucacagcugucacagcaaagucuuuauguacuccgagaaccaagccuuuaucauauauauguuuugcagauauuuuucucauacuguggguugucuuuuucacugucuugaugguaucauuugcagcacacguuuuuaauuuagaggaagaccaguuuaucuugauuuguuuucugucuccuaugcuuauggugucauagcuaugaaaccauuguugaauccagacuuacucuuacacauucuucuaagaguuuuuuaauaugaauucucuuacauuuggucuuuguuccauuucauguuaguuuuuauauagggugugagguaaggguccaacuuccuuuauuugcaugugaauauccaguuuucccagaaccauuuguugaaaaaacaauuauuucccucauugaauggauuuggcacacuuguugaaagucaauggaccauaaaaggguuuauuucuggauucucuauuccauuggucuguaugucuguccuuaugucuguaccacacugucuugauuacuguagcucuguuguaagcuuuaaaaucaggaagugugaacucuccuacuuuguucuuuuuuucaaaauuguuuugguauuuugggucccuuuugguauauuggguccauuuuauucaaugauguaaugauauguguguuuccauaugaauuuuaggaucagcuuagcaauguuccuugucucuuucuucuaauucuguagccuuuccuggguuagaaucaguuagacuaggacuaggacagugcucccuggaaucugcccaguagcugcucugacugugagcagagaaccugugggcaucugggcacuuagucugaaaugguccauaaggaaccccuaaaauguuuaaguuucugaaaucccugguuguauuguaaaaagcuauuugaauuuaguauucuguuucaugauuauuauacuuaaguguaaaaauguuuaacuuuuuuuuuuuuuuuuuuuuuuuugagacggagucuugcucugucgcccaggcuggagugcaguggggugaucucggcucacugcagccucugccucccagguucaagcgauucuugugucucagccucccgaguaucuaggauuacaggugugugccaccacacccugcuaauuuuuguauuuuuaguagacacagaguuccgccaucuuggccaggcuggucucaaacuccugaccugaagugaucugcccgccuugaccucccaaagugcugggauuacaggcuugagccacuacacccagccuuguuuaacauuuuucagcugcauggaaaacugauauucuaggauguauauugcauuuaucauuuauccuguggcuuuaugcacccuccagaaugcauaccccagcauaaaaggccaaguuagggagaaaccugccugcuggaguucuuagauuuauaaaucuuguuuccuuaacugucugcccucugaccucuccagaccacagccagcagaggagaacuaaugggcagagacaacacugaucugcugccaucugcacugggcaagauggccucaccugacucacagcuguugcuuucucucgcgaagcuucuaccauuuucugcugauucuuaaaauagauuuggaucuugucaauuuuggucgucaaaaagauugaacuuuuacaggaugaaauccauuauuuuccuaaauuaucucguuuugggaaaucaguucucggccauaagugcaggcucaggugugcuaaggagggcaccccagacaccugugcugcucuuugacaggacuuaccugucaaaggcgaaaauaagggugaugucaugugaguuuuccauuaagcuaaauuuauuccauguacaggacuaucuuuuauucugaaauugucuucuuguucccuauaaccucauauuggaagugagauacugucuuuuuggguauuaaaaugucuuuuuuguaggaucuuuuuuuuacugaucuuauuuguauguuaggaugauagcccagugucaguccucaggauucuuuaugaaauguuccuagucugugaaauucuaacucuacaauuucaguuuagaccacaaaucccagauuuuuaccuuguuuacauuuguaguuaccacauaauauugcaaaugauuuauguaaccucaaagcccauuuuuuuauucuuuucauguaaaauguccagaauaggcaaauccauagagacagaaagcagauuagagguugccaggggcugcggggagggaggaagggggaguaguuacuuacagggauggggaguucuucuaggaucaugaaaaagguuugaaacucgacagagggcugauugcacaacauuguaaaugcacuaaaugccccugaaguguacuugaagugguucauuguauguuauaugaauuuuccauuuuuuugaaaagcccauuuuauucagugauauaaugauauauaagaagaccugaagguguagggggagugucguauucagaggauauacaucaaggcaaggauacucuguaugcuuguacacacacacaaauacauauacacaaagaacauaccuauuauuaauuucuguuucuaaguaugaucauuagaagcugauuagguaaauaaacuuucugcuuugggacaagcagaaagauuuaauuaacacuuaacugaaauucacagauacucuuuuuuuuuuuuuuuuuuuuagacagugucucacucugccucccaggcuggaguacagugacacgaucucggcucacugcaaccuccgccuccuggguucaagcaauucucuuaccucagccucccgagcaacugagacuacaggcgugugcuaccaugccugguuaauuuuuuguauuuuuaauagagacgggguuucauuaugcuggccaggcuguucucaaauuccuggccucaagugauccacccgccucggcuucucaaagugcugagaguacaggcgcaagccaccgugcccagccucaaaagauauucuuuuucuuaccucaaaaacuauguuuuccaacuuuucacaguggaaaguugaagucgugaaaauauccucaggauaaaucugaaucguguuucuuuuauugcugagucugguuggcguguuccugguauuuaguggaacucuggucaacacaggcugaaguuagugggguucucucugugggguucuaaccuugaaauaggagcauggggcuugccuuccccuucuccauuccuccaagaaagagaaaggaaaggaagagaaaagaaaaagcauccuguauuauguguaaguuuguaagaauccuuacuaugaguucugaguacaacaucuuuuuaacucuuuucucucccucuccugcuuccuucuucaaucuccagcuaccauucauuuccugauuucauuuauaggucuuaccaggcaagaaggccaagcagaaggaaccuacaucagggaagugcugggcuacgggccccaccuggacuugggguucugggcagccugaacacagguuucuuaguuuccugaaguaauugagcuuguugccuuaacuucaguuaaaacacugaucgugcuuuacuuuuaacugagcauugagaccucuuauaauauuccauaaggcuggauauuguuuugaggaagacgauuuuuccucuuaaccuugccucuguguuuguguguguguuuggucgguguuuagacaguuuuccaugcauggacccugauuacagcgggagcaggcaacgugaggugcccgcaaucagacauccagcuccacaugguggccucccugcccccagcucauccuuacgcagugccuucaaauugagugucuucaaaggugcugcuuagucucacuuugguuguugugucgcugucguauuuuucuuuuuucgcaguauugaaauguucacuccuagggaccgaacacugguuuuaguguccauaguggcaaaaaaaaaaauuuuuuuucaaaacuuguuucuauuugguccucugugacccaaguuguugcuuagcuuuccugccuaguaagagccagaaacgagauuaggacgugaaugguauuuucugaacccucagaguguguacaauaccauuuuguaaagaaaagcaucuauauucaagguagaucuaaauaauuccuagaaaugccaaauuguucucccauucauuuuucaagacaaauauguucuaauccauaggagagugagaauuuccaaguucauuaauucggguuccuguuaccaacucauguuuuacagcccauaugaaguuuuguuucacugaaaccuuugauuaucacaaguagaacuugggaacucuacacugcugucuccagacaagacacagaguuucacuuacauuaacaaaggaugauccauucagaacuguaaacaaaugcuacauugugcccuuggugguugugacccgauucaguccugcuuugaggcugaggacagccaaguguuggcccaaaucagcauaaaucagagcaacagaaaauccacccgagguggggcccuggauuggacgugcuuuggacagcagguccacagccugcaccugaaugaauccugaggcgggcuucugacucugcucuaaacacucauccugaaguguaucuggaucauuuuaaguaccacucuagcagugguacuuaguuacaauuaauauaaacaugucauuccauuaaaagaaaccugcagcuucuguuaaguugggucaaauauaagauacugggguuuaaagauguaaauagaaaauucaguuucauccagcaaggaauacagagaagcagcaauagagccugccagcccucggggagcuugcagucuaagagaacacaaauauguauaauuuaaaguaaaauggaagugucacuaagcgggugagaggaugcaaagauugccuucaguuagagugauaaguaaguuaccgucacggcagcauuugcagguauuggagcuuuauuguaaguuucuucauucagcaaauacuuccgagcacuuuugugucugauccuguuauagcugguggaaaauuauagacuaacaacccaugugcaaaugacaacaucguguggcaugugcagggcuggcagcuacauggggacauuaacagagcccagcagaagggcaccucacuccacaccuggggagaaaagaggugugcugaguuuuguuuauuuuuuuauuugcacuuguuuuaccauaaaugaaauaugacccuucuuaauauguuaucugugauauguuggcauggauaucuuaauguauaaaacaugcuuauauuuauauaugacauuauguuuauuuuuggcuacauccagaaaagaauuugauaaggcuuaaacuauuaaaacaugugcaacaggcuauuaaaggaaacaaaauaacuagaagccaguuaggaggacuaguucagcuuuugaauggagcuauucaacaguuucagaaauuuuuuuuacgcuacuaaugggccagugggcauagcaucuuuuuaagcuuccuuccaguuugugguacuaaaaccauugcagaugcauaaaggaagaugcuuaucauccugucugaguuguaagaugggacacaacuccuuaucauaguacauuccuuaaauaaguacaagaauuacaguugacccuugaacgucacaaguuugaacugcacagguccacuuauauguggauuuuuuucaaccaaaugcagauugcaaaugcacaagauucgagaccuauguauacagagggccaacuuuucauacgcacggguucugcgggccgacugugggacuugaauaugcguggauuuggguaagcguggugguccuagaagcaauccccaacauggaccacuguagucuguuacuuacauuggcuuuaaaguugaguuuaacuuguccaaagacauuguuauuuaagcagcaauauuaugauacagcuuugaaggcaaaacuuaaaaaagaacccauggauagccuuggaaccauggaaagauucuaacccugagcuucuaaauaguauugcauuuguagaaccaaagacuagcaggggaucagcaaaggcugagagcaaguggucuguauguccucauaaugaaaaggagcagaacagaacaacagagguaaagugauuuucuugcuccucauucagguaaucauuggagauuuguucagcaauaauagucaacauagaaaucuacaguguaggccaaauagaggauuucuuguuaucuucuuucuucguacugugggauagauagcccaggauuccuccaaguguggcaagugcacaccacugcuaacggcaguuauuuuaagugauucagaguugaguauuauuuuacuuuaauaauuauauauugaugaaugugaaaauauauaauuagcacaucaaauccaugguuucuuggguuauuauugcuuaggacagggcuuaguaaaaaguguauccauuuaaagcaaaauaccaaguaaauaagagccugacuguacacagauuugugacgaucuugaagguguucaugcaggacugaaguacgggaaaccccagggugggcgacucuggguuccaccuggggaaucuguuccgaagacaccuucccaucucuuucuuggguuacaagcaguggagacacacuugggcuugcauagaugaagacaaguguuuuuaaggcacagucacagagggacuccacacagaggagcaggguggagcgggacuguggaggcagaaggguccagacuccagcagcgugagugaccccucuguguccucauccaccccgccacucccagucuuugcgugucaugccccuucuuccccgcgcuuuaccguguaauuucucugcaugcucuucugcauuuacucaguaacauaauacaguuagcaguugugggaccuccagcaaguauugaacuguugaguggcuguucuucauuuggaaaaugggagugauaacaguuucucucucacaggacaguuguggauagucagggagguugcagugugaacacuaggcacagcaucugaaacgugcuggaaucagucauguccacacuggcagugauuagaucugccugauucuucccauguuccgucuagugagaagucgucaguagcuucaguuuucaggaggaaaacuuugacuuggucaaaacuuuguccuugaucaaguuguuuacucucacgccaagccgcccuggagugugguccaggaaaaacaugggcgccuagguccgccccucggccagccguggccagaggucacuggugcugcuguucacauggccggugucaggguuuuaauucgagguggagcuucccagccguucugguaaugaggagucuugccugauaugucuuggccagcucugauuggucaaauguuugaagaagauaggguuaccaaagauuccuagacucuccaaguuuggcagaaguuguuagaggaucacacaguuaccuaaaaugauugguuuaauuauaugguuugaucauucuucagaaaccaccaccuuggguaaaccauuguucuuaauuuucccuucauuuuuugcucucauugucuggccccaaagacacacccccuugcgauuuuguaaaggaugcauuucauugagaggacacaguaugagggagcagcacauggaccuaaacuugacuuccaccacccccagccagaugaauugcugagucaguucacuguuccaaaacuguuuucucaaggcauuaugguaacaggccaugugaaauucccuaacaugacuagggguuuucacuucccagcuuuauucaauccaaggguuuuuuuggcauuuuuuguuuuuaagacggagucucgcucugucacccaggcuggagugcaguggcgcgaucucagcucacugcaaccucugccuccaggguucaagugauucuccugccacagccucccauguagcugggauuacaggcacccgccaccugccaccacgcucggcuaauuuuuguauuuuuguagagaugggguuucaccguguuggccaggcuggucucaaaacuccugaccucaagugauccaccugccucagccucccaaagugcugggauuacaagcgucagccaccacacccggccugaaucaguuuugacauugucucuuccucuggguggcaaaugugauccauucaagacagauuauaucccaugugaagagucacccugagaauuugagcagggugugcugugugguuacuuggacuccagacccuugucugcagaacuggugggaccuugacuggguccgguucuccugucugcacaugcaggccauggaggugcugagguugcagcagugacggcagcacugagggucagcuucagggggacccucuucaagccaaacaaaaagucuucucaaaaaauggaacuaaagauggucccuugauguggcgucucaguacggcugcugagguaucucacaaggccaccagcaaguuaaucuaaggaggcauuuuccucuugugaucaggcagcuguuccagcagaaauggcucaaggagaaauucuccucccagauucagugucuggugggugaaacuucacuggugcguugccagcccuggccuccaaaucucuuuaaauuaugaggucauagaaugcaugcuuaaagccccaggccugucaagucgcuuggggacauucauacugaggauuuauuaagauauuaauuugguuaucaggagucuggauggggaugagaggaggggaucuuuauuacaugcugggaaaaucagaaaucaacucuaauugacuaccucuacucuuuccucucccaagaugacuuugccaaaaagcugugagaaaaaguccucaaaucucagagauugacuugguacuugauuauauccagcucgcuggugggccuguggccacagagccucagaagaagguuagaaggucuggccagacuuuagcuuugcuccaccuacuuggcagggucaagccuacuugccaguggcuuggagaaguguuuuguuuuguuuuguuuacuuuuuaggaguguauucaaagcacauucacaguaaggaaaaaaaaaaugcagccugugucuucagggacugggagucucugauuccagcacagccgacuguccagcaaccccagaauugguaggcuggacacugggcugcuccucauggcggugggagcaugggcugcucagcuggggccauccaaggaagcaaagauguggugcuguccuguggcugggggagcaggaugaauugggauaagggaagcccagggcaggguguuggcacagagcugggaggugcauuacaccgaggaacugacguggccuaaacuccacagugacuuccaccugggaucacaguuuacagucagcugagugcucaagagaacucaguagaggggaauguugaugauucagguauuugguuggugaucauguuaucaagucagacuugcaguuaagguagugucccagacguuuguucagagggcuccuucccacuugucaucuguaauacuggcuaaugggaaaccuggcccaugucaaauuuguauuaggaaccauugauuucaauucacgggcuuuuuccauugaggaauuuaaaggucuuagaaguaauauucuuguuaaggcaucugaggucucccgggggacagacacagucuucaucuugagcaggaacggugagaccacucuucucccuguaagggaccaguagcaugugugggaccacgccgccugcacagccguccccucacggggugccucuugcccuugcagaucaccaggugcuccgagcugcccugccugggcucaggcaucagcacggucccaucugagcgucgccuuaaccucucuguagaccucuguccuugucuaucuaauggggaugaugguagccccucuguguguucuuacuaggauuagugggcugggaaaaguuacaguaauauauuaccagcauguagaaaauacccaauaaugaugaacuauuaguauuccuuaaaagaauuaaaagugaaaauaguaggaaacacuaguaagauaaaauacaaugggaaauuaaauuuuuuuaauuacuuaaggaaauuccucaauccacaagcaacaauaaauaagaaacugagauuuccuagcagcugaaagguuuuuuuuuuugcaguugaggcugugaagcugggcaggguuucagcugagcugagguuggaagucccugaccuucagcuguggccgccuacggagcagcagggagagcaaacccauggagaaccccgcggcccccaaagcauggacggagcugccagccuucuccccugcccuucuuccucuacucccgaccugccagccuucuccccugcccuucugccucuacucccgaccugccaaccuuagccuaaaaucagagcugcuagaaucacacacacugucguagcugguuuuguauuguaaaugagucauucuguuauuuuggaaacuuaugucucaugccaggaucugcagauaguucuuuuucaaaauauuguuuagacaaaauaaauuucuuuaaauauaauaucucuacuuuaaaugccugggguguugcaugcauuuuucuaggcuagcaaagcuuaaagauuauuucuauaauuucaguuacauuuaccuuuauagauggguuacucuaaguaacaaauuaaacacacauggaucuucuaacuuuggcuuuaaauccuaagaagagauagguaauauauaaaagaguauuaaaaagaaauggagaguaaagguauaugucgggcagaugcaguagaaaagcaagggucaugacgucaaugcugggcaaagcuaaauugugaagacaaaacaauaaugaaacaggguuauucaucacgcuaaagcguacaguccauaggaugauauaacuaccaugaauuuggccuaaaugauugaacauugaaacacauaaagcgagaacuguaggggauuaaagacaaaaucagugagugcagugcuggugggagaggcgccuggacuucuuggccccucacaggucaugugguagacauaaguuguuauuacugugagccaguagagacuuucagguuugauggcuggaaaacaaaugcucauuuuauaaguuuuuuuuuguuuuguguuuuguuuuguuuuguuuuugagacggaguuucacucuuguugcccaggcuggagugcaguggugcgaucucggcucaccgcaaccuccgccccuuggguucaagcgauucuccugccucagccucccaaguagcugggauuacagucaugcaccaccacgcccagcucauuuuguauuuuuuuuuaguagagaugggguuucuccaugucagucaggcuaguccucaacucccgaucucaggugauccgcccaccucagccucccaaagugcugggauuacaggcgugagccaccgugcccgacccucaugguauaaguuuuuaaacuuaauauauacuagcuuacagaggaaaccgaugugauuuccaaaaauuugaaauaauuagaaaccuuauucucacauuauaaugcaauaaaaauagaaauaaacacacaggcggaaaccaggcaucccugggagucccuuggggcagagaagagcuucgucgcucaagcaaaacuuccauggaggcgaggacugugggcuuuguuggaagcuuuaucuccaaccucuagaacacgagcacuaaguagauucugaacaaaucuuauuaaaugaauaagagcuaauaauccuaauaaauauguugaaagcacuauucuaagcauguacauuuauuaugucacucacuccucacagucccuguucgaaggaggugcuguccucauccgcauuucacagaugggggaaugggaaggguaggcucagucacuugccccagaauugacagcuggcaagugggagacugagauucaggcugggcugucggacuuggccguguucucaugugcagaaccaccauugccuccaaauuaaugaaaaaaugagauaagguaauggcuuagaguuaauguguaaagauuguuauuaaauaagaaucaaaagaagugauuuaaacacuaaagagguagcaaagaaccaaaguaaguugaagaauuacuguguucuuuaaagacaaaagcagaaaugaaucaacuaagaaaaagagagaaugaaaccaaagaacagguuuuggaagggggcagacagcgaugaagcggggagaguaaagacaaguagaccuggagccggugugguggaaaaaggagagaaaucauagcguguaagaaguaguaaucgucgaaggaaggugaaugcaagcgucuugugaaucugaaaauggcauuuuguaaaauucacuuuccauuccugauuuguaguuuguuugcuuauuuguuaacuuucuuaaauaauuucaaaagcauggaaaaguugcaagaaugauauaaagaauuuaaucaaaauuucacccauuugucaauauuuugccacauuugcugcacauuucucucauaugcucuauauguuguaacgagcaggcggucuucccagccccuccuuuaccuucagggcccuggccucacuucuugucccccucgccccaggaggcugugaaaagcaaagcacugugccucccaggcacaugaucuucucagaaaggaggagccccagggaaggaggaggcagccccuggcacacagccuauccuuugaggguuguguuguccuuucuucuugguuguauaaaucuucacuauuuuggcugggcaugguggcucaugccuguaaucccagcacucugggaggccaaggcaggcggauugcuugaugucaggaguuugagaccagccuggccaacauggugaaaccccgucucuacuaaaaauacaaaaauuagcugggugugguggugggcgccuguuaucccagcuacucaggaggcugaggcaggagaaucacuugaaccugggaggcagagguugcagugagccgagauugcaccacugaacuccagccugggcgacagagcaagacucugucucaaauuagaaaagaaaaaaaaaaaaaaagccgggugcgguggcucaugccuguaaucccagcacuugggaggcugaggcagguggaucaucugaggucagaaguucgagaccagccuagccaacauggugaaaucccauuucugcuaaaaauacaaaauuagccgggagugguggcacaugccuguaaucccagcugcucaggaggcugaggcaggagaaucacuugaacccgggaggcggacguugcaguaagccaagaucgcaccacugcacuccaaccuaggcaacggagcaagacucugucuccaaaaaaaaaaaagaacacucauuuccagagucaaguuacgugaccacagguggcacagggccugugagaacagccugcgacgacuuccugccaguccucuucuuccccaucugugccccuacuccacaggcaccuguggacacccugaccugagcuggugaggcuucaccagugcacgccuggcugcuucccugccugcccuccggcccugugaucccauguccuggaaaguguaaacucuuuacaaaauucccugucguuuuagugagguuucagaagagaguagacucagauaaauguauuccauccuccaucuguaaucauaaaguaaaacauuauuugugauguaaugcuuuuaaagaacaccaugagaacccugacuugauuuauugaaucguagcacacauguccagugaaauuucaaacaguugacaauggcauuaccuauuuguuggcaugugagacaugcuggacacggggguguggguagagaacagaggagcccaugaagccuggcucucaguggugcgcucguccgcacacacucggagaugccagcaguguucucucuggguuggccuuuccuguguuguuuggauuuuuuuuuuucuauuuuacagugagcauguauuauuuuucugaaaagaaaauucuucaaaaauaaguuauacauguuuacauaucacauuagccauugaauacuaaguuguuucauguaaagaccaguggucacuauacacagagcgaaagauuucauuuauagguuuuuauaugguccuucuuguagugcccaccuuguaccuuauuuuccuggauuaaaaaacauacauaucacauuauucuuuucucuguuccuguuuagagacccuguuguauuuucauuuuuucccccucucugggauuugcugcuggcacucaaguuccugaaagaagcauucucucauagucucaaaagagucagaaagaaccucauuuuucagguguagaaacugaggcccaaaaaggucaagcagcuggucacggcuaguuaauagcagccagcgucucuugccuuuuucguccgcuugcugcuuucugguuuuuaucuucuuacccaugugagcuuccagcaccaccugcuccccccaccaccaaaaaaaaaaaaaaaaaaaaaaaaaaagcuccacuccaccggucuuuuauaaccuaucaaacuuuaaggauauuuuuccauucaaaucuaguuaugccacagauugauaauacuaagauguuugugaacucaccaaacagauuggcccccccaugaccuaguggguacaucuguaguaauuggauuugggguucauucagccucuuucaaccaacauuuaaguaguuccuauugcacugcccuguuacaagaucaagaacagcaaagcacuauugcugugcuguuuaucagggcauaugcauaauuguguuaugcagaaccagacauugucaaauugagauuccgccuuucauuugguacaaauuuaguugcugagugcagugcauuagaggccugcuuggacaugccuggagaggaugaaaauguugcuuccguugguugcuuccauuaguugcuucuguuaccaucaggagaguaacaagauugaguuauagaugcugguaagucacuugauacaucauuaacaaaaaacaaaaacaacauuuauugaggacaugcuauauuucagggauuuuucuaagcacuguacaucucuuaauucacaucaaccccaguaaagacaauauucccauuuuccaguugagaaaacugaggcccaaagagaucguuuucugcccagggucacuaagguagucagagguggaguugggacuccagcugggcuuucugccugaguucuuaacaccuuuguuuuacugcugcuuccugucuucgaggcuuuacagauauuugcuaaaugaaggauucagaguuagaaaugaagggggcgacugugccuaguaauggccucagagugcugugccuugaguguuuuuaguuuagcuauaaaacuuggaccauagggagcaaguccuaggaaguacuguguacagaaaaguagacucuagaggacagccuguggagguuuccccaaaugccaccaccucucagaucacccaacugagcuuccacauugaaagacacggggccggcucguuccguguccagacagacacuuucacucugugccuccggagaugaggcucccugcugagcggucaguccucaccugaggagguggggcgaggaaaggggguugcccacggucacugugguguugguguucuuuuugaaacgaaaccuuccagucgcagacacaaaagccguagagaguaaggcagaggaucggccaugcuucugggaggcaggggaggggagcaccugucaaaggggacccuuugaggccaacuggggcaguggggccaggucagggagcagggcuccagggccagguggacagccaggaggcuggagucgugcagucccucacaggcugcccuaggcuuagucuggaagguggggagcgccuccuccuucagagaccacugagcucucagcuccccauggagcuucuuggcaccugauuucuagugccaccuuuugcggcuccuguggagaguccagcucacggaggccccccagagcccucguuauaccugcagguuccccccaccaaacccugcugugucaggaaaacagaaguucaguggcagcgcagacuuauggguagagaaggguccccugucuuucaacacuuacccaaacacuagaauguuacucauuuccaugaauaauaaaaauaucaaaucuuuaggugacguaucuucuccaguggaaaaaugaaccuuuuagcugguaaaccucuugaauaaccggccagccauauuacagucguguuacuuagggagugugauaugaugggcccuuugagaaagcgaucgaaagccaagguuuccgggugcagccugcccccucaaguccccacugaaacaggaggagagggcaggagcgcccgugggcucucaguggcuacguugcuuguugguuugcuuuccugccuggugagcggccacuggagcauccugaggaaaggggagugaggagcaagcugggguucggccccaaccggggugcucugcgugcacucaucaggguccccacccaggugugcuggugacaggcaugaggguacuguacuggggagcugugagucaccaccugaggggcgccugcuucuaucccagaaucauccuccaggucaugcaucuauguccagcccuucccagguguggucaguccccugagagcagcguggccguggugccugcucacaccuggcauggguagaccagccuuagcucgggagggcauggaugggagugaugugucuuuuuucuuuuuuuuuuuuuuuuacuuuauuaaaauacugaguuuuauuucgcauguauuuuuuuuaucuccccaccauuuccgugucugaucaccgcuacuacuauguccuaucauacuuacuuaaaaccauacauacuuaaaaccaagcagagaguggaguuccaucuuuaauaacuaaacaggcauuuugggcugggcacaguggcucacaccuguaaucccagcacuuugguaggccagaggggaaagauugauugagcccaggaguucaagaccaaccugggcaacacagcaagacucugucuucuacaaaaaaauaaaaagauuagccaggagugguggcaugugccugugguucuaacugcuugggaggcuggggugggaggaucgcuugagcccaggaaguugaggcuacagugagcugugaucacaccacugcacucccgccugggugacagagcaagacccuaucuaaaacaaacuggcauuugggaacaacauauucuuggcaauggaaccuggacagcauugaucaaacaugguagggaaaguucucauucugcauuauaaaaaggacugccagauaucaacuguuagagauacgaaauaagauggaacauuuuuaacuguuuauuuucuuaaagagacuuccugcccugccagagaucuugaauagcccccuagucagucauccagaagccauucacauaauugauuuucuuggcuuccacucugaaaagagaaccaccuuuugcuauacuuggcugcauguuugcuuuaaugucuucugcagaacuagguucuucugguguuuuaggaguauuuuccuauuuuuugaaggauuccugaccuuuucuugacauuggugacuuggagucuuuuccauucugguuugauuguugugcaugauuggguagaguaucucguauagauuucuucacuggagauuugucuucaguuuccuuaucaucaucaucaucaucuucagcaacagcaaauuuuacuuuuuucuguggaaccuugcugccaccuccagggggagaucgcuuuccagauauucugaagaguuucacauccuccugucucugacucugcaucuuccuccccagcuacuaagugccauccauugauacacacgggcccugaaccacacuucacccacaacgccacagguggugguauuucauagcccaagggaagcccuuggcuguacagauguuuucaaagccaucaguguuaccguaaucggacuaccuucaucauucauugccucugcuucaacaaugcacaauucauccuuugccccuacgaucauucuuaaagauagcuagugcucauuuucaucaucauccaucuuaaagugauuaucuguuuuugguguuuuuuuuguuuuuuuuuuuuuuuugaguugauggccaggugagguggaggccagaacgcaaaguagguuaauaccaauaccagguaacuaauucgaaucuuagagaguggaacgguggguauuugacaaguucgaggaggcuggcagcuugcgggaggggccggagcggucuggcacugguuucucucugucucaccuccccagagauuggacacacacgugcacacaguucugauaucgugguuucuggcacgugacaugguacccguguugcucuguggcccugaucccccggcugccccugcaaggcuggagcuccggcagcaccgcagggcccgguagguccuggcacacaggccgcaugcucauuggguugugucugucaccgacccucccugcugucauccccgggcuggacgucauuugaaggaagagccaaguuucagcaagaguucgugucuagaaggaagcacuugaaccuccucugucugagacauggagaaaggaaguagagaacauaaaaagggccuggaaaaguguguguauuuucaguguaucuuuuucacaccucuacacugcuuugucugcugguaaacauauugaagguucuggaaucaauuucaagauggaauugaaaagaacuuauuacaucuucuugucaaauguuaagagcuguuacuuuuccugagacaguaccugccuuuguucuuuggauaaaugagcuacugcauuguuggagcuucuugucaccaggugcaguaauauuguuaacauucaguauuucaccagucaugcuagugaaaguggaagaugaagcgauaacgggcugcacgaaggguguugagcauuuaguaaucagugcccugggugccuguucuccccaaggcuuucuagaacuagaguccuaugugggaaauauggccuguaucuggaaauaaugcugugcuggauuuauaucuuuaucccuaggaguuuguuugaccugucucaaccuuucccuguuuaaaaaaaaaaaaaaauugaaucuuccaauucagcuaacaccguugaauuccucuuguugccugcagccggagugaagguucauucugaaugugcauguguguccacaggagauuuuacagcugaggaaccugaggcugagaauaauuucaugacuuuaccauguucugauuuggcagagucugaaccgggagucaguuuguucuuccauaugacucccuuuacugaaaaauucacugaagagcuuuuccgaggaaagcagccucuccuggccuuugccuauuucagccugacuucucuccauccggggcgccucuccacuccacuccaccccacccuuccccacccauucccugguagaagcugccagucuucaugggcggaaagcaugaaugaacuagaauuuagcuucaaccacugccuuuugaaaugaaaaauaucugccuuauuaaauuauacuguuaauuucaugagaaagggaugaugggguuggugguagaaaguugugggggaagugaauacuaccccuuucuucauaugcaaauaaaaccaggcuaacaaaucagaaaaacccaaaggguuuaagguaggagcagcucagguuugugagggaaccccagcuugguccugggguuagcagaucuuccucuccaggaaagauaauguaaccuugguacauguguacaacaaagcuggauaaaccacagcauuggaacguuaugguggacugugagccauggguugucucuauccaaacauguaaacgagugucaguguagaaacugcagaccagccccacguuaccaaauuuauacccaaaugaaguguaccuggcgguacuguucauuuugcccgaaauccacccacacggaguggaaagaugguuucagcaucccuggugacaggaagggcugugcaccaccucuccggguuucucauggagccccgccaaacagaccuagcuacaggcagccacaugcuggaaccgggaacacuuagagugggcacauugaagccagcuugcuucaacuccuucacauugggugguacagacagacccggagggaggcggggacauuggcuacauuugaaugaaauaacauccauuuagaaaccugagcagaggcacaugugugcagggaagcuaagauaccauaucucaucacaccuaaggcacuguucauuguaguccaaaccauuuuuaaagaauuaccaaaaaaagaaaaaggaaagugaaagauguaacuugauuuuagagacauuaauaugaaaaauguauguauuagaauggauaaaauaagacacuugcacuuugaaauuaagaaggauuuauuguaaauuucagaagucaucuaccgaguuacaaacaguacgagaagauuaacccaauuuugaaguuauguaggugcuaagggucaggguagaaguuagucuugacauuuuguagauauauagaaguauuucauuguuauguuuauugagcuuucaaguuguagaagcuuggauuuauagaguaagagauccuuguuaccaaaaaugagggcuggcaggccuguaccggggaaggcagagcuugugugucggguuugccuggaagagggcugagggcuggguucaugggcuguagcuaagggccuucucuucugaaggagaacugccuaccucuggcuucuugguuucaguucacccaugucucuccugaacagagaucaaguuggaucgcucaucugcuuaaaaauccucugauucaaaucucucuucccacagaacuuuuuagauuuuucuaucaaagcaccucugacugcagagauuccacagaagagaaaugccuacuaagagcaguuucuuugaagaccugaguuuuaucuuaaaaguuuauguagauguugcauucuacucugauacagguggcguuauuuugauauaaauauauuucaaacgguaccucucaguuaaauuaccugaguuuguuuuccucagauggaucuguucauucagcagacaucuguggucccacuaugugcuggccaguuuuagaugcugaggauaaaaaugguaaaaagacaaaguucuccucugagaaaauuuauaauuaagcauccaguaugauuaauguaggguauauaaauuauuaucaauuguucucguuuugaagauacugucuuuugaggaaaauugauuuuccaggagaaugcagccugauuaauaucuccuguaacuucaggccccugugauugacaagugagugccucuagacagucuccccauuuagugcagccuucagugccuucccagcaacugcagccucuccucagcugugguuccuguucucccugagccuucauccgcaugucucccagcagaauucaucaccucccauauucugguaguuuucuuuuagaucagauacugucuuuuaauguaucuaucaucagugccuagcacagugccuggcguguauguaugggaugcguuugcgaaauacuuccuagugaugcaggcuguguccucaugguuggggcugcucuuuuuuuuuuuuuuuuuuuccugagacggagucucuaucgcgaggcuggagugugguggcgugaucucagcucacugcaaccuccgccuccuggguucaagcgauucuccugccucagccucccgaguaacugggacuacaggcacaugccaccacacccagcuaauuuuuguauuuuuaguagagacgggguuucaccauguuggccaggauggucucaaucucuugacuucaugaucugcccuccucggccuuccaaagugcugggauuacugcgccacugugcccggcaugagccaggcaugagccacugcgcccggccuugagacuuuaguucuuauaucccaauugcuccccacccaugcuuuagaucugauaagcaugucauaccacaguuuuuauuuuauccauuugcaagcauaauuacugaucuuucuuuuaagagagaaucuuuauauaaauagaaaaaaauuagagaucaccuagauccuuaucuuaauugggaaaguuuuucaaucaaaaaauuagaagcuuaaauucuucagcaugacacacuauguagaggaacguuagaaaguguguuggggggccgggcgugguggcuuauaccuguaaucccagcacuuugggaggccaaggcaggcggaucacaaggucagggguucgagaccagccuggccaauguggugaaaccccaucucuacuaaaaauacaaaaauuagccaggcgugguggcgagcaccuauagucccagcuacucaggaggcugaggcaggagaaucgcuugaacccaggaggcggagguugcaguaagccgagagccaagaucacgccacugcacuccagccugggcaacagagcgagacucugucucaaaaaaaaaaaagaaagaaagaaagaaacuguugggauuucgugagugcgaguaugucuucuggucucagguagauccaggugaguuuagaggucgucgguguugacgcaucuaaaaccacgcaggaaacggcugacaaucgugcagccgaauguaccccuggagcagcccagggacaccccgauuggcaacagcgggaguugggagaagagagggaggccagaggguggguguguggaaggagacucacgucucacuagguucuuuccauuuucauuuuuuagccauaugcauguaucuuuagccuuuguuauuugaaauauaacucacauacagaagcauaugaaacaaauguguagugaauaauuauaaagcaaauacccacauaaccaccauucaggcugggcacccuaaaagcccccuguaagucuuuuauaguuuuagggauuccuguuucuuccuauaaaugaaauuauacugaauaaauccuccuuaucugccccuuugaugcaacaguauuuuguaaggcauauccauauuguguauagcuguauuucauucaucucuaucgcuuuggaauguuacauagacugcauuugcauuuaccuaauccaccacugaugggcauuugguuguuucuagucugagcuguuaggacguugugcuguggacauuccuuuaccucgguugugauggacguguaugugagugucgugaggugguaugccaggagugcuguccuggcugucaaccucguguauccucaacaccacugauaaugcacugccccgcccaugggugguguucgggcuccagccacaaagcagcuccuugaggcacuauuugguguuguccguagugguuuuaauuugcauuucucuggugguuauuaaugagagugacgagcccuucauacgugguuagccauuuggaucuauuuugugaagaaccugauuaagacuuuuuccuauucuucuauuuguacucugaaguuuucuuacugaguuauuggacauguuuauauauucuggauaugagucuauugguuauauguauucaaauaguucuauccugugccuugccuuuucauccuuguggaugucuugaugaaggaaaauguuuaauuucaguguagauauauguauauaauuugauccaguugcuuccuuucuuucuuucuucuuuucuuuucuuucuuuuuugucccuguguaccuaguugucccaacacaacguguugaaaggccgacuuuuccucacuccucugcaacccucugcugucacaagucaggugucgauuuaugcaugagccugugugacagcacagagccuggcuguuuucauucaugaagcuuuacaggaagucuugauuucuggaacagcaaguccuccagcuugguucuucucaggggugucuugguuagucuuaaccccuugcauuuccacauacauuuuagaauccauguauucaguuccacagaaguguguguuggaauauggauugggauagcauugaauccguaggucaguuucuuacucggguaacuguuauccacaggcugcuagagcaagcaucaaaucaaugguuagcuaguaaaagcuccccucugagucggggaugggugcaaggggccguucucacugcuccucucagcguugcccagagguccuggucagcgcaguagauaagaaagagaagaacaauguggggacuugcagaugaaaggaaaaccagagggauuuagcaagauagcuacauguaaaagugauacucaaaaaccauuuuuucuguauugcaacagcaguuagaaaauuaaguguuuuuaaagauaccauugacgaucacaucaaaacauagcaaauaccuaagaauaaaaucugaaaauuaauguuuugcacauuuugagaagaaaauuagaagacuuuauugggagacauuuaaagagaacuugaguaauuggcgaaacaguccauguucaugaauuggaagacucaauccugccaaauucuuaaguucuccccagaucuguaugggaaauauaaagggccaugagcagugaaaacgugaggagggaccaggugcaggaaucaaccagacauuaagucuucuagggcucuagaaacucagacuccagguggugcaggaugaggcaguggccaagaagagagagagcccugccugcacagacacugcucuaggacacaggagacacuagaagucauggagaaauggucauuucaaaaaguggcaugugaauauuaucuuuaaaaacaaaauagaacugcugagcuuuuguuuacuuggugggggaaacucauccucugcuaaguuuccucaucugggacauagaggggaguggaauuuaguacauauuaaugaugaaucccaaauuugccccaaguuguuaguucaacuuuguuccuacucguuuuguacuaagaauaaauacauuugaaagacaagauggcaccgucgcuaaauguuggcuccugccuuuccgagagcuugagcgcuucuuucuguuuugcgugagaucucuugucugugggcucgcgacuugcauagaccuccccaggacccugggagcaccuugcauggaagaauacacuuggggcuggcaugguggcucacacccgucaucccaacauuuuugggaggcugaggcaggaggaucacuugagcccaggaguucaggaccagccuuggccaacauagugagauugugucucuauaaacaauuuaaaaacuagcugggugugggugcaugccuguagucccagcuacucagagggcuggggcaggaggauggcuugagccuggaaggucaagguugcagugagccaggauuauaccacuguacuccagccugggcaacauagugagacccugucucuaguuaaaaaaaauaaaaacgugcauggaagcugagggugcugcuugaccugaugacgcuguggucucuguguuugaaacuuggcugcuucagcugcuuagugaauauuacgugagugaccagggaguacuucccacccuugugagccugcacauucugggguaucuuuugaguugucacugucuaggcugguaguuuuugcagcugugucuccuugcuccaucgggguaaugcuuauuuggaaggccccaacaucugugcagcagaaaguccugguucugcugucuuucugcagcugccaugcugaaaguugguccuuuauggugucuuggagcauuucuuuugaccaccaagacuuuucauguaaaugugggcuuggcuucuuuuuuucaaucaguuuccuauccacaguuuacaugaugccucuuggugcauagugacaauuuaguaauucagccuuacuuccucauauucuaugauuugguggcuaagcauguaugucacagcucucacucccuucuguaauugagguacauguugcuagcaacaucggugaaguuggcugugguauucgccguuuaggacucauuuacaaaagccuucacugcccaguaguggucuccaaacucuucuguccacgcuugccuggcagcaaaaacaaccuccagcacacaccuccacugcguguaaauuugucuguugaauauuaguauguuguaauuucuuguucuuuguagaagaaaguauaaauagacacccugcuguuuucuuccuacguuccaaucuugaguaacccccaggcucacccugcacucuagauaucacugaccagugaaacgcauucaauuucuguaccucccugacuguugggaccaggagcauguauaaagcuagacaggaaugcucccagccuacuuuaaaggagaucuuuguuaaacaucucuauuuaucacugauuaauaacaggcuucccuuuaguaaauacguuuuuuaaagaauagcacauucuuuuuuuuucuuuuuuuucauuuucuuuuucuuuuuuuuuuuuuuuuugagacagagucuugcucugucacccaggugggaauacaguggugugaucucaguucacugcaaccucagccucccggguucaagcgauucucuugccucagccucccaaguagcugggauuacaggcaccugccaccacacccagcuaauuauuuuguauuuuuuaguagagaugggguuucaccauguuggcuaggcuagucucgaacuccugaccucagaugauccacccaucucggccucccaaagcgcugggauuacagacgugagccaccgcgccuggccagaauagcacauucuuaucuccaccuucuuucugucauuuuggaugcccugggucuuuucuccucuucuccuacggguuuugcaugaguauguccauguauauugcuccgggguaugauugaggauuuaucuugaaauauuuggaaauugucucaaauucacaauaacauauuaauuaaauaaugggaaaagcuaaaaugaucuauacaaguaugaggcauuuguaauaacacuuuacuguuacaaaucagaauacguaaagguaugaagcauauucuuccaccaccuccacccauuuuuguuuccccgugguacaguccugucaacgcagcagaaaauaagauuuuuaaaauauguugaugaagaaguuguuaaauuaacuuguauucaaaaaaaaauggaaauauuugauagggcccaaggaugcaguuuuuuacuuuuuuacccaauucauuguuacagguuuuuuuuaaaacaguaaaauucuuuuaaaaaaaaaauagucaaaugagauuuuuuaaaugaagaaaagaaaugaaaaaaagagcucaugagauuauaaucacaggcauaucugcuuauggucuauaagcaaaaauucuacagaaacacccugucuggaagccuagaagaauugaaauucacuugccuuuuagaacaguuuggauagaaauuuuauuaaaaaccguguuacucugcucuuccuucuuaauuguaauaaauuugcuuuuguguuugaaugacaacuuagucuuuuauucugaguaucaguuacugugcaguguuuauaacgcgaaugaugcuuuuagggcauuuugaggcauguaagagugauuuaacuccacucugaaugaucccaacauccuuuugaguuucaguucccugaaaaggguacauuuggcccucguguccguaucugccacuucauagcaccguggccuuaggcaagcuguguuggcucucguaccuguguccucgccucuagaucgggguaacggcacuggcuugaacugcuguuaggaggauuuggcgaggacauguucuuaaaggacuuaacuggcuacuccuuaggagccaagcugugcauagcguggcucuuagggagaacgguggacucucaguucucuguagugccaagaaugugagaaugccaaacagcuccaaauacacaggcugcgacaacacacacgagcucauuuaagguaauccuggcaaauuaggguacaaacaaagguguagaauugaugagaauugaaggcaagcaaagagguaauuccaaaaaugaacguuuuucauugaaaaagacuggauaucugaaugugaagaguccugaacgcuguaaugacaguuacucguuucaaauaguugcacagccacugaguucucagaguauuuaggaauaaaauuuuuguucucaugguguuuuaggauccuacaggcaguacaccccacucccauggccuugcgugugugcuucugaucucugaaugcagcguaggaaacagggaaaccguagcuuccuacagaaugggucugcucagacagcagagucugugugcuuguuauuugcaaggcucaauguugggccuuugggcauauagagaacuagaagacauagucacauggcaccuacccucaaaaagcaucuaguugggaguaagagguacuaagcagauagcuaacuguuuaaagcacuaacaagugccagaugacuugcucagagucauacaucuuaccuaggcaguaaggaaaggccuuguagaagaaaccucaacaggaaguugacaguaggggcagggaagggcaagaggaguguggaaaugcucggcaccagaggaagcagaggagcugcaggaaagcagcaacaccccgccgcccccaggacacucccuggagcgaggcuggcauggggcagugggucucagggccccagugcuccuaaaaaacucugcaggacgugaaagagcacucuuuaugugaauuuagcuauugcuacugaccuauuugaaauuaaacuggagaaauuuuuaaacauguauuuauuaauuuacuaaaauauaauaaacauauuacauuuuaacagaaauaacacauuuuuaaaugaucuagccacguuggccaggcgcauuggcucacaccuguaaucccagcacuuugggaggccaaggcaaguggaucacuugaggccaggagcucgagaccagccuggccaacguggugaaaccccgucucuacuaaaaauacgaaaauuagcugggugugguggcgcacaucuguagucccaauuacuggggaggcugaggcacaagaaucauuugaacccaggaggcagagguugcagugagccaagaucacaccagugcauuccagccugggcaacagagugagacucugucucuaaaagaaagaaagaaaauacccauguuuucuaaaacaaaaacuaauuuagugguaagaguggcauaguuguauauuuuugcaaaucucugcaaugucuggcuuacuaggagacauuaagacaaggauuccccuguccgcuucugcauucagucuguugccauauguugcuuugguggaaguuugggaaaacgugguugggaagggaggaguauuuuaguagccuuuucagauagucguggacauuugcuuugauauuacaccaaaaguuaguaugggucguuucuuaaaggaaucuguaagguggaaucugaaacuauaucaguaaaagccgucuguaaauuuuauuccauuaaaucaaguggucuacuuuguacuuugaauggcucuuuugcccuugaaugguguuaacacuauuuauucaucauuuggaaaauacuuguucacggaguuaugcaaaucuccuaaaacauuuugcaaaucuuugacacauuucaguauguaugucagucagucccguuuauucgugucaccacugaucuccucuucagcccagggaagaugucacgcucacaguggcagacagaaguuuuccagacuucccagaauacuggaccgucauucagagcuugguuugaauuuagcuucauccacuugccagcacugagugauuuucuaaaccucuuucuuuaugucuguugugcuguuauaaagauuaaauggcaagaaagugucaauauguguaaaguuuuuaggaugaugucuggcccagguaagcacucacuaaguaauaguuaccguuauugcuguuucuaaauugccaucaucauuaacgucagucgucaugugugauaagccuugacuguagaccaggaugagggaaaugcagugugcuugguggggcucuaaggugcuaacucuuugaauguuuggaaguuaacagucaguuuggacuguuacaucuuuggacugaugccaguugcucugucaucuagcaagcguggacaaccaccugcccuucccauguuguaagcugagggccuauaggcagacauaaggaggcauccuucccccucuggucuuuuuuacccugccugaaccuaaauucugcagauaucaccuggugucaauguguccacgcccuuuccccagacauggaccuuacugguugccucucauuccacugcccgacacggugccugugaucauugcugcucagagaguauuuguugaaugaacacauguagauggaguuuauuucuaacagugcucucaacaugguuugaaagaguuaaaaagcauaaaaacuuccucauaccaaacauauaauaugaccagcgacuagcuggguuuuuucguuuuauuuucuuuaaggaauagccuuuguuuaccccacccaucuccuuuuuucuugaaucucuauucaaaauaaaaauagaagaaagcuuaaauguguuucacaauaacuuuggguuaagcacuuuugugaucaauauacuuugcuuucugcuuuucagauguuccuccugcugaucaagagaagcuuuuuauccagaaguuacgucaguguugcguccucuuugacuuuguuucugauccacuaagugaccuaaaguggaaggaaguaaaacgagcugcuuuaagugaaaugguagaauauaucacccauaaucggaaugugaucacagagccuauuuacccagaaguaguccauaugguaagugauuacaguuuaaccagugugucccaguucugauuuauaaacaggacaggccaagaucucugagccuaacacagugcuacccaggagaagaauccuccuguuccagaauuuguaguugugcuugaagaaugaaaauuuucuuuguauccuggauuguaaugauaauaauaggaagggaagucaguugucuucuagggaccagucuaagugcuuugcauuuauuaacucauuuaauccucacaacuacccuauggaguagaaguguuagaauuuguauuucuauuuauuauuuuaucuucuuuaaauuuuuuuaaaacauauuuaacauuaauauacuagugccuuuuuauaguucagaaguaaacauuuuguccauccaugugcaggaaaauucuaaugaugggauggaguugaaauauugacagaaccaagcuggugucagaauaguucaugcugauuggcugagaaggccuccaccugucagugcugggaucaggacagcccaugcugauuggcugagaaggccgccaccugucagugcuaggaucaggacagcccaugcugauuggcugagaaggccuuccucugucagugcuuccucugucauuccucuaucaaugacaguauguccugacuggcugaaauagucuuaucauccugcaguuaguucacuguugguuuuauucagcccccagaucucaguccucugaagugucaaacuuuacagcccauuccucagucaguaccaccuggaaacacuucauucagugccauuaccaaaauucauuguuugacgcugaaauccaguuuucuguugauuuuucuugaauuguugauauuuuaucugccuuugaaacuaguaccccccacacacacacuuacuggggagucaguguggcuuaguguaaaauguuaaguccaauuuucauugaacucuuuguuaaguuacugauuuuuuuuuccaaagcuauauauuucagaauugacuggacuucuugaccuaaaauacuuuuauuuccuucuuuaguauguuugcuuuggaaaaagaugaaaguaauguucuucguuguaguucagucuacugugucagagguugagaucaacuugauuguuuuaacuuguuguuuuuaacucuuaaaguucagaauucacuggcauggcuaccauguagucggccuaaggacuacaaaggccaugcggguuccugucccagacuugugccugaagaagaguaauaggcauaaacugagcagagaauauauacccuaaaaccuuaccuguucagacuaaugacacuuggggaauagcuuuuuucuuucauuaauuuuaacucucaauuacuuuggaggcccacucuagccccagaaucauaaaaaucucuaauauuuucuccuauuacuuucauaauuuuguuuugcgcaucacauuuuauaaucuuuuuucuuuuagguauggauauguaauaguuguacauauuuauggaguauaugugauauuuagguagaagcauagaauccguaaugaucaaaucaggguaauugggguuuccaucaccucaagcguuuaucauuucuuuguguuaggagcauuccaguuuuuuuguuuguuuguuuuuuguuuuuuguuuuuuuuuaugauguggguuagggauagaacuucauuuucuuuuaaauuuauuuucuucuaaaauuauugaaaaauuauuucucccuacaucauguauugacuauuucauuucccccuauugcuuaaugcuuccuuauuauguguucauuuuauuuuacuguauguuagauuuauaaguauauaaauucuauauuaaguuuacacguguggaagauuuuccuauguuuaagaaagucucugauucccacucuuuaaccuaagagggaagaaucuacaaagaaugacaagacucccgcuggccugguucaggucaaaugcccgcccuugaaccgagugugcucccgacugcuugaaaccgccucucguuuguauuucacaguagcaguguggguuacuggcaccacuuaggauacuuaaaagcccuugaggcuguuuuuauagauuaagucaucauugccucuccucucccugucauaauuguuuccuaacuugauucuccuccugcuguauuaacuuguuucccacccaaaccucgcgcugggcuccagagcguugccagccccugggcucccuaagcaguaagcagacacugagcauccaucaugggccaggcacguuuuggggugaggaaauagaauggcgaacaagacuucugcccuccuaaagcuuucauuuucaccuaaagcuuucauuuucacgugggagacaaccauaaaauaagccaaccaauaauuuucauuuuagauuacggugaugccgugaauaaaaguaauccagaugaaauagauaggguugcaagacugggaaugugauuucugccuuaugcccacgugggcgggaagaaggcgcagaguggaaacugggugaugaauuagacuguccugugaagaugggcacacaugagaugcugucuguggucacugugagagcaggggacauuuucuuuccuuucugcucuaaguucagaaggcaacauagccuuucccuaccccuuguuugucuggaucuggagguagaauaggggauggggacagauuggauuuuugguuuuguuguuuuguucuguagcuagagggcauugaugagaaguauagugaaagaaggaagaacacaggcggugggguggugccuggccuugguuugugacccucuugucaagaauuuaagcaaccaguacaaggccucugucccaagcagugccugggccugguguggcaggcagcaaaagccugggccucuuugugguucacgucugaugagaagcucugcagcuuagagccccugugugcccaacacuuaagcagccuuuagccaugccuguuuuucucuuuguuucuuauuggggauggggguguguauauuuuggucauaacaguuuuagagacauuaauuuccacuuuuuuuuuuuuugaagaauccaaagcuuuauaguuguuguacuccugaugcugcuacuuuuaaguauccugcuuauuagacuggacugcuagaugguuuuuuuuaaacagaucuacugagguauuauucacauagccuagaauucacccauuuaaaguguaugagucagugauuuuuaauaugaauauagaauuguacagccaguaucacaucugguuuuagaacaguuucauccccucaaaaagaaauccuguacucauuaauagucacugccauuguucccuccucccucacccacccccagcccugagcaaccacugauugacuguucaucucuauggauuugccuguuguggacauuucauguaaguggaauuacagaauauguacccuuugguguccgccuuccuucacuuagcauaauguucucaagguucauccacgugccaguaccucaugccuuuuuauugccccauaauauuccaucauacagauauacuacguuuuauuuauccacguaucuguugauggacacuauauuauguccauuugggggcuguuaugaaugacuguugugaacauugauacgcaagcuuuuguaugaacguguguuuucguaucucuugggcauauaccuaggaguagagucgcugggucauaugguaacuuuaacauuuugaagaacuaccagaccguuuucacaguggcugcaccauuuuacguuuguaucagcaguguacgggaguuccaguuucuccauauccucaacacuuguuaugaucuguuuuauuacagccguccuagugggugugaaguguaccucauugugguuuugaugugcauuucucgacaaccaguuguguugagcaucuccuuguguguuguguauuuuuauacaucauagacuucagaccuagaaauuaauggaaacguccugaucaucuagcuugacccuuuucuuuuccagauaaaaaggcuuauuggguucagagagaugcggguggugaggagcaauucccaggggagccaguucuuggcgugcaguuucccaggccuaaguuauaccagcuccaucauuaauuucagccguauuuaaauauaaucagccuccuguuuuuucaauuaaauuaucuaguuaaucuguuucucgggcacagaccuucuucugauagucacaauaccaguagcaaaacuaauuguagcuuuuaaaaaacucaauguaguaaaaguaaagcugcuuuguuaacaguaacuaaagaguuaagguuagggguugcacccuuucaaaaucugaaacuuugacauaucuagcaguuuuuacaugguuucagaggguucaagccucuuagagccuacaguagaccccaaauuaggaaacguagagucucuucuaaaucgggauucucauccaaaucaggggaucacagauaccuggucuccuugagagccuuucggagggccugugauguuagaacuauuuccaucauacugcuaagacuuuaauugacuuuuucacuguauugaaauuuguaccgauggugcagaagcaguaguggguacaacauugcgcaccuuagcaagaagcacagugauggcaccaagcugacaaccacacaccccaguagaaauagaaacagccaguuucacuuaguggucuaaaugaagcaauagaauagauuaauuguauuauuucaugacccuugugcacacauggucuuaggacucuaugaugaaaugugaagguuucauaaagcucuucugcugccggcgccagucaggagggagagcgcuugugggauggagcugccagccaaacaugccgcuguuuucauggaacaccauuuuuaccugaaaacugacagacaaaccaguuauucggacuuugaauauuuggcaggcaucuucugaaaaaauaagcaaaaugagaaagucacuuuaaggaaaauaacugacagaguuuguugucagugauaaaaugugagcuuucuagggaaguuuuguuucauuuuguuuuuagagaugccgucuugcucuguugcccaggcggagugcaguggcacagucauagcccacugcagccucgaacuucugggcuugagugauccucccaccucagccuccugaguagcugggaccacaggcuugcaccaccauacccagcugauuuuuuaaauuuuuuuguagacacggggucuccacucuauuggccaggcuggucucgaacuccugugcucaagcaauccacacgccucagccucccaaagugcugggauuauaggcaugaacuaucgcacccagccagaaauuuucaguuuuggaaaauuuguaugcaccagggugagcuucagccucccaaugcugcagacacuccugcugagcucaguggugaugggaaugagugggauuuuuaauagauaugaugaagugagucaccacuuggaagagccaccuaacucaaugaacaaguauuuuccaaaugaccgguaaagguuacagagucauuuguggcaagagagccauucagagugcgcgauccagcacuggauuugaaugugagaguauagaccccucacugauaagguuucagcacccaugcaggagcucaccccuaauaaacuacuacugguugaguuuugauguagacaaugaccuaaaaacacuauuagauagauacuccucccuugucaacuacauugucugugugagaccagacuuucauccuauauuucaaccuaaacauucugaacacagaagcagauaugauaaucuagcauuuuucuauuaaaacagacauuaaagaaauuuacagaaauguaaaacagugccacuuugcucacuuaauuuguucuggaaaauauaguuauucauaaauacaugucauuuacacuaagacaugauggauuuuuuuuuuuuuuuuuuuuuuagaugaggucuugcucuguugcccagacuagagugcgguggcauggucauuacucacugcagacucaaacuccugggcucaagcaauccucccccucccccugccucagccucacaaguagcugagucuacacugcaagugugcgccaccacaacuggcuaauuuuuuuuuaaagagauggagucugggccaggugcaguggcucaugccuguaaucccaacacuuugggaggccaaggcgggcggaucaccugaggucaggaguucaagaccagccuggccaacauggugaaacccugucucuacuaaaaauacaaaaauuagcuggguuugguggcacacucuuguaaucccagcuacuugggggucugaggcaggagaaucgcuugaacuuggaaggcagagguuguagcgagccgagauugagccacugcacuccauccugggcaacagagugagacugcuucucaaaaaaaaaagacauggagucuggcuauguuuccugaguuggucuugaacuccuggccucuaguaauaauccugccccagccucccaaguugggauuuuuuuuuuaauuucugugguuuaauuuauaauauggccaauaucaauagauauaguucuuauaaacaaaaguucuuuaggauuugcaaccguuuugaggaguuuaguaggggccuaagaccaaaaaguuucagagcuacuuuucuaaaacagugccacucaaaggcugcagcuucaacagccuuuaggcuuguuagaaaugcagauucuuggccagguacgguggcucacaccuguaaucccagcacuuugggaggccaaggcuggcggaucaugugagguugggaguucuaaaccagccuggccaacauggugaaaccccaccucuacuaaaaauacaaaaaauuagcugggcgugguggcaggcgccuguaaucccagcuacuuggaagacugaggcagaagaaucacuugaacccgggagugggagguugcagugagccaagaucgcaccacugcacuccagccugcgcaccacagaauaagacucugucucaaaaaaaaagaaaugcagauucuuugggucccacccuagaccuguggacucucuggggguguguugcagugcuguguguuuucagugcucuccaggucauccucaggcaagccaaaacuucaauaacuguuuugaauaaucguccugcauugucccaucuuuggaucgucaguucccccagagaacaacuuguuauacucuugcauuucuuccacugaauucagcacacugccuuuuauagacucaauaaauauucauucaauaugagguuuucugcauagacuugggcauuaagacucgucuuaacagucacagaugaaaauaaccugaagaucagaaaaggaauugcuuggauuggugauugaaugagucggaugacucagaaguacuucgcauuagaguggaccucuccagaaauauccaaaucuauugugcuggaccacugagaacgcaaccugguguacucaaucaugcaagaaauguguauugcagacaccaugcuaccucuuggggcuaccccaagaacuaaaauaauauagucucuaccuauauggcauccacccuuacuggucugggagacaagaagaggcagcagacguaaugauacgagggccaaggacugcgguggcggucaguguaaggucugguaagagcacaggcauaggaggccuaaccccuugccugggcgccccagagaaguggccucucuacaccagcggccagugcuucaggacuagcuggcucagugaaagcaauauagaggagggaaggggaggggaguguucccagcagaaggaacagcuccucuaaagcccaaagacuagagaaaguaagacguguuuggguuugagccaagccuggagcucccgauugggugggcuagagucuggauccuggggagcuugauggaacccgaggaccugagguugggugggagagcugggaccaccccguuugcuccggcugcagugugaagaauaggugggaaugggugucagaaugacgcaugaagggaccagcucaacaucugcugcggcauuucaggagagaagugguggaaugagccaagcggcuuugauggcagagagaaaugggcaaaugcagagauguuaagaagguagaaacacgauucgggguggauuuguuugagauuccuggggagaggaaccaacgcgcagguuucugacuugagcaaguggaaugcugguucaggggaaagagcaugggcccugguguaggaaaggccugaggugggucucaucugcuaacauuauuuagagcucuuuggguuaacgggggcaggcacccaauucacuguuguuuacacucacaagggaguuuaccaggcagacacugggucucucacacuuaguccacagagucacagggacagcuuuuccuuccgugucccauguccccgcucucuguaugcagccuuccuucuuuggggcaucccucuaugaugacagaggaaagcauggcccuugcuggcuugccagaagaggccugaugucuccugucuccuaccugcccuugaucccguugccguaacuagggagaugggguacugugguugugacucagacugggucaugugcccaccaaaccaugcgauagagucaaggagcaagaauuccccagaagggagggagucgugugcuucucugggcagaugaaacggucggaucuguacccaacuuuaaucugcuaacugugcuacuuugggugaacggcuugguucugcaagcuugguucugucugcugcagacaaauagcuguaaugcuucugccucacagagcagcuaggaugaaaggggaacacauggaaagcuugggcagcccccgugacaaaguugucaguguccucggaaguggccagaaagagacaagccuccaagauuucucagaaugcuuaccagggggacgccucaaugcagccuucuuucuucauauucguacgggacuuauuucuaauucucgcuccagacucugauaucuugagguuacuuaacuuuuuuuugagacagagucuuucucugucgccaggcuggagugcaguggcguaaucucggcucacugcaaccucccagguucaaguaauucuccugccucagccucccaaguagcugggauuacaggcaugcgccaccacacccagcuaauuuuuguauuuuuaauagagacaggguuucaccauguuggccaggaugaucucaaacuccugaucucaggugaucugcccaccucagccucccagaguacugggauaacuggcgugagccagcgcccagccucuauuuucuuauuuagaaaguuaucaugcuguggaacuacuucauagagaguuaguuagauuaguuuaaauggugauuggaagauuaaaaauacauggucugaaguaugauuucauguuuguaacauauaaauaaauucaugaaaauaaaaucaaacuuagggagagaaaguaacuugugaaauacucuacagaguacggugacccagcccuguggcaccauccacaccacagauugauuugguuccauuuuaucgauagauuuuuaaaauaaagcugaaggccucgccaacauggugaaaccccaucucuacuaaaaauacaaaaauuagcugggcaugguguugcacaccuguaaucccagcuacuugggaggcugaggcaggagaaucgcuuaaacccuggaggcggagguugcagugagccaagaucacgcuacugugcuccaaccugacggacagagcaagacuccgucucaaaaaaauaaauaaauaaauaaaaaagcugaaggaauauaguacaaacuguuaauaguaggugucuuugggugguaucauuaauuuuucccuuuuacuauacacuuuuguaauuuuuaaaaaaauucagaaugggccaggcacaguggcucaugccuauaauccaacuuugggaggccagggcaggaggaucacuugagaucaggaguuggagaccagccugggcaacguagcaagaccuugugucuacaaaaaaaauuuuuuuaggccgggcacgguggcucacaccuguaaucccagcacuuugggaggcugaagcggacagaucaccugaaguuaggaguucaagagcagccuggccaacgugguggaacccugucucuacuaaaauuacaaaaauuagccaggcgugguggcgcaugccuguaaucucagcuacucgggaggcugaggcaagagaauugcuugaacccaggaggcagagguugcaguaagcugagaucaugcaacuguacuccagccugggcgacagagcgagacucugucaaaaaaaaaaaagcaagaagaaagagaaaguuuuuuaauagcugggugugguggcgcacgccugcaccuauaugccuagcuacucggucggggcugaggugggaggcuuguuugagcucaggagcuuaaggcugcaaugagguaugauugugccacugcacuccuaccugggcaacagagcaagacucugccucaaaaaaaaaaauuaauaauuauguaccacauuugucaucaucaaaaaccaguaaagauauuuuucuuucuuaaaaauaaaaacaagcggccaggcgcgguagcucaugccuguaaucccagcacuuugggaagccgaggcagguggaucaccugaggucaggagcucgagaccagccugaccaguaugguguaaccucaucucuacuaaaaauaugaaaauuagccaggcaugguggcgggcaccuguagucccagcuacucgggaggcugaggcagaaggauugcuggaacccuggagguggagguugcagugagccaagauugcaccacugcacuccagccugagcgacagagcaagauuccaucaaaaaaauuaauuaauuaauuaaaaagauaaaauaaaaacaagcuauccguauguaauauaguacuguuuuuaucaggacucuuguugguuuccagggaaaacuaguugaucacauuauuuuaauccgcacugucuguaagugauuugauguugacuuacacguuuuaugggcaugagaguguucuuaggaucuguuggccggguccugggggaggucucacacccugcacccccagauggguguccugugcuucacuuagggacugauguggggcacguuccuucuucuauuuuuauagcugauauuuacaguguguucuggaaaguuuuacuugcuauaagggugaugauaguuugggagaggaaagaauguguugaauuaagagggauaguacauugaccaauggaguugcagucaaauuuauuucaagugaggauuuaaaucaugcauucccaaguacuuuuugaaauccagagaaugauuuuucuacuuuaaauaucaguaagcuguuuuuuagagguuuguuuguucuuacgauuuugagauuuuccuuugauguuuuuaaauuauaaaagaaauacaugcuuaugugauaacaaaugaaacaaauacgaaagcauuuuaaaaaguuaaucuuuuuccuacuucaccccuccccaguucuacccaucucuaccuccaaucagccaauucauguuuauuguauuuucagaaggcugcugagaaacuuuugggaugaugaguauguucauuaucugauuauaugauuguuucacagauauaugcauauguuaaauaucaaauuuuacacuuuaaauauguacauuuaauuguauauaaauuauaucucaguaaagcuggguguuuucagauguccaaacuuguuagguauuucuuuuggucuaggggugcagugaagaaauuacuaagacaccaagggcauugugaaccaagaaguuuugggaacuuaugaccuagugaauaucuuuccauaacuuuuuuuaaauuaauuuuuuauuuacauauagugaaauucacucuuucuuguggccaguucucggaacuuugauaaauguguauagucacgucuuccgcaccacagucaggauauagaacaguuucuuuugguuuuguuuguuuguuuguuuguuuguuuuugagacggagucucuguugccuggcuggagugcaguggcaccauaucagcucacugcaaccuccgccuccuguguucaagugauucuucugccucagccucccgaguagaagaacaguuucuucagccuccagaaacauggcuuuaugcucacuuuguagucagagccuuccccuuccuuucucucugccccucacuagucuguucucuaucacaucauuuugucuuuuccagaauggaaacuccauagaaauggauucaguguauagccuuugggucuagcuucuuucgcuuagcuugaugcauuggacauucguccauguugucacacaguuuguuccuuuuccuucucaguguugucucauuauauaaaaguaacaccauuugcuuauccauuuccuauggagggauauuugagguguuuccaguuuuauuuggagcaauaaaacuuuuauaaauacuuacauaccgauuuuagacauaagcuuuuauuuaacuuggguaaacacauagggaugcaaucgcuaggugaaugguaaguguguguugagcuuucuaaggaacugccaaaccguuuuccaaaguggcugccccgugugauucccccaacagugcgugaguucucaugccucccguaucuuugucaauauuuggugucaucaguccuuuuaucucauuuugauuuuaauuugcauuuccuuaaugacuaauuaugccaggcuuguuuguuuguuuuuuggagacagggucucgcucugccagccaggcuggagugcaguggcucaaucauggcucacugcagccuccaccucccaggcucaggugauccucucaccucagccuccugaguagcugggacugcaagcgcccaucacacccaccucauuuuuguauuuuuaguagagacaaggucucacuguguugcccaagcuggucucgaacuccugagcucaagugaucccccugccucagccuaugaaggugcugggauuccaggcgugagccaccacaccuggcccaagcauuuuuucccugcgcuuuuugucguuuguauaucuucauuggugaauugucuguuccaauuguuugccuguuuuucaauugggcuuuuuuuuuuuuuuuuuuuuuuuuuugaguuuugaguuuugagacuucuuuacauaucuggguacagauuuuuugcgagauacaugauuugcaaauauuuucucucagucuguagcuugucuuuuuuuuuguucuuaagugucuuguacagagcaaaaauguuuaauugagauaaaguccaacuuaggauuuguccuuuaucaguagugcuuuugguagcauaucuaagaagucugccaaaccuaagcucacaaagauuuuucuccuauauuuucuucaucguuucacauuuuacauguaggucugugauccauuuugucugcaguucguucuuuggcguauggauuuccaauuguucuguuuguugaaaagacugaugaauauccauugaacugcuuuuguuccuuugucaaaaaucaguugagcauguugugagucuucuucuggacucuguccugucgcguguuuguguaucucuguuugccagucucacacugucuucaguacaguacuugauaguaaauuuugagaucagguugugugacugcuauaaccucuuucuucuuuuugaaaauuguuuugacuauucuaguuauuuuaccuuuccauauaaauuuuaaaaucagcuuguuaucuacaaaauauucuccagggguuuacugcaugcagugaacauguagacuuggagaccauugaccucuuaacagugugagcuuugcagccuauguacacagcaugucuccccauuuuggucuucuuguuuuguaguugucagcaaacagaugcuauaaauaucuucuuagacucguaaauuaguauuuugguuuuugguugucauuguaaauagaucuguuuauuucccauuuguaauuguuuauugucuuguuguaauuauaucagguuuugcuucauguuauauauauucauauaaauauucaguguauauccccucuuggugaauuaacucuuuuaccaugauagauaugacuguauugcugguaauauuauuugcucugaaauccacuccgucucaccuuaauauagccauuccagcgcucuucugacuaguguuggcaugguaugucuuuuucuucccuuuuacuuuugaucaguucguaucuuuauacguaaaguggguguaugguagauagcguauuguugagucuugguuuuuuuuuguuuugguuuuuguuguuguuguuguuguuguuguuguuuugagacagagucucgcucugucacccaggcuggagugcaguggcacaaucucugcucacugcaagcuccgccucccggguucaugccauucuccugccucagccucccccaaguagcugggacuacaggcgcccaccaccacacccggcuaauuuuguauuuuuagcagagacgggguuucucaccauguuagccaggauggucucgaucuccugaucucgugaucugcccuccucggccucccaaagugcugggauuacaggcgugaaccacugugcccggcugagucuugcuuuuuuauucagucagacaaucccugucuuucaggguguugaaaccauuuauuuuucaugugauuaugaauguacuuggguuuaaauguaccaccuuccuauuuuuuuucuauuugucccaccuguuuaucguuucucuucuuugucugcauucuuuuggaucaauugaguacuuuuuaugauucccuucuaucucauuuguuggcuucuuuaugauaacuccauauuguuugauuuuaauuguuagucuuuucuagaacacaccuuuaacuuaucacaaucuaccuucaagcgauaacauacuauuucauauagaauauaagacauuuacaacaguauacuucuauuucuccucucccagccuuuccgcuauuaucauacauaaaccccucaauaucuuauuauuuuuguuuuaaagaaauuuaagugauuuuuaaaaaucuuuuuuuauuauacuuuaaguuuucggguauuaaaaaucuuuuauauuuacccagauaguuacaauuuucaguguucaucauuccuuuguguagauucagauacccaucugauaucaauuaccuucugcuugaaggacugucuuaauauuucuuauagcacaggucuacugaugaugaauucuuuuagcuuucguguaucugcaaaagccuuucuuuucuuuugccuuuuuuuuuuuuuuuuuuuuuugagacagggucuugcucuguuacccaggccaguguauaguggugcaaucacggcucacugcagcuuugacuuccaggcucaaucaguccucccaccucacaccccaaccccaacucugccccaguagcugggaugacaggcacaugccaccauguccagcuaauuuuuuuacuuuuuguggagacagggucucacuagguugccuaagcuggucucaaacuccugggcucaagcaguccuuucaucuuggccucccaaaguacugagaguacaggggugagccuggucuugccuucaguuuugaaagaucugcuugcugguauagaauuccgugucgaccguuuuauccuugaaaaacuuuugcucgccuguugucuugcuugcauuauuucugaugagaugucuccugccauucuuuucuuuguuccuuuggacauaauguacccuuucccccucugggagcuuucacaguugucucuuuuuaagucauuugauuaugaugggccuuggcaugguuuccuucauuuugccuguguuuagaguuuguuuauaauuuucaucaguuugagaaauugucucuucaaauauuuuuuucugucccaugacccuuucucuccuuuagggaucccaauaacguguauuaggcuucuuagaguugaugcugaugcucuauuucucuuaauucuuuuuuuuuuuucuguguaacauuuggauaguuuccuuugcuuucuucaacuucuuuaaucuuuucugccaugucuauucuguuaauuuuuauuacaguaaauuuuucauuucacacauuuuuuuuaauuaagugagcaaauuuacuuaagcaauuagagaucuguggguacauauuguuguugucaucucuagugguuugauuugugucuuuuuaaaauaucuuucacguccaccuaacuuuuuggacacaauacuguauucauguccuugucugccaauucuaacauuugugucauuucaguuuaguucaguugacugguuuuucuucucauuauaaauccuucuccugcuucuuugcgugucugguaauuuuuaauuggaugucugacauugugaauuuugcuuuguugagugcuauaucucuauucauguucuugagauuuguuuggggaugcaauuaaguuacuuggaaauaguuugauccuuucaguucuugcuuuuucagauguuuuaggcaggaacaguuauauuaaaaccagagcuaauuauucuccaccacugagaccuuucugauuaggaagccagugcccuauggauuaugaauuuuucccaucugguuggugggaacagacacuguucccagccccgaacaaguacuggguucucacuaauccuuucaggugguucuuuucccaaccucugguaguuuucucacacaaauaugcugaucuguacucugcugaauaguugagugaccucuacaaauaaaucacuguaguucuucucugugugcagcugucuccccuguggaacucugccuugcaaauucuaauccaguuugaauccugggucccaccuggguucuuucugccuauacuacaaccuaaaaaucuaucaaggcaggagccuggggcggugugggacgugccucacuuguucccaucucagggaucacuguccuuauccuucguugucugaaauccagugucuugaaaaccguaauuuuauauauuuuugcccaaauauuugguuguuucaggcaguagcauaaaccucauccuuguuacuccaucucaucuggaagcauaagucugcuucauuuauaauagauacucaauaaacacuuaacuccguccacccaggggaucuagcaauuauuauaaaaaugaaagacuguuugcauaauuuauaaugccauaauuucauacgucauuugggguuaggggaaauggcugugcauacaugacugggaagugauaaggaguuuagcucugaaacuucccuucucaguugauuuauaucacguuggauagagaguauguuguucugcuaugcuaaagcauuacuaaacuuucucauaccuuacugcaaaaagaaaucagaauacaugauaaagcaaauauauuagaaugcuaaugguaaaaucuagaugauagcuguucgcuauaaaauucuuucaacuuuauugcauugaaauuuuucguaauaaaaacauugggaauacaucauucagaaucuauacgaaacuaaucuuuggcccagaguaaauaacuuaagagcacuuccaaauccaguguuaucuuuaaaugacacuaguugaauugaauuauaaguauuaugaauuauuucuuauguauaaauauucuaaacucaaaaaauauaaacucaugcacauaacuguaaaugauuuauuuucaugcuuaucugaagaugaucuuguuaugaaacuguagaaaauuaaaauauucauuguuugaaaaguuuagacuaaauuuccuuuauuaaguauucuacaaagguuuguaaguuguuuguuuuuuuuuuaauuugagacagagucuugcucugucgcccaggcuggagugcaguggcacgaucucagcucacugcaaccuccaccucccaaguucaagcgauucuccugccccagccuccagaguagcugggauuacaggccugugccaccauacuuggcuaauuuuuguauuuuuaguagagacaggguuuugccauguuggccaggcuggucuugagcuccuaaccucaggugaccugcccgccucagccucccaaagugcugggauuacaggggugagccaccgcgccuagcccguaaguuuuuauuuccauaucuuuaacugcuauuuaggaacauauuugaauagauuguaaaaauagcaaguuauucaaaguaagaauuuucaauguugugguucuuuucuugacugucacaucauggcaucuauuuggaggugaaaucgauucuuugaaagcagcucuugcuguggaggaagcgcgagguagauuugugggaagaaggcucugcucucccuuaccucucuucacugccgagcacucauugugugccagggccagcaggaagauauuaaaccaaggacuucccggccacccagucauacuugagauaaauauuccaaagaaaauguacagcaucauagaagagcuuaaaauuaggggcccaauuaggacuguaauuauuuugcagcugagacguaaagguuuaaugagacauuuuucacaguuuccagguaauuaauugguguugcaguuaauaaggugacugaugcgugcuuuucccaggauccauuuacucucagcaaguguuugaggaccuccuaggugccaggcacagugguaggugcugggauugcugugcauuuauguucucuagaugauagcugaguucuggugccaugaaagcagauucaaacucacuuuacaaauggggaaagggguaguaucucccuuuaagacugcuacuacgauuuuuacuauucuaccuaaauuuuagguuaaguucauugaguucaucaaaaauucaguuuaagauugugucugcuuuauacauugcucugcgaaguuccaucuuuguaauaugaucucauuccacaucaaagguuccuccguuuuuucgggcauucuucagugccuuuuauuagaguuuucugcuuucuccaucaaggccuuguaacuaggucaguaauucccaggcacuuuguaguuuuugugucuggguagcuggagucuucgucucuguuucuuuuuuguauuugcuuaauuguuaguggaaaggugguugcuguugguuucauauuuuugauauuugcaugugguagucuaguugugauggucugucuguugcuucuguuuuccagcuauaucauuugcaaacaaaugacaauuuuguacuuaaauauauauauauugcgaaggggcuuaacacuuucugcccuucccagaaauguaucucuuagcaauaugacucguagaaccuaacaguuccaucacaggaggaaguguucugcaguaacuguaauuuggccuuugauggauucaucuguuauaaauccuguugacaugaauaaaacagagaauaaauaacagaauaacccuugugguuuugaacagagaacuguaaauaaucaaaccuuucuuuccuguugccucuaaaguuagacugucagcgguuuuuuuuuuuaauguaucccuucaugucuuaaaauuuuuauauguuacacugcugcaguuauguuacggcauaaauauucacucauugguaaugaaugauaacacauacagaaaggcugcaugauauugcugaauuguaagaauuuuccguaaaguugcuucuugggccauucuaguuuacaucuaauuuaauaaauuuagcaauuuggagaacaucugcaggacugauguaaguacugaaaguggaagugucagggaggcagcagaagcaggugcuuccugauauuaaccagagacgguccuggcacagauggggccgugugaaucacaugcagacauacguaugcacucacgugcgugccauuauuuucauguggaggucaaacagucagaaacguuugggaagugcuguguaaugcuaacuguucgugcauaauguuuucccauuuaguaagugcuguugcauguguuuucugugauucucaccacagcccaaugcaaaaaauaaaaaaaggauuuacgcuuuuuuuuuuuuuuuuuuuuuuuuuugagauggagucucacucuauugcccaggcuggagugcaguggugcaaucucgguucacugcaacuuccaccucccagauucaagugauucuccugccucagccucccgaguagcugggauuacaggcacccaccaccacacccagcuaaguuuuguauuuuuaguggagaugggguuucaccauguuggcuaggcugcucuugaacucuugaccucaagugauccacccgccucggccucccaaagugcugggauuacaggcaugagucaccgcgccuggccuuuacccuuuccaauggaggagaaaauugaggcucaggcaggcuguuuggucugagguccuucuucuaggugggaagaggguguagagagacuguuuccaugaggcugugcugccuuuguugggcagcgugauucugcgucugugccucugggugugcgcuggauccguaggucucauuugagagaucacagugacccugugugcugcccagaagacccgggacuccuuagaccucagagcuucuuugguguucacugcauaacguugaugucuucucuguuuccucagaccggauccaugcauccagguagcauggcagugacauuugcacacagacaucagcaccccagguuucuguaccuggggcuccugccccugauucgccccugcagcuuuuguguuaagaaauguugcuaggucagaaacccaagaagaauuugaggugauagaccguuggcccucuguuccuuccccccgccccaguauuacuuuuuacuuaaccuuuucuagagauaugcacuaaauuaaugcaauguaaugugguaagaaagguguguagaaguuaggagugcaaguuuuuuuccuuacacaugagaaaugacuuucaaucaaucagaauuggccuggaaugaaccuucccggaccuaggucggucaucagucaaggacgcuguaucagucugcucaggcugccguaagaaaauaccacaggcugguggcuuaaaccacagaaaugugucuucucuccauucuagaggcuggaaagucuaaacucaaggguguagcaggguuuguucccugcugagggccuuuucuggcuugcagacggccacugugcccucccauggccuuugcuccgagcaagugcagagaaggcgagugugagccuucuaccaucccuccuuacaaagacacuaauccuggagggccaaggccccacuuaugacuucauucacccuucauuauuuucucugaggacccaucuccaaauccagccacaccaggguuuaggucuuuaacaugaaugugaggaagggaggccacaagcauugaguccaugacagacacugaaaagaggacauuguguucagagcaagccaucugagucaccuugcaggcccucagcucagcaucaaggauucagugagugugcagguguuugagacggggccuagcugcugggcugacugucacugugcgggagagcuucaacuggaaacccuaaucacuagcuuuccugcuaguagaaaccaccaguuuacuuaggaaucucagcugacugggugccucagucagggcugugcagagaaacagcaggagagacagagauugagaucucaaggacuugccuucugcagugggugaguccagcgggcaggucuggacuccguggacaggcagcgggcacgagacuuggccgugguggacacugcaggccgcagguggacucuccucagagaagcugcaguuugggucucacaggccucucagcugacugguugaagcccccacauucucaagagugaucgcuacuugaaguccauugauuauagguguuaaccacaucuauaaaaugccuucacaggaacacccacagcaguguuuggacagcugggcacuguggccuagccggguugacacauacggccagcuggcacagucggggacauuuuacuuuuuuucaguuaucgccuuuaaccacgaugggugaaaucacacuuuccugugccuaaauaacaucuuaggcaaguugguuaacuucuuagucaucccuggucacagaaauccaaucuagguuaaagcuuucaucucagacccucugcaaauggcaucuaagccgcaccccaggcagccuggccagggagggacaugcugugggagaggaggggaagcaaggguggcuccgagccccucuugcccgcccucccccggggcuuugagcagaacccagagcagaggggaagggcagcugccuguucugcucaguugcucccuguggccucggccagaaugguggucucuuccucuguggcaugucugugacucuugggcagcaggccucuuccagagggacggcuguuuccucucccccaagaccuacagccucgucucugggugagcugaccccucucucccuuggcagcuuccugggcggcguggcccuacggcuccugcucuggccucuguaucccugaugggcagccccagaaaccucggaagcagugaccgugcuuuccuuccaggcgccaugguuccucaggcccugaugucacaggcuguucccagagucuccugccaggcauaguccuguucacagauuccucugccacccagaguucgugcccaggcucugcccuccccacacugugcucugccccugucggcaccaggccgggcccacagcucuaacccaccgaagaacaaagugccaucucccuuuccugaaggugacccuguccugugggugacuggacccucaccccagucucuuggcuuugagagagaggguagaaaccccaguucacgaaugccacacuccccguaggagcuaaagacucaauucagacuuuccuuucucugcccuucauggcccuggaaguuauggagagcuucagcaguggcugcuaaugacaggacccugggaggacauggcggccugcccaaaguguguguguguguggccuuuccuuaauaguugagcuuuuagcaucugcuuguucacgucugugggcuuuggggucagggugccaggaggggcagacuagaccccugucugcgccgagugccugugggccagcaacugaggcagggccguccaccugucaaucaccguucuuugggaggcuccuugcagugcccuauacacacacuagcuucacagaggaggggacagucccuggagaguagacauugccagaaauuauaacaccagugagagucagguuaacucucgguuuuagauugcaaacuuuugucuuuguaccuaugucuuaggaacauuacucauacuuuuacuagaaguguuuuuuaauuaguuguuccuggcuuuucagccccuuuuuucaucccugcguuucuacaguauccgugaaggccauuacaguuggucuuuacgucagcuccccucucagaugacacagagaacaagcucagaugcuugauacucagaugcuugaugcucagagcuuuuauagcugaugacuuucugaaaaaugauauuaagguuuggaguucaguaucaauaccaguaaagaagggaagaaacaggcaggugcgguggcucacgccucuaauuccaguacuuugggaggccgaggcaggaggauugcuuaagcccaggaguuugagaccagcaugggcaacguagcgaguucuugucucugcaaaaaauaaauaaaauuagcagagcaugguggugcgugcugguagucccagcuacuugggaggcuggggcaggaggaucgugugaacccaggaguuggaggcugcagugagcgaugauggccacuguacuccagccugggcagcagagagaugcccugucuuuaagaggaaaaaagaaaagggaagaaacagcaguggugacauugaguauuagcuuggucuuuacaagacuggguaucuaaagccagccaaguuugcccuggacucucuagaaacaucuucucguuguuaucguagagucagauuuuaaucuuuuaugucaaagguuuugauuuugugcuucugagaguggugggacugggguugugaucaccuauaagagccauucaccagaacccaguuauauaacuggcauacgauccguucagagauucaauaagguaaccaaucauauuuagacuuaguauaaaagaggguugggcauggugacucacgccuguaaucccagcacuuugggaggcugaggggagcggaucacuugaggucaggaguuugagacuggccuggccaacauggugaaaccguggugaaaucccaucucuacuaaaaauacaaaaauuagccaggcaugguggugcacgccuguaauucuagcuacucgggaggcugaggcacaagaaucacuugaacccgggaggcagagguugugaugagucgaguucgcaccacuacacuccaaccugggccgcagagggagacgucaccucaaaaauaaauaaauaaauacauagauuuaguacaaaauaaaaauagguuauaaauguaugacauggaaacaguaaucuuuucuguuuaugucacugaucugucaguauguguuauacaaguccaaacagacugagagaaaucuaacagcccaugccugggcgcacagccaugcugccccuaccgauccucugugccccugagcaguccuuucucuggaaaugaucuuagcugccgacucaaaggucgucccacucugacuguugcuuuccucaucguugcggauugcagaggauguuggugccauugucacacggguccucccugcgugacgcagcccuugccauuuccagcauuuucagcugugaaucucugcugcgucuuucgucaucucaucccuuucuuacucucauuuugagcauucuccuuggucuugcacccacuggauaguauaagaccucagaagucaucacugugccaucagccuuuguugguguugguugucauucaaaguuugacagucaagaguccaaguaacuuugguggucaacuugcgugcgcaccuguccaaagugauguuuccugcugcaguuuugauccaggcucucucugaggacccacacagcuucugcguuuugaggauacggaggagcuaaguuaccaugggaagcggcuacuguuagaauuaccuaagacuuuauaaaauguugucuguaaauauuuuaaaugcccugauuguaauuauagaauauguggauuuuaguuugcaguuaacauguuucgaacauuaccaccuuccuccaauccuacgggagcggaauuugacccggaggaagaugaaccaacguuagaagcagccuggccucaucuacagguaucgggcucugggugauagacucggagggcacuggugacacaugggaauggccugggauccacagagcgggcgcacuggucuggccagauggaccucuccuccucaguagcaugggccucguaaacccauauguacaagaaaaauauuucagcagaauaaaguuaauguguguguuugaccacuuuacaacagccagugaagauguguaauugugaguauguucucagugaagauggccgcuguguugauggccguugaauugaauucaggcccagagguccuaagccaacaaucucccaguuuuugcuccucauauuuaauaggugccugcugggcccccagguccugcgcuggccacugccuuuccccagggcauuuguaaggcagaagguugguuggcaaggaggcgccagggucggcaugagcagagcgggggccaggugugcgggugggagggccauccauccgugacaggcggcccacgcugucccacccagcaugucugcacagggaaagaauugucccagcuccaggaggucaugauucuggguccacaucuuagggcccucuuaccuggcagccccagaguuccuguguauuugguuggcucugcgccuuggcauugugggacacuccuaggcgacaggcugcaaauccccccugcagaguugggucauggcuugguuuguggcaucugugcccuguagucccugaacaguguacuauaacugaugacaucagccauggagaucauuuuguuuaaaugccguuuaaggguguagucuguggguuucaccaaauaaaauaauuaccaucaccauuuaucauugaauuaagccauguaauuuagcauuaauucuguagauauguggcuuugagaggcuaauauuugcauaccaauaaagauucaauuucugguauauuuuaaccgccauucaauaaaaucucauguuauuugacucauuguuuuuuuuccuccuagcuuguuuaugaauuuuucuuaagauuuuuagagucuccagauuuccaaccuaauauagcgaagaaauauauugaucagaaguuuguauugcagguaagguacaaauuagcugacacucugaaagcccugauggaaugaugacacccagccacuaagugucuuuuucuucucaaagcuuuuagagcucuuugacagugaagauccucgggagagagauuuucuuaaaaccacccuucacagaaucuaugggaaauuccuaggcuugagagcuuacaucagaaaacagauaaauaauauauuuuauagguaagucacguguggauggcguuguccuuguguguggugaugcucauuuccccccucgaugcuccccuaccccaucgucuccucugacaggacucagcauguggaggggguuucucaaagccuauuugucaugugcagguggacccccuugugcacugugugcagggggcugcugggcucauccucccugccuuccuccccucuccccacagcucccuccugagccaccaagcuccccagcgccucauccugggucccuccauuguuccuguuucuacugaaaggucaaguuuccuggaaauguggaugaauugguuccauccagaccaacuguauuagugaagguucucuagaaggacaggacgcauaggauagaugaauauaugaaggggaguuuauuaggagaguugacucacacgaucacaaggugaagacccacaauaggcugucugcaggccgagucccaaaaccucaaaaguagggagacggacagugcagccuucagucuguggcggaaagcccaggagccccuggcaaaccacugguguagguccaagaguccagaagcugaagaauuuagaguccaauguucaagggcaggaagcauccagcacaggagaaagauggaggccagaagacucagccagucuagcccuuccacguuccucugccugcuuaauucuggccgcaccggcagcugauuagauggugcccacccagguuaaggaugggucugcgucucccaguccacugacucaaauguuaaucuccuuuggcaacacccucacagacauacccaggcacaauacuuugcauccuucaaucuagucaaguugacacucaguauuaaccuucacaccagcuuuuuccuucuaccugugcaucaccucauucuucccguggagucucagugagaggaggcggggcaagaagugaugucauucaucuguagaaagccugagaucugugcaccucgguuaaagguuuggagacucccacugugcaccaggggagggaaagccccgcuggagcagccgguggaggaggacagaguccaguggcaggcccaccuccaggcccgccccuccccagccagccucugcucagcuccaggcuccuuccacgccagggcucuguagccaguguuggagccuccuggaaugucuuuuuuacaccagcccuucccucagccucccaggcuuccugaaacaucccuucacugggaggcucugccugacuuggcggugggucuggucucccgcaagggcagccaccaugucaguugauuugucgcacgccccaccccacugccaguuucgugcuccccacugcgguggcaccaagugaaugucaauagaggaaacaguuccuguuguuucuuuuuguuccuggaaaguucacuaaaugagcaguuucuucuacaaguuacagcuucucuggucagcuugccucuaaggcaucugacuccaggauguugcgagguagugacacauccuggugaugguggggacgguaugauggcgugucucugugagauaagagcaugagcaggucccacacagccucgcugcagggccaggguguggacagagcacgggccauggccuggagaaggggccaggugucagccacgcccaacacgggccucgggguccuuucuuagucacagugaccacgggaaaagaaaaggggcaucugagacagacagauggcagaugagacccccccugccaaaacccacagcccuggccccucccaucccgugccggcuugcacagccugcgucgggagcacccugccuuuccgucugcagucauuagggcccgcagccccggccucucccaucccgugccggcuugcacagccugcgucgggagcacccugccuuucccucugcagucauuagggcccacagccccggccucucccaucccgugccggcuugcacagccugcgucaggagcacccugccuuuccccucugcagucauaaggguugcauucccuccugaccugcacaccugauagggcauuucggcgugagagccuuugauuuugcguguggcuuuccuuugaacuccuuccaaguaccccacaucucguuuguaaaauggagcccggugcuggacauagcccagaccugacacauuaacuauaacagagaaugaugucacuuuccuaaauguuauguuucuauuuuauguuucuugguaucaugauuccuuuuuaacaagaucauuacuugccugguauacuuaucuaugaaaacauaauauacauuauuuaacauacaacagguacaauuuaaauuuccagucuucuugaccuaaaauuaaagcucuaccuaacauauuucuguuuucuuaauucuaguagguuuuguucagauagcagaaucacaaaucuauugaacaucugcauuuaagaaguagaaaaugggccgggcgugguggcucacgccuguaaucccagcacuuugggaggccgaggcgggcagaucacaaggucaggagaucgagaccauacuggcuaacacggugaaaccccaucucuacuaaaaauacaaaaaauuagccgggcgugguggcgggcaccuguagucccagcuacucgggaggcugaggcgggagaauggcgugaacccgggaggcggagcuuacagugagccgagaucgugccacugcacuccagccugggcgacagagcaagacuccgucucaaaaaaaaaaaaaaaaaguaguagaaaguguuuuguaccuuaaagaaccuuaggaaauacuuaaauagauuaguauuccaaaguuauuacgcauaauuuacuugaguucucacuaaaggcuuggugcuagaauauggcauuugugucugugugcaugcuuuugauagucuuuucuguaauugugugcaugcuuuugauagucuuuucuguaauugugugcaugcuuuugauagucuuuucuguaauugugugcaugcuuuugauagucuuuucuguaauuguccugauacgcgcagucaaaagcaagcaugcuaucuagauuccgugauugguuuggguccucauugucaauaccacuaccuccucauuucaugugaggaaaaaaaaagaagaaagaucuugagaguugcauucagcucaucuagguuuuuuucuuuucuuuucuuuucuuuucuccuuuuuuaaggcagggucucacucugucacccaggcuggaguacagugaugcuguacuccauagcucacugcagccucaaaccccugggcuuaagggauccuucuaccucagcuucccaaguagcugggucuacagaugugugccaccacaugcggcuaacuuuuaaaauuuuuguagagauggagaucugucucacuguguugcccaggcuggucucaaacuccuggccucaagugauccuccugccucagccucccaaagcacugggauuacaggcgugagccaccacacccagccagcucaucuaaguucaauauagaacagcugugucuuguaagaaaaaacauuuugaacauauuuggcucaacuuaacugaaaauguaaauauaagguugcuguuuauuucuaugguuuaucauuaccgucagcuuaagugugaguuaaacagugcuguccauaacccauggugccugcucuggcacacagcgggaccuggaggcugggcgggcagggcagugugccguuccuucucuugcugcauaaccagccaugggucaugcucuauccucacccuggcccugcagcaaggcugugcagcaccugcucaugcucuuaucucacagagagaugccaucaaacuguccccaucaucaccaggaugugucacuaccucacaccauccuggagccaggagccaccgccagcucaguggcuucugucagcaugguccaucacuccucacgaugcugucgucugcgcuaggcucauccagacgguucugcuccguggcgugugcuggggcuggaguguucacaggggcugcugagcagguccccacgcugccucugugaugccuugagcuccuccagguugucugaguuucuacagccacggccacguccaagaggggagaggcaggacccccaguccuccuaagaguuuggcuuggaacuggugcagagugacuucugcccuuuguguuggucagagcagggcacaaggacagcccagcuucagaggaaggagaaauagaguccaccucuucccaugaggccagaauacaucauacaggcaggaaaggcauuuagaauccuuucuggagacuucuauagccagcagguucccagcuuagugucuggggggucugauucccuuucugcugaaagagugagaaacacucucuccggcucccagggaucucuguuucccucccagggugucccuguuugucucccgcuggaaaaggaagaaggaaaagaacuguccuuauuucuucuuucuucugccuacaucaaagcagguuuaaaaaauuagaaauuaagaauuuaucaguaagaauguaguaauguugauuuaggaaaacaaaauggcuuauaacugcaagccauccuuauguaaauguuaaagcugauggaucuagaccagaagggguccaggggucuuugucucggagaggcccagaucacagcucuccaagguccaugcgagaggaauaguaaacugaagccacacggcugccguguaugcaaagggagccugcagggugaguuucguaaauuaaagcaccucucgguguagacacacacagacugacuucugcuuggucacagcuuccaagccucaggguaggugcaggcugagggacaccaggugcgagcauuuucuguuucuugucauggcaccagugucguuccugucacccacggcacugagcucugcccugguaacgucccucccucccucuuaggcuuuggccaccugcauuguugugcuacugggucucccugcuaaagguucugcuuccugguuccugcaagagcagaucucaguuuuucuguuguguuguuuuguuuuguuuuguuuuguuuuuuguuuugaaacagggucucuguugcccaggcuggaaugcaguggcgccaucucagcucacugcaaccuccaucuuccagguucaagugauccucccaccucagccucccacauaugugggauuacaggcaugugccaccaugcccggcuaauuuuuauauauuuaguagagguggaguuuugccauguuggccaggcccgucuugaacuccugaccucaggugauccaccugcuucagccucccaaagugcugggauuacaggcaugagccacugugcccggccagauuucggcuuuucuaagcuggccuuccagccucuccaugcaucuugcccaccccacuccacggcacagaccuuuguuccagccaaacgaguucuucucccucuccacacugccauauaaaaaaaaaaaaucugugaaaauccuccuucaguacccaauucaagcaccaccucucagugcauucugauguuugggaacauagaaauguuaagacccauucuugaaaaauauuucacaucuguggauguuaaggucacacuauuucauuuguuucaaacaaagugaacgaaauuucagaguugaauuuuuuaaucuucucaaacuuauuuuuggcuuagagcggucucuaaucaaaugguuuucaucugaugggcagggaucuuucagacccucucacugcaugcaggauaccccucguggacugcucuagaccaaucccaggugcacgaggcuuggggcaggagaggcuucuuuguuucuguaggagcccuuugcggggaggacauuuuccuguuuccuaacaugucccuguucccucucuuugugcccgguuuauucagcagacguguuuucagcaucaaacagaugccaggcuugcuccuagcccugggaacauagucacgagaaguccuuggcccugucuuugcaguggccccaucuggagggagacaggcuggcacagaggguagggugcguguccuggggcuccccuagaagcaggcgcaguggacagagaugucucagaggaagggagcugggucugucgcagaugggugcuucagaaagaucgcaccugagacagcacggaggaugcgugugggugucaguggggaacugggcagguagaauaagaggaguucaggaaucacuucuacccuuugcaggaacugugcuaaauauugcgggcuuuaaaauuaaguaagacauuggccuauguugaaauacagcaaaaacguaagauggauuaaugaacgaguaaaagauggaugaacagaugugcgugugaucaagcagauggagcacauugcucguggucgaaucuggugguugaaauggguguucacuguagaauucuuuccguuuuccuagaugcuugaaauuuuccaaaauaaaauauugagaaaaaaauucgugcaagaccaaguucucugcccucgaggcauuuacagcugcaggccuugaggaguuucuuugguuccugaagggcugcuugcucaccacgagcaguguuugcacaaauagaugcgcuucuuguugccuggcuccauggcuccuccuagagcauuguuuucuuauucagguuaguucagugucuaauucuaaugggaaaauuguuuuuucuagguuuauuuaugaaacagagcaucauaauggcauagcagaguuacuggaaauauugggaagguaagccucuguuauggguagcaaacggcuguagauggaauuuauaccagagugauccauuucauugaguccagcugcccgcuuuaaagcaaggcaguuuaaaccauucucuaaaagaauucaaauacaauuucacugaaagcaggaguuggugagcucuuagauuagagcacgccaaaugacaaaucucucccauuuuuaugguucuguacguagauucuacuucguauaccucaguaucauuacuauggaaacacaauuccaguuauuuccucaagagcaauguuaaaaauaguuaaccuaagaagguuuauauuagaagcuugaaagaagaauagauuguacauuugggguaucauguaaaugcuaauauuuuuaauuacuucaguuuuuuauauguauauuuauaaaauaauuaacauuucaaaacuuucaucaucuuuauccaaguaaaguuuuuaguugcccuuuuuuuuuuuuuuuuuuuuuuuucuuuuugagacucuugcucuggcacccaggcucaaguacaguggcacgaucucggcucacugcaaucucugcuucccugguucaaacgauucugcugccucagccucccgaguagcugggacuacaggugcccgccaccaugccuggcuaauuuuuguauuuuuaguggagaugggguuucaccauguugcccaggcuggucucgaacugcuggccucaggugaucugcccgccucaccucccaaagugcugagauuacaggcaugagccaccacgcccggccacuuuuauuuaauugauaacccguagauuuuauauuagaccuucuaacccacuguuucccagaguuccucagggucccaugguuaguaaguguggaagugcuuuuuccugcaccuuuuuagggauguaguguagaugggcaguuccggguucucaggagccugugguggagaagucuggcacucuggauggaucuagugacgcucugcagcuccugagcacaagacucucuucucaggguggaucagguccugcccaguaguucugagaaaagcuauucuugccacuuuagauguaauuugaaaaaauguccucgcugacaauucuuuuaguuuagacaaacuugggcgggguuucucccucagugcagugcagugaguggugaagaggaugccucucuuacuagaugugugaccaugggcagguacuucuguaagauaggcgcauccucgcauuucccuccuagguuguugcagggaccggagcgcuguaugacauguguuccacagcccgccaugccgugugcguagggcccccgugugcauagggccgccgggcagcucccgccgagaggcugauuaguuuuauccuucuuccagaugaggcugagccuucgggugacccugugagugagcacacccuccuugaugggccgcuccaggcucgcccuucccgcauuguccgcugugccgcgcagagucaguaauggaagaccaaguuagagacagcucugucuacuucugcagcucaguggcagucacucccguuugccuaauuacaaaaccaagacaauaaacuaguuguuugagacaaaaacuuugcuuuggaggcucuagguaggaccucuuuucuugcacaagggaacagcuuucuguuuuuuuguuuguuuuuuguuuuuguuuuugagauagagucucgcucugucaccgaggcuggagugcaguggcccgaucucagcucacugcaaacucugccucccagguucaagcaauucucugccucagccuccugaauagcugggauuauaggagcccgccaccgcgccuggcuauuuuuuuguauuuuuagcagagaugggcuuucaccaucuuggccaggcuggucuugaauuccugaccucaggugauccacccaccucagccucccagaaugcugggauuacagguaugagccaccgccuggcccuaacugauuuuuaaccagcucucauccagcauccacugggucucuguuaccaacauuagaauaacauaccugaauuacuccaggcagcaagaaugccuaccagauggauaaggcugagggaagguguugggugggggguggggggggucccacgugaacugucccgucuuccuggccuguuuagggaggaagauuuugccaccaggagcuccugcuguugagccagcucccugcuguucuggguaacaccuguaaacccagaauuuuuaaauuauguaguuacaaagauaaaaauaacuauacuuccugguaggcauuuagcauuuuuaaacuuuuugcugguauccucuuuuuucugauacacacacacauacacacacacauauguauauauauaggaagaauccucggauuucccucuuaggcuguugcagggaccggagcacuauaugaaguguuccacagaccccuauauaggaucucgcuauacuacccaggcuagagaacaguggcucuucacaggugugauuauagcgcacuacagccucgaacuccggguucagaugauccugccgccucagccucccaaguuagcuggggcacaggugcauggcaacaugcuuggcuacguauauuuugccugcuggguuuugauggugaaaacaaaaauugaaagacggcaagauauuuguuuaaaaccuggaauucguaaauguucaaaccuaauaaauguucuuuuuacaguauaauuaauggauuugccuuaccacuaaaagaagagcacaagauuuucuuauugaagguguuacuaccuuugcacaaagugaaaucucugagugucuaccauccccagguaaggggcagcaggacucuaggaacacagcuguuggcauuugaucaggauugaacacgagauagugaauccggccuugacugagagugcuuucuucuuuauaggccuguacuaacuuugguaacaaacuucuggugauaaucgaaagaauaaggggguaaagagagauuccuuuuaagaaauucagaaaaaucucuguaauacagaauuuuucaguuuuaagcauugagaaaggaguaacucucugaaaggagucuaggaagacuucugagaggaguuuucuguaguguaaucuaaaauucaguaccuuaaagagaaaagccuauauagguccauggccaaugaauggccuaugaaaacguuuuuuaaaaaaauaaagcugccuauaaucccagcacuuugggaggcugaggcggacagaucaccugagguugggaguucaagaccagccugaccaacauggagaaaaccgucucuacuuaaaauacaaaacuagccgggcaugguggcacaugccuguaaucccagcuccucaggaggcugaggcaggagaaucgcuugaacccgggaggcggagguugcagugagccgagaucgcgccauugcacuccagccugggcaacaagagugaaacuccaucucaaaaauaaauaaauaaaugaaugaauaaagcugugaauuuuuuaaacuguaguaaucuaaguacagcuguacugaaaaauuggucaauaagugguuaauggacugcauuuaccuggauuugguuuucucucacucuuuggcugcagugggcgucuuuguucacuuccggcugucacagggccaggcacugagcagucacgccccagcacaggcacaggggugcacaaggcuccucucugccaggccccacuuucagagcuuaugguaggggcuaaaugacaaaaaguauauucuuuaauugauucuuccuagaacauauuuauuuucucugacugcucuuaacugguaauaucuuugcauccagccagauuaucauauuguuguacaaaagaaauuaauaguucagagauuuaagauggaaccagauuuuaauuuguuguuccccacuguuagaugacucguugauuguagucugcacaaggaccccaagaaaaucccaucauacuggauugacuuagcggugguuagacuaaaaagacuguuuccugauuuauuuuucuuauuuuuauuuuucagcuuucugaucuaucaccaauuaaugggcauaaauguuaaugcccguuaaucacacaagggcuuugucuguaccguggguccuugucuugcugugggaagguguuuaacgaugauucuagaagaagcacagcagcauuuuuauguugaaauguuaaugcucuuucuccuuuuacuuuuuagcuggcauacuguguagugcaguuuuuagaaaaggacagcacccucacggaaccaguaaguacugaugcuagcgcgucuuguaagaugugugcauuucacuaaauguaaauauuacaacaucugcuucaccaaauugccauucauucagacuuuuucaucuuaaauugcaauacuaauaaacaggcucauuucauucauggguuauagguuuucaaaguauagucauuuuaauugcagauuccuuuauuauagugauuauuuuauguaaugagauugccaccuugucccucguugcacuuuacuguuugaacguaaagcacuugagcgguuauuguagccacuaaauuuuagugugcaauucaguaguuucacaucugcuugguuugacaacauauugaacugauuaugaucagaggaauuauaguuaggguuugaaauuauuguuguacuaaagaggcuuuaccgccuugaaaauacuucccaaguuacacuguaacuauuuuaugaucauugaaucacaagugaacguuagauuacugcuguucugugcguggaucuguaauuuuuuuucagccuccauaauuaugucagaggauuuauaauuuucuuaacauuuuauguuuauuaaaauaggcuaucauagccaggguuaacaaagccagacaugucaggugccaguuuaagcauuuaaauacauuuuuugaaacaacuuuauugagauauaauucacauaccacacaauucacccauuuaaagaguacaauucaaaaauuuuugauacguuacauuuugaauuuuuuuaaauugugguaaaauacauauaacauaaaauuugucauuuuaaccgcguuaaauguacaguucaccagcguuaaugacauucauaguguugcgcaaccaucaccacuauuuccaaagcuuugucaucaucccaaacagaaauucuacccauuaaacaauaacucuccguucucccucccucuggccccugcugaccuguaaucuacuuuaucucugaauuugacuauucuagguaccuuauauaaggagaaucauaaaacgcuuguccuuucacaccuggcuuauuucacucagcguaaugucuuccagggcucauucuuggguugcguaucagaacuucauuccucaucaugguugaaugcuguucuaucauauggauagaacacauuggguuuauucauuguuuuuucaguguacaccuggguuguucccaccuuuuagcuauugugaauaaugcugcuauuuggauacugguguacaaauauuugcuauaauccccauuuucaguuccuuuggauauauauccaggaguggaauugcugaaucauaugguaauuguauguuuagcugcgggacagacccccauacuguuuuccacagugacugucccguuuuacauucccugcagcaaugcacaaaggcucccaucuccccacauucucaccagugcugaugcugcugcugcugcuguugcuuucuuuuuauuuauuuuauuuuaucuuauuuuuuugagagaaagucucacucugucacccaggcuggagugcaauggugcaaucuuggcucaccacaaccucugccuccuggguucaagcgauucuccuaucucagccucccaaguagcugggauuacaggugccugccaccaugcccggcuaauuuuugcauuuuuauuagagacagaguuucaccauguuggccaggcuggucucaaacuccugaccucaagugauccacccgccucagccucccaaagugcuaggauaacaggcguaagccaccacacccgaccuguuguuuuaauuauagccauccuaguggugugaaagaguaucuuguugugguuuugauuugcaguucccuaaugacugaugauguugagcaucuuuucagcgcuuguugaccaaaaucuguauaucuucuuggccgggcgcgguggcucacgccuguagucccaacacuuugggaggcugaggcgggugaaucacuugagcccaagaguuggagaccagccugggcaauauggcaaaaucccaucucuacaaaaaauacaaaaauuagccaggcaugauggcgugugccugggcaacacagugaaacccugucuccaaaaaaaaaaaaaaaaaaaguguauaucuucuuugcagaaauguccauuuaaauccauugcccauuuuuuacauuggaguuuuuuuuuaauuauuugaguaucaaaguaaggaauguuaggaaccaauucaaauguuugaaugcucuuuuaaaagucacuguuagacuagaaaaaguagaucuugucacuccugggcccuuucucucuuucacaguucuuuugugaaguuguaauuuuuauagugaaauugcaugagaaauucuuaacauugaauuucugaguuaaacuggcuuuugggcucugcuuucuuguaaguuuuuaaauucuauguguagauucccuccauuucacccacaaaauucaagaagagcucuuguccuaugacugcagagguagcaggugcuacagagccacgagcugggcccgcccuguccugccgggcccucguggaaggacgcaucccugcacacucucccuccagccccuagauaccuccgccugagauuuuggggaccucccaaggaaauguaccaaaucucaucacacuucagcaucaagcauagucaaggcuuagggugaggagguguuauuuuuauccuucuuaacgacugaagacauguuuagguaggaaaaagaaaaaugaacaguguuaauaaaacucauuggggauuuuuuuuuuaaacuguauuuucuccagugguuacaugcccuaacucuucugccuauaucugagguauucuccaaacugaagggugagagguuguauuuuuuuuuuuuuuugagacaggaucucgcucugucacccaggucccacaauagcccgucugcaagcugaggagcagggaagccaggcccguuccaaagcugaggaacuuggauuccgauguucgagggcaggaagcguccggcacgggagaaagaugcaggcugggaggcuaggccagucuagucuuuucacguucuucugccugcuuuauauucuggccucucuggcagcuuagguggugcccacccccauuaagggugggucugccuuuccuagcccacugacucacauguuaaucuccuuuugcaacacccucacaggcacacccagugcauccuucaauccaaacaaguugacacugaguauuaacuaucacagagguuuuacuggagaaaguaauauguaaaaaaaaaaaaaaaauuuaucucuccccuccucucccaccuuuuccuauucaaaaauaaaagacaacugggcacaguggcucaugccccuaaucccagcacuuugggaggccaaggcaggaggagcccuugaagccaggaguuugagaccagccugggaaacauagugagaccuccucucuaccaaaaaaaaaaaaauuuaauuagcugggcauggugacauguaccuguggucccagcuacucgagaggccgagguggaagaguuguuugagcccagggggucaaggcugcagugagcuaugaacgcaccaacuucacuccauccugagugacagaguaagacccugucucaaauaaauaaguaaauacaaauggaagggaaaaaaagcuauggaaggagagauuuuugaaaguauguauuuuucuuucaugaauuuucuuugugcguauuucucauauccuguaguggcugaacaauucaccaaaugccacauugcguuuaccacagacagaggcugcucccaccuaagccacugucccagcaucucuaucccgccauccacugucugucagccugacccuaaccuucuccaccgagggcucggugaaugagccucacccuauucucucuuccaccgaaaaguaacacaaaagcagagaauguuuguaaaaguuuuuaauucccacuaauauaguaaauaaagugaauaucacuuugcaagagugagagcuguuaauugcaguccugucuaaaagagggcaagagaccccgugccggcuucaguuggguccuuccggcguaaauguuacaugcaggacucugacuuggcaccagcacaaaggaggugcaaaccccaccaaccuaggccccgauguucccacccggggacacuucauugcuuaguuuccugcugcacagauaauguaauaguaccguccuggcuuuagaaagcagauucaauuuccuacauguuaagaacauucagacccucaugucaguaaauucccucuuuugaaaugccuauuuaugaaaacacaaaggccauuuugucuuauuucagcauugaaagcuuguuaaugagaugaucaaaguauaggcuuuggugcagguguacaucucuugguagcacuaaggacaccugguguccacguccaucucccaggccugcaccaaagggacuccugaagccaucaaauguccaggcucaggaauguuuaaaguaagauccacuuagaagacugagauaugaaggacauguguugccccauuuguagccuguaauuaguauuuuucauuugcuaauuguguacagugcucaaaagcuuucugggcacaugaaacacuuucucuguuggaagaauaacaaaagcucaucagagauuuuacagaaguaaaacuguguuccguuuucacccaccugccucuucagucucaucacauuuuacuacauggcauaguagcggcucuccuuucuccuuggucuaccaggacaggaagggggcuccccaagacucaaggcuggggccacuggcucgccugcccucugcagggagcgggcaguccuugggcuuccaaaggaaaacucggggccuugugcugcacccagcagcacacagccauuguugccucggauucacauucccugaguagacacccuccuccacagagcacgccacacugacgcagcaaaauagcugauaccgaucacagcucauuccaaacaaugugaacaggaaggcccgugugugaauccgaucccagaaaugauaccuuuuccagagaaauggaauagcuaaaucgguuguguuguauaguucacaaauuaacauauuucuccuaauaaaauuccauuugacaaaugaagagaaauagauguaggaagugauuuccaucugcuguguccuuaauagugauuccaauacacgcaaagugugguaggaacacaauaaauacuuauucaauaguuuugagcuaggagaaccauuaaaugaugcauuuuuagaaauaauuccuuuuaaagacacuuguaugguagauuuuuaugucagacuugaaaacuagcagcacuuccuuuuuuauuuuuauuuggcucuuuugggguuuuuguuuguuuguuagauucuuggaguacaguggcgcagucauggcucacugcagccucaaccuccugggcucaagcaauccucccaccuuagccucucgaguagcuaggaccacaggugcccaucaccacaccaggcuaauuuuuaaauuuuguguagagacaggaccucaccacggugcccaggucggucucgaacuccugggcucaagcauuccucccaccucgaccucccaaaguccugagauuacaugcgugagccaccacgcccagccuuacuuuccuuuguuucaugaauuuuggaguuuuauaaaguguaauaucauaaaagauuaccugggagcccaaaugccaaagcaucaaaacaaaauuuuucuaaauggauguuaaauguccaccuuuuuaaaaaaucacuguaaugacuaaaaggcuggccugcuaagccaugaguuggugcgaucuacugagcuggaaaugacuagugagugaaaacgaccaggcggucccgggggccagcacuuguggcaauugcacagcacaagagucggguagaagccccgcgguguugcugugacgaggccaaagagcugcucuaacgcaccggauugcacuuguacaauucaguguguaagcacauauaugcacuucauaugcaaaugccuguuuuggauuguuguacucuuuuagaacuaagauggcuaaacucuaaaaauauuaugaaaucugcauggauucacauucaguauuuuguacugguaugauugugguaagacauuuggaaacuacaggaacauauaaagaaagguugcccaguggaaauucuuucuagcugucugacuuggccaaggaacauaaaacauccacuauccacaaacugggaaaccacugcaguccgacgggcugugccuggcagagagcugguggcacagacccucuggguggugacaauccuggcuacagcugccacugcagccugcucaccgcaggcccagcacugcucaggcuguuguaucugacgcccacaggugugcgcacagagagcacaguacgcccugcccgggaggucccaucgcaguaccuguggaugugaguuaauaaggucagcuuaauucacaucacuccuuuugauauauuuuaacacaguugaaaacacugucuaugcauacagaaguauguguguuuguguauaaacacauauggaugguugauaaauuugagaaagaaauggguuguguacacguggcccacaguuucaguacuggcugcuuccacaacuaaaauguacacaugaauugauaaugcucuguguuuucuccguugaucuuauucuuucuaaauuauuguccuaacuucuuauuuuuuuuucuuuuuuuaaaaaaaggaauggacucuuacugaaaugguguuugaucagagaaaguggguuauauaaacuaaaauuguguaauuucugaaguguauaaaauuaagccaggcaggugguacgugccuguggucccagcuacucagaggcugaaagaggaggaucacuugagccaaggaguucaaguccagccuggacaacauaaugugacccaucucuaaauaaauugauugaucagauagauaaccagacagacagaccuacuucucaaauacagaaaaucacauaugaugacugagucacuguucccucuguaaggaagauggcaccaucuccguguguugccuugcaguggggccaccgcagugaaaacacagacuucuuaccaugcagguguuggggccucgugggcaucagucacuccacgugucauuucuuuuguagguggugauggcacuucucaaauacuggccaaagacucacaguccaaaagaaguaauguucuuaaacgaauuagaagagauuuuagaugucauugaaccaucagaauuugugaagaucauggaaccccucuuccggcaguuggccaaaugugucuccagcccacacuuccagguauguggggcuugggggaccugauuaaauucuuccaguguucauuugggaaaggaaaaguuccaugcguagcuggccaugcuuugccucucaugcaauuuaaagguaaaauccaaguuuuuacuugaauuauacuucaaauacgaugcuguaacuugaauucuauagaauacccuugagcaucuugucccuucugccgcgauacuuuuucucacuaagagcagucaucuggcuucucuguaaagcugucuuuaucuucauguucagugugcuuccaaguucauaaacacccuccuuuccacaccugagcaucaauauugauagacaacggguggccaaagccucggcucugagaugcucuugcugccgaggcccuucguuccugacacuguguaaaucugucucccuuuacccuuucaaaaaggcugagagcucugacuuuugucacugccaaauuccugugcgagaggacgaccuuggucagagcuacuuucuacuuucuuuucccaauuuccuuaacccuucaagccagccucggcucaucaccucuuuugaaggccacccccacacaccuucccagccugccugccucuguuggacgugcuagccaccuguccuuuugcaucauugagcggauuuuauugugcacucaucaugaacaaggugaaaauaggcacaaaauaagcaagaccucccggugcccagggagcaggccacacaguggaagagagugaccaugucacaccaccaccuuacagccaaacgugaagggccagguggcgugugcagcaggcucucagaaacacaugggcaguuaccuuagcacaagucuaagugguuagaaaaaguccacaagaaugagggguccuccaaacugagccuuucaagaugguuuuggaaagagaucauugaaaccaacaaaacuaagacaagaaggcaagugauagaagaguaagaagcucuggagcacgggcagccauaguaaagugaggccaggcugagucggguuaaaggaaggaacugcugugguguagucucuuccauacaaauauucagguuauuuucauuuuauaaauuccaaugaguuuucacauuaggaacuaagaaaggaaaauuauguuuuggguuuuuuuuuuuuuuuuuucaucaauccuggccuacagagaaaauaauguuucucaaggcuuucagugugagcacuuugcacaaaggagcaugguuuccuagaaacuguagagaccagcgccacggagcccuggcugaaguacagggcguucguaugccaaggagagacuggcagucgugggaagugucccaaaaacuugagccccuuccccagaugcaaaauuagcuaucgcuauggguaacguuagaccuucaagagaagacagggacaaguggacucacaaugugcuguuuugcauaaaagcaugugacagggcaaggaggaagggaaguccagguggggaaagcagagccaagguggccgcgcagcugccaguggcuugggugccacuccacaugucacagaagccuucacgucccugccaggaacagagcaugaaggcugccagggcggccugccaugccucugaugagggaguucagugccaggacccacucaggccuucagcugcaggcccagccccccaacucgcccucgucugugucccccacgcacgcuugcgcccaucuuggcuucugcuucuuagaggaccugaucagcacagaguacauuccagaaucuuuuccagacacauaugcauaaggccaacucauucuuaauuuuuuuuuuuuuuccuuugagauggagucucacucugucccugaggcuggagugcaguggugcgaucucggcucauugcaaccucugccuuccagguucaagugauucuccugccucggccucccgaguagaugggauuacaggugcgugccaccacacccagcuaauuuuuguauuuuuaguagagacgggguuucaccauauuggccaggccgaucuucaacucccagccucaugauccgcccaccucggccucccaaagugcugagauuacaggcauaagccaccgcgccagcucauucuuaacuuuuagauguuuuuuucacacccaaaaaaaguacugguuuuaaaaacuggaaaaauuuaaaguuuaaaccaucaagcaucuuaagcuucuguuuucuaaaucaggcuuaaaauauuacccccaaauauauuggugggugguggguggguggauggauggauggaugguuuuguuuuugguuuguuuucuuuuuagacaaaguuuugugcuuguugcccaagcuagagugcaaucucagcucacugcaaccucugccucccagguugaagugauucuccugucucagccucccaaguagcugggacuacaggcgccugccaccacaccuggcugauuuuuguauuuuuaguagagacgggauuucaccauguuggccaggcuggccuugaacuccugaccucaagugauccaccugccucggccucccaaagugcugggauuacaggcgugagccaccaugcccggccuagaugguugcuuuuuaaaguacaagguauugaacucuuaaguaagaacuagccuaggagcugugaugcgauugugccuuguuuugaauccacgccgcacucucaugcaugcccuccccucccccauuaccuaacucacuccuuuucugcaaaguucaucccagcucacugccucugaggaaucagcccugauuccugagccuggcacaggcucaccugccauucucucagcaucccacccauacacaccgcaccacaaccucaggaucucuaagcuguaggcuucuggcaggagaagcgucagccccaugcugcucagagccuccaagugcugcugugaguugugugcagaugaaggguguugacaguaguuauacaggugaagcuccucuucccagaggcauacaugcugugauggggacaggccaaguguccuggugacugccucgaacucccagauaguucuguggaacgugcacuugugugcugguuuacuacggagagaaaaagcaaauaggguaggguaugaacaguguugaaucuggguggagggaggugggcacucauuauguuagucuugcagcuuugucuguuuuugaaaguuuuaguaauaaaaauggggggcugagugcaguggcucacgccuguagucccagcacuuugggaggccaaggcggguggaucaccugaggucagaagcucgagagcagccuggccaacauggugaaaccccgucucuacuaaaaauacaaaaauuagccaggugcgauggcgcaugccuauagucccagccacucaggaggcucagguaggagaaucgcuugaacccaggaggcagagguuguagugagucgagauagcaccacugcacuccagccugggcaacagagugaaacuccaucucuuuuuaaaaaacaaaaauggaugggcuaggcgugguagcucacgccuguaaucccagcacuuuggaagaccaaggcagguggaucaccugaucucaggaguucgagaccaaccugaccaacauggcaaaacccugucuccacuaaaaauacaaaaaagccgggugugguggcgugcgccuguaaucccagccccucaggaggcugaggcaggagaaucgcuugaacccgggaggcagagguugcagucagccaagaucacgccauugcacuccagccugggcaacaagagcaaaaauccaucucaaaaaaaaaaaagaaaagaaaaaugggggaaccacccucuaguggcuucccgugaguaagcgccagugcacucaggcccuguuccccugcccuccuacuguucaugcccccacugcccucugcagugguccucagccagccccgugcugacaacucaggaccucuccucccucugguccuugcucagaugucaccuccuccccauugaagccaccccaccgcacacgcaccgccgcugccuguucuccugcccugcugcccuuuguaugugacuuaucguuucuaguaaauuaauaaucauccaucaccugucuccuccccacuagaauguaagcuccguggagucaaggauuucugccuugcuuuguucagugcugaaugcucagcagaacacagcacgcccucuugaccugacagaugggggaggcggguggauagguggaauggccuccuuugaguugucuccucagcaucuagccagcaucuagcauaaauguuuacggaauaaguagagaaauaggugacaauguucuugaugaguugauguacaagaaguugucugccucuuuguugaaggcucuucaggguuacagguuacagucuagaauauuuugaauuuguagaaauaaucauaauuuucugguccaagguaguucauuacccgacucacagguuuaacagcaaggacagccaccugaugucucaggcacaaccuccagcaagccauccacuugugucuuucagguggcagagcgagcucucuauuacuggaauaaugaauacaucaugaguuuaaucagugacaacgcagcgaagauucugcccaucauguuuccuuccuuguaccgcaacucaaagacccauuggaacaaguaagaaagaacuggcugccaucuuuuucagucauuuuaaaauauggcacguuuuacugcuacuucaguaagaauaaauaucagaauuuuaaauaucaauuaaaaaacaagaaggucaguugcuuuguggacucauaaauuaaguagcagcguggguuguuucuguggccguugaauuuaccaccuuauaccuucauuccugccaguauagaggcacauugguuugcagccaccucccaguagcagcaguuucuaggccucuuccugagcguccugcagagaagcugaaggucucugcagagcccaguggggcucagccccggcgggggcacaguggccacugcauucucggggugucuauugagcucugcugacaugcacccuggaugagccccugugugagacccaagaaccaccccacaguggucacuaccuggagaagaagagggaagccaggugaucugaacacagccccauagucccagcagccaaaaacauuuccuccuacuccgcuccuucaucuuuugacuuaaagaggaugaauaaauccguuuacugagcaauagucuucugagacuuuaaaaggaaacuguugauaugggugccacauuauuuauuuauuuuucuuuuuuaaaauuuguauuuuauuuguuuauuuuuagacagggucuugcuauguccccccggcuggaguguagugucacgaucauggcucacuucagccucgaccuccugggcucaagcaaaccuccugccucaggguccugaguagcugggacuacaggcacccaccgcuacgccuggcuaauuuuuguauuuuuuguagagaugggguuuugccauguugcccaggcuggucucgaacuccuggacucaaguauuccaccugccucagccucccaaagugcugggacgacgugagccacugcgcccaggccauauuauuuauuaauaugguaucaucuaauauuccugcuauuuaaagaaauacgacugaguuuuucuuuccccaccuucuuucaucucuuuccauuguauauuguaauuauaacucagaacuuaaagaagagcagguuaugcuauccagcccuccucccuuaguuuaugggugaggaaggugagacuuggagggcauucgcagcccagucugcggucccaaagcuggugagcggcacucuggcccggugcggucuccuaacucgcagugucuauugggcaccccucuggcugugcugcacagucacccugcugccggcggaccagcccucucccaugcacccucucuccuuguccgcucgaggcugcagguggcacugccuccuucccagaauucugcagggcagcagccagacagguguuagcccuggagcucugagccagacccccgagcgagcguccagccaguccacucgcgucaagucuucugaggguugccgcccagaaauucaacagagaagggcaggcagaucagagugaggaugacuuugguucacauuccugccuuccuccugagcagcugucugaacccggggaaguuagcucucaccaggucuuucuuagccacaguuucucuuuggaaaaacugagaaaguaaagugcuuugccuugcaacaaucuucacuugguugugaggauuaagauaaaguuaauaugcguaaaguaccuggcuuaugauaggcaccaaguaagcauuugcugucacuuagugguuguagggccagcagccaugcugauagcaguggaggcagcagccaagacccucauggcaauagcguggugguuguaguuguuaauacagcacauccacccucaacaaccuguucuuuguagcauugauuuauuuuauuuauuuauuuauuuuugagauggagucuugcucugucacccagacuggagugcaguggcaccauccuggcucacugcagccuccaccucccagguucaagugauucucccaccucagccucccaaguagcugggacuacagacaugagccaccacuccuggcuaauuuuugcauuuguaguagagaugggguuucaccauguuggccaggcuggucuugaacuccugaccugaagugacccacccgccucagccucccacggugccgggacuacaggugugagccaccgcgccuggcuugcauugauuuuuuuuuuuuuaaucgcaacaaugacaacaaagccccuggagugucgccauguuucuuguguguaauuuaguuuaguauguaagucagcacaauucauaacugacuuccaauccccgcccauugcaaagaaaaaaauguucuuuuaaguguuuucuaaguacaacuuggguuuuauuacaaaguggauuaagaaggaauuaugauuugaggguuacguuuuuugggauuuauuuguuuuuagcuacuggcaccuguugcucacaguccugcgggucgagcagguccugcugcgcaggcuuucgcuggugucugcugggggaucggggcucuuacagggcugcagucccauggcagcugggacuagagucacccagaggcucagcuggaacaauuuggccucuuucccucuccaugcgugucagagccugagagcuaagcauugauuaagcuguuuuaugcucauuuuauuuucucuuucaaagcucuguguugccauuauuaaaauuaauuuuucuguccucagggaauaagaugaaaagaaacugacauuuauaggaaaucaaguauugccauuauuguccucuuuauaauuuugucuuaacuauauuuguucaaguuucaauguuuuuaauucaguuucugagcaaggucguuuuuggcuacugucagcuggagacagugaguggaguggccucuguggcuaugugagagccacugugaagaaagucucgggauguguggcugucagaaaacaaguaacgcggaaugagcaggccuugcauuuuagaccuuagggauccugugcgaugugggacuguuggaauauggagcagccugagaguggagaggcgagggcucagcaggaaugcgugcucccaggcucaccgugcgguuuucuuuauaggacaauacauggcuugauauacaacgcccugaagcucuucauggagaugaaccaaaagcuauuugaugacuguacacaacaguucaaagcagagaaacuaaagugaguuguuccuuucacaaguuacuguuuccaggauuuuuuucuuaauccuaaguaaaccucuuccacuguuuuguccuaaaacgguauucuucacucgaaagcaaaaccaagccuuucauacuuggaaagcaaauuaaaacuguguuauaauaacguauuuugaaagaacagguguuuaaagguagcuauucuccccccuuguauugccagauuaaucaucuuugcaaaaagugcuuauguaagcaagaauuuaacauucagaauuuuuucuuuucuugggcuauaaugggcuuaaaggcuauaauguguaguccauuuucauguuuauaaggcagggauuugaauuauauccuauaagguuuaucccagagagcaagaaucuucauuucaauguagcuuuauucugauuuaaugaacucagcgauguggguguucucuggaaucuagucuguccuuugcaaaaucaggguccugcccucgugccuuugagcccacauguguccagggaugaucuaagugacaaaguacuucgucccuaggcugugcaaguaauaaugugauuaaauaguuguuggaggucacuucuuccaaguugaguauggacuauuggcagauuuuauuuuuugcuugucacuuaaaacuggcuaagguagauaagcuuugcacgaauguaauucaaaauacacuguauacauauguguguaucuauguguguguguguguguguauauauaugaaacaacugccauuuagucauuccuuagacaaauaugugaauauuuaccuuauacaccaggcccuguuuuagauucuggcaauauagcaaugaauaaaacccacaaaaauccuugccccugggccgggugcgguggcucacgccuguaaucccagcacuuugggaggccaaggcggguggaucacaaggucaggagauugagaccaugcuggcuaacacggugaaaccccaucucuacuaaaaaauaccaaaaaagggccaggcgugguggcucaugccuguaaucccagcgcuuugggaggccgaugcaggcagaucacgaggucaggagaucgagaccauccuggcuaacacaaugaaaccccgucucuacuaaaaauacaaaaaaaaaggccgggcaugguggcucaugccuguaaucccagcacuuugggaggccaaagcaggcagaucaccugaggucaggaguucgagacaagccuggcgaacacagugaaaccccgucucuacugaaaauacaaaaaauuagccgggcgugguggcaggcgccuguggucccagcuacucagagucugaggcaggagaauggugugaaccugggaggcggagcuugcagugagcugagcucacaccacugcacuccagccugggagacagagagagacuccgucucaaaaaaaaaaaaaauacaaaaaaaaaucagccgggugugguggcgggugccuguagucccagcuacucgggcugaggcaggaggauggcgugaaccuggaggcggagcuugcagugagccaagaucacgccacugcacuccagccugggcgacagagcgagacuccgucucaaaaaaaaaauccuugcccuuuugggguuuauauucuggguaguguggggaaauaaaagaacacaaaauacaccuaagugaacuauagagcaugagagaugacaagucagucaggaaagggccggggagacagaccagccauuccucuagagcugccagcugcauggucuguucucaucucagcucucagugcaguucgcagguaggaagcaugcaagcagcagggccuucugauggcagauccuccucucguggaaucccacagcuuucccaacaggaccuuaaagguuguguaguacauuuucuggguugaaaaacuuggauccuggccgggcgcaguggcucacaccuguaaucccagcacuuugggagguuauggcugguggaucauuugaggucaggaguucgagaccagccuggccaauauugugaaaccccaucucuacuaaaaguacgaaaauuagccgggcgguaguagcacgcaccuguaaucccagcuacucgggagguugaggcaggagaauugcuugagcucgggagguggagguugcagugagccaagauccugcuacugcacuccagucugggcgacagagugaggcccugucucaaaaaaaaaaaaaaacuuggaucugaguuaagcgauugaaagucaugugacucgcaguggagucagucaacaacccaggucuccuggcucuuaagacguuuccuuuuuaauauuauaggaaugggaaugcuggcuccuuuuacaguacuggucccuuuacacuguacugcauacucguuuuuucaguggauauaugagcuucuugucaaaauuaugugggucccaugaagaaacaucuaaccaggggaagggggaaggauugagacauaagacguacuuauauaagauuucuuuuaagaauuccaaucuuggacauguuaaauuuuuuuauauuuucucauguuuaaaucucaguucguuuuucaugcugugcucagcacguaaguguggggaaauggagcaggggggcugcgggaggagccgcuggcugggcucaacaugccugugccuuuuccccuucaguguguucuugugucugaugcaucucuaacacagaugacauuuuacuguuuuucagagagaagcuaaaaaugaaagaacgggaagaagcauggguuaaaauagaaaaucuagccaaagccaauccccagguacuaaaaaagagaauaacaugaaaacgcccaggguuacuugaauguuuuuauaagauaggaauauaugucuucaccauggggggggucucgauuucacuaacguuguauaugaaaaugucugcaauaaaaaguacuuuuaaacuuuguaacccuccuuuuguacaaguacuuauuuugccccauaucguuuuaccacagaauugacuuuuuuccucugcuuuuuaaauaagaucugaaucuuaugcauauacugugguaaaaagaaaacuugaauacagccugagacugugccuccucucucagauaucauagaugcugucacucaaacagcauuucccuuucuuuuucauaugaaauuaguucuaaaagaaaggaaauuagauuggaaauagauuaaguaugacguuuugauguccucuuucuuuguaugagguuucuguaagcccagccuuuuaucauuaaaaaucagcugaauucugccacauuagcagccaacccuccuucccaccccagcagcgggugccagugugcucuggugagucugcgccgauggccggacgucccggagcugccggcaguuccagcugccggggcugccaggguccgggaggguuuccuggugucauggucuuuggguuugauguacgcugcuguaaaugacuagagcguuaugacaguuucuucacguucugugugccugauuauaacagugccucuuaaaaagaaaaucuuuuucagaaaaucuuuugucugaaucuuugccacucuuaagaauucucaagcuuuccuucaacucuccagaaaagauuuuaccgaacaauguauuucuuuuagugagagauaugcauaguuaccuaaguugguuuuuagauuucucugacacuuaauaaaaaguuauacaugaauauaaaguuaaaaguauaucuuuaccuauauaacaacauacugguuuguauacucugauaaaacugcaaucaggaaacucaaaucaggaaaacggaaugacauuucuaauugugagcccuugaguccaccuaaaacagguagccagcauuuuucuagcaguuauuuacucaugcugacagaaaugcuguuuuaagauuacugucuaaaacuguauaauccuuaauugagguagguagcuauaggcgucuccuuuuaacgaauugaauuuauguugaaagugugguuaaaauacugauauuuguuuuaaaacaugguaacacuauaaaccugggcaaguuuauaaggcccagcccugccugacgcugcccugcgugucuugcuuuguucugaagagccucaggcaaagugggugcugauagcccucaggauugucaaggaccccaguacacaugcaguugaaaucaguagccucgaaaacaugugagaaaugaauacacacacacacacaaacacacacacacgaaucagaaggucugauuuuauguaccuagaauauagagauaacuuauugaaaaauugcauaaaauuguuacauuacaaaucaagagcugguuguuuguguugacaaacauggcccaguuucacuacugcacauacuguacguaaccaauguuucuucugaaauacguauuguucucuuuuuucuuuuucucaacuuuuccugaauguucucaaguaacuuucuguauucuuuuugguugcucucuuugcaaacgucuguggugguggcaggcaugccgugguucugcauaggagcuuugacgaacugugaugcugggagcuuagcccugccuuguccucaugucuguguugacgccaucugugacgcaguccccaugagucucguccacaugcucuagucgcauggcacauggucuccuaaacagaaaauacuucaugggucaauaccucagagcuggaaacucuggccucguacuugcuucucauucucaggagaaaauaucuaaauucugaucacugcuucccauuacaacagcaacaaaaagucaauaauuuuguggauaauacagucugguuauuucuguagugaaaauaguuggguuuucaaaguuugguuuuccaucucagaucugccuguggagaauugguuugcgggcuuuguuuuuaagguggguucccagggacucgcuguguguucccugaugccccccguccuugcagaccgagccuucguccacucaaacgugugacagcacguacccagcaggcguuggggacccgggaaggcugcggugcccucaggagugugucuuauuugagcaguuauggcaacuuuauugggguuuuuaaugucacagaugauuuaauuuucuaaaaucaugaaacauuggcaguuucuaacauaaauguguuucuccuaauccaucaaaaggggccauauaauauuuuacuacucacuucccccagcuuuugugggaaucauaugaaaugaagacaggcacuucugugagacucagaguagcuguggcucaguguuugcaacgaccaaaacugccaugagcaacccagggcagggucugggacggaugccugccuuuccuucgagagaggagcucaugugcggaaugcaccucagugaagguuuuuguuuugguuugguuugguuugguuugauuugguuugguuuguuugagauggagucuugcucuguuacccaggcuggagugcaguggcgugaucucggcucaccacaaccuccgccucccagguucaagcaguccuccggagugccucagccucccaaguaugcugggacuacaggugcacgccaccaugccuggcuaauuuuuguauuuuuaguagagacgggguuucacuauguuggccaggcuggucucgaacuccugaccuugugaucuaccugccucggccucccagagugcugggauuacaggugugagccaccgcaccuggccuucagugaagguuuuuauuccuagucagaacccucuccugccagugcccgcugugugagguuuauuuugcugugaacaucugguagcauucuuguguagggacacucuccuuugccccgagggccagagagccgugcuccaagcggaggcuguuggugggucccaugaagagcacugcuuguugccuggaguagucaaaagcagaagaagcguuggugugaaacaguccccgcaagucucaggagucuugcagccacuuagguuucuguaucucccaccugacugugagcccccucgaggaaaggugcuguguccugaauuguggaaauuucuagggauacaaagaugagaacaagacauagcccccagccucagggagcuuacaguccauuaggagaggcagaugaauucagcucagaugaucagauuguauuaauaacauaccugggggagugugcuggagauggcaggaccagcuuauucguucccaucucuaaagaaagacacacacaguacgggggccuggccucuugguuugacugaaggggccucacccagucagacuugagggaaggugcccgcggcagagguagagaaaagcagggacacagugggugacaggugucgguccugguggggugucaguuauggggugggccggugcgaucugcugagaggugaggguggagagggagcagaauucccccaaaaugucagcagauauuaaagagccauaaagggcaaaauggcccagcccgacuugcauuuuugcaagcucuuuggcgcagcauggauggagugcuggggcugucgggguaggguguggagauguguggagaucguggugcugggcggagcugugggagugaaggcacagggcgcugaggaccuggucugacuggccuucaaggaaggaacccagcugagggugugugccccgucuguuuuugggggacguggaagccaggugggcugaguugagcagcagggccugggccuggaggcauggaagccagggugaauaaggagggacagagggugugggaaaaggccgaagacagcccacagaggaaggagcccaaggcaccuggaggagaggcuggggucacagagaccgagggagggugcagguucagggcugaaugauggcguccauggucaucauuccucagagaggcccagugaggcaaggccgggaagggcuuagcagccagagggcacccauaggccucaugccagagguggcuccgucagaggaugagggccaacaccagacgguggcugagaacggagcugcucugggcuggcagggugugaggggcaggggugagggggcagggggugagaggcaggggugaagcaggucagcaggagggcgcugcugugacaggagcucagccugaaagaggccgaagcugugggacucacugggcagagaauggagggguguggaugagagcagccugggcaggaacccccgcuccccucuccugaacucagaggcccugagcaaguuccccagccccuccaugucccaguucccccaucagccaggugaggguggcaguacacacacacgaccacgcaggacaaacaggcgccccacacaguucccagcucacagcagacacagaugccacuuccuucgccugugcccucagagccagcagacgcucgucacagucauacuguccugugcacccugucucauggaacccucacagccacccuccggggugaccuuacccccgcacuacacucauggaaauggagucaaccaggcccagugacugagggcugagccaucuguguuucaauccagagcacagggagaguggagaagucccagggccgcccguagggaauggagagggagcgucaggcucacccaggcugcguuuguuuugguggagagcaagucacccgggaugugaugagaggguuucauaagcaagccgggaaaaugggauaaaggggagagagaaccgugccagcugucucgaugagaggacaugaucgugagaggaaagggaaaagaaucaugagguuggaggucgcuggcaaagaaugggcggccagaggugaggguuccaguggugagacagcucccaccaccgagcccagggugcgaccucgcacuuggcugcucacguggagucagaacugcagaggccauggggugugggccaggguaugggcgggccacuguccaucagaugcagaggggucaggaggggaccagcugcuuuacugucuccacugagugcuuucugguuucagaagucagcagccgcaucauguugcagguguaggcgagucucccacugagugggcuuccugcgggagagggcccuggggggcggcaggggagaugagucccuagccaggaugagaagcuuggaguucagagccugggcaccuaacagagcgacuccacgcuuugcauugcaguacacaguguauagucaagccagcaccaugagcauuccgguugcaauggagacagaugggccuuuauuugaagaugugcagaugcugagaaagacagugaaggacgaggcucaucagguaaaagugcaccgagcucagcugggcacccaugacugauuugcuuaagaaaugcacauuuuuguaggcgaugugauuugcaucagugccuucuguuuaagcugaaauuaaaacuuaaauuuugcuagucuuauaggaaacauuguaucgauagaucuuagugaucaaauuacuagaaacaguuuuuaaggauuaaguaugugccugagauguguaucuccauuuacuaacagcaguaguaaucccaacucuuaacuguucuuuaaauguucacuccagcaaaaucgaaagcuucacagccauauccaccccucgcuguuuucuucacagcccucuggcuucugcuucgacccagagaggcucccuuagcucuucacagcgggugcuaacaaccccucucccuaggacaccucacccuccuugccccucccccuguccccucacccccuugccccuccccccuugcccccucaccccccucgccccguccccuuccccccucacccccuucaucccccucgcuccucuggccccccaccccuccccccaccccucagccuucuccccucgccccccucaucccccucgcuccucucgcccccccaccccuccccccaccccucagccuucuccccuugccccccucaucccccucacuccucucgcccccccaccccucccccucuccccccugaccccccucgccccccucgcccccucccgggcacugucuuucagugcuuuggucacaggccaccuccaaagagagccuccgaccacuguuacuccucagcugggccuguagacacuuaggacaacugacucaguuccugccuggguucaaggagcguuucagcugccguguuucccugagcgucccucccuguuucaaaugccuguaaacuaaaacaguagucccaaauggccuggggacauuggccuuucucacugagaaacuuuaaccucuuuuugaccagcgaaagaauuccaaaagacauccccuucuaaaauucugagguaagaagugaaaguaggcgccccgccuguggaguagccauuguuuuacuccuuuacugcauuaaauaaaauauguuguuugaaugaaugccccccauuucuuuuuuacuucuugaaugugacugcuagaagauucggaauuagcacauggcugacgccauauccccggcuccuuuccggaguugcacaggaaagggcucacggcaccaaguccccacggcagccacggucaucggccucuucugccccucuaauuccucaacucagguuaagagcaaaauagaugacugaaugcuuuucuuagcucaucaaagccugaaaauacuagaaauacaguggaaaagcucacugaagacuuggaauaucaguaacuaauuuucuaucuaauccaguugguuccauauucuccucaccaugaauguucuuagcaaugaauagaugucaucaaaaauaugaaaaucuguauauauuucucucuuugugggaguguuaauguucuucuugauauuuuuuuuuaacucaggaauuuaagguugccuuuuuauaccauuuugauuuuguggcuucaaauuugcucaagacuuguuaaguugaccuuguuacugcacacagaaggaaaucacagucggugucucuucugugagggaaccugccugggaguuuguggccacguguucauuuuuaagacacgaggcuauacacaguuaaaaagccaauucuuggccgggugugguggcucacgccuguaaucccagcacuuugggaggccgaggcaggcagaucaccugugcucaggaguuugaaacaagccuggccaacauggggaaaccccaucucuacuaaaaaauacaaaaauuagccaggcuugguggcagguuccuguaaucccaacuacuugggaggcugaggcaggagaaucgcuugaaccugggagguggagguugcagugagccaagauggugccacugcacuccagccugggcaagaaaagcaaaacuccgucucaaaaaaaaaaaaaaaaaaaaaaaccaauucuuacacauuaaauagcuuaggguuggggaauuuuuauuuuugguauagccuuugacuuaggucagaauuaaagcuagacaaagaauaaacuagguccaaaaugugauguaccugaaaggugugugcauauuugcaauuuagguccugcucuguaguagaucaagaacuugaucaagaaugcaaaccaaaauagcauucucuccugaguaaagcugccuuugaaagucaggccuaguaucugugugauauucggggccccagaacguccaacugcuuggucuguccacugcccuuagaaaggggcacguccccuccugggaggguuaccuuauacagugacaggaaggaaccaguccuauggccauccacgugucuacuuguaaauacacacacaggcaggacaguucuuggagaacuccuguagcaugucugcuuccuuguuuucacaacucuugaaauuguauucugucaccggguuuccugugugacugauauucuuacaacagugauucccucaccucauccuuagaucucuaugaauuauguuccugagucagaagacucagaagagucauugggaugucuguuuuccccagauuaacgugcucuccauuagaaucucagcaggcuuuuuauccucaagaaguugagaaagcuaauucuaaaauucacauggaaaugcaaaggaucuagaguagccaaaacaacugugaaaaagaacaaaguuggaagacuaauaauacuaugcaauuccaagacuucuuauaguuuuuguuuguguuuggagacagggucucacugugucacccaggcuggagugcaguggugugaucacagcacacugcagccucaaccuccugggcucaggcgauccuucuaccucagccuccugcagugcugagauuacaggugugaggaccugugccuggccugacuccuuguagauuucuguggaucaguugaaucaauugaauucaguugaauucaaccuauccagaugaagguauuuaugaagugcagucucuagguguaauauuugaaaugauaaauucugcuuuuuuuuuuuuuuuuuuuuuuuuuuuuuuugagacagggucuugcucugauacccaggcuggaaugcaguggcacaaucuuggcucacugcagccucggccuccuggacucaagcaauccgcccacuucagccucccaagcagcagugacuaccggcaccaccacacucagcugauuuuuguauuuuuagcagagauggaguuuuaacauguuggcuaggcuggucucaaacuccuggucucaagugaucugccugccuuggccucccaaagugcugggauuaugggcaugagccaccgcgcccagccaauaaacuuuucuuaaguugaaaaauguuuggagucguuuucuggaaauucugaaagcacuaugguuaaagcaaaaagaagguaccaauucaagucugcagugagcuaugaucgcaccacugcccuccagccugggugacagagccagacucggacucugaaaauuaaaaaaaaaaagguaccgggaugcaggaaaaacgugcacaauuuggugaccaaauugacguaagaaaugauagcugaaaauuaagcuuuuuugguuuuuauauauagucauuugauuauauucagugcccuuuuaauuuuauuuucagcuaacuuuauuuuuccaaaauaauuucacauuucuuugagaugaugugaguguuggguagggagaggugugagagguaguugaaggaauagcuggagagugggaagcaggcucugaugcugauggauggaguaggcuggauuuuuguggagaaauucaaccauguaucuaccuauccuuuauuuacauuuccuucaagaaacuaguauaacccuauacagaacauucaaagaaaacuagcaaauaucaugugaauaacauuuauauuauagacauuuuaaauguuugcaauucucauuuuuaacaguuggucgggagaaaagcagugucaaccacgcaaguaaggaagguguagagagacggaaggugggcagugcaggcucucauuacucaacguguagagcacauugaaggccuguucuccaggagaagaauugacgaguuaacguggacaugaaguauuuucccuuuuguccaugucauuccagauugugauggucaaaacaaagaaagaaauuuggcagcugggaggccgggcacaauggcagaugccuguaaucccagcacuuugggaggccgaggcgggcagaucaccugaggucaggaguucgagaccagccugaccaacauggugaaaccccaucucuacuaaauaacaaaaaauuagccggacgugguggcaggcaccuguaaucccagcuacuugggaggcugaggcaggagaaucgcuugaacccaggagguggagguugcagugagccgagguugcaccauugcacuccagccugggugacagagcgagacucugugucaaaaauaaauauaaaauaauuuuuaaaaagaaagaaauuugguggcugggcaccauggcucacaccuguaaucccaacacuuugggaggcugaggcaggagaauugcucgaagccaggaguuugagaccagccugggcaacacagcaagaccucaucucuagaaaaagaaaaaaaaaaaaaauagccaggcauguggugcgugccuguaguccuagcuacucaggagacugaggcaggaggaucccugaagcccaggaguuggagucugcagugagcuguaaucaugccacugcauuccagccugggugacagagacccugucucuaauaaaaauaaaaaaaaaauuuuaaagaaauuuggucccuuaagaaauguugauuauuucuaucugaaauuaaguaguaaaguuugaaguuacaccuuuauaagaggaaggaaacuugcauagccauguaugcccaaugccuggugugcuuucagcauuuacgguuuacauugagccuuccgggucugcccgugggcugcagaagagaggccaccucucucugacuugugucuccugugguccgcuccgccccugccagcauguucaccugcacauccccucugccaggccguucaucagccugccaucugcaugcugucuuauucucccugccugcugcugcucucauuuuuuugccuuguggaugguaaaauuauucucugcuuuacacaucaauuuaaaaugucuaagcagaaaggcccagauauauccaccgguuuucuguccuuucagaagcucuggggucauguuuguguucucaguuugcauucacugguuccagcuccaagcuuuuuacuguugccuuuuucuaugaauauguuucuucucuuuggagugccuauuucagcuguaauuacauauuucaaguauauaaaaaucuugguuuuguuuugcuucacuuuguuuuacagaucaacauagaaugggcauaaaauucaggguagaauuucaccucuggguugaagguagacaugcuuuacauccucacacguuaacacgcucuuacaaguaccgugaugggugaggggaccgugaccuucaccaucuccagagauggaugauucuccuaaaacccucacgcugguuuccagggaaacaagaaaccaaaaguccugccccuaccaugagugaauguuaauauucaaauaacauuucuagaaauaauccuaaagugaugugacaaaauucuuuuuaaaccuugacauuauugcuguuuucaucgguaaauuugcaaagaacccugcugagaaacacuuagcaaaaauuugaacuuuacauucaggacuucugcagguccuugaauuuuucauuaaagcgaaggaaaauguauuuuacauccaugucaaaaucagacaucuggaauuuguaaggcguuuuuacgcuuacguucuuuuuguugucaaaagacugacuuaaauuuugucugcuagacauaccacaaaaguaacuuagucuuuuucaauacacugaacaaaaaggaagacuuaauuuuggugaagaaacuuuauccagaaaaguuucuaacuaauuggcagucagucuucuggcauauacaucauguuugggugauuuagaugguuuauuguuuuguuucagaauauugguauuaacacagugucucuacuuuuaaacugaauuauguguuuauucauggaaauggaugcuuuugauauguaaacucuccaaauuaaguuucccuuuuauugcagauacaguuauccaaauccucaugcaaaaaugggauucacuuaauuuuuuuuuaagugaaaccaaaauuuccuagacuuuagaaagacaauggauuggagaagagaguauauauuuuuuucaauuugauagaaguuugaaauccaauuuaaauauguuuuuuauucauucuuuuucuuuaccuccaaggaaauuucuacaucuuuuuuuuuuuugagauggagucuggaggcccugucacccaggcuggacugcaguggugcaaucucggcucacugcaaccuccaccucacggguucaagcgauucuccugccccagccuuucaaguagcugggauuacaggcgcgcgccacuacacccaucugauuuuuguauuuuuaguagagacgggguuucacuauguuggucaggcugaucuugaccucuugaccucgugauccguccgccucggccucccaaagugcugggauuacaggcaugagccaccgcacccagccagaaauuucugcuucuugaaaugcuucuguaggggacaugcccaugaaauggcuuuaaugacauuuaugaaauaggagguuacuuaggaaauuuacuaaaaugcaugaauucugcaaauuagagguacugaguccuuuguacaagcacugcacauuucagaagaccagaaugccaguauugaacacacagguccucaaacgagucacgauuuuuaguagcaagacauuuuuggcaaauuuccaugauaagaccuacgccguuucccuguggccagggugccgccagcgagugggugaggcacacgugccucgcgguuauccuuugacuuccaccucagaaguaagcuugcuuuucagauagcuuaguuuguagccaacgccauugcauuucuaauuccaggcacagaaagauccgaagaaggaccguccucuugcacgccgcaaguccgagcugccucaggacccccacaccaagaaagccuuggaagcucacugcagggccgaugagcuggccucccaggacggccgcuagccuccggggcgccgcgucggggccgggcccgccaguucuuuuccggauucuguagaaaauacauacuuccugugccauaccaaucaguuacacucaaagcuuucuuggaccccguuccguaggcaauaacgugcguccgccucagcgcgagauuaggaguucaaacaauggugacuucccagagcccgcuggcagagccgcggguugacgacgguguccucgcagugucgccgccaccccagcguaguccaagucagacuauuucacaaagucagagcgauaggaaagcacccugcccuucaucuucauguucucccaaauggaacuuaggaucuuuuaacauaggugguucugugauaacaucaguguuuuccaaaucaaaggaacgcuuuaaaaaauaggaccuauuuuuuaagacuuuacagccuuugaaaugguuuccacgugauuguuacgccagcaguucucguuuuguuuguuuuucaaucucagugaaauggcucuuugcuuucgaguucucacgcaacguacugggcaaaugacaauccucagccgcugguauuuucuaaggggucucuucacuuugaugagugacaugaacaccgugucuccuucucuuguguguaccuaaagccauauuuccaagucugugguacuccaggauuccaggaguaagccuguagaagagauuuauuuuaaaagagauugcucugaaauuuaucuuaaaagagcuugcucugucuaccuugacagaaauuggaguuuuaaaauuauguguuaauauuuuuauuugcagauuucguuuccgucaacuuaaacauuguugcccuucaacaaggcucuugaauuaauaaaauuauagucucuaagaauuccacauuuuauggaaaguuagagcaaaaucauuuugaguuaagccaguucuuagccuaaugcaaacugcagcgccuuuaagcauaaaguaacacaacagcauugcacggggccggcacugccgcugccuucacugaaggcugcagugcuguucugagagcuuggaggaggcaccagcgaggaugacguuuaguggagcucuuucuguugaaaagagcucacguuaucaacaccuuguaaggaaaauacagugucugaguuuucaucggucuucacaugcugcuauauauuccacagaguuccuugcauguacugagcuuuuguuuuagauggaauagcacaaggagaaaaaucuuuaaacuuagugcuuugucuauucuuuauuucucucaggguggccaguauuuugacuuauuuauccugcuugaaagcuacuugagauguguacugcuauucuaaacacgugaucuaguuucuuucaucucuggcauaagauuauauaacuuaauguuaagugucuugaggcauaaaagacaaaauguggcuuauuuuaggaucuguuuuuucaucgaggucucggguauccuuucaaagauagugagaagcagacacugcuccuugugcagcucugguaccuccugcccacugcugucacuucaagccacuggcaaugcuucuguccucgugucuuggaggaaaaucaccuggggggaggggacuucuugugguaagagcaagugcagguaugaaaugcgaagauugccccagcuaaaaguggacaaguccgcuuugugagaugaauacuuccugagaaacuugacaaguaucucuccauuuuaccauuaugaaaacuaucauuaaaaaaaacaguuuagaugccuucuccuuuugagggaaaaagggugcuuuuuauuguauaaagcagcgucuuauguauuuugauauaccauuguuugaacuuccgucuuuagcugauagauucucaaauauccuugauuuuggauguucaguauguuugugagagagguuucugggaagacucucuuuuugcccucgggaaaaagcaaaauaucaauguuugggugacuguguaaagcucaguguguaagaacaucuuuuugucuagguuuucuuucugcucuuuauugaagacaaacacucaccaaaaagaaaaauaaaaguuuucagagaaacuaauuuucuuuggcaagaguauuacuuaauauuuuggccuccuaaaguuucccuaguuaguacucggacuccugugcuaauugucagcuuacauaucauuguauagagacuguuuauucuguaccaaacugauuucaaaaguacuacauugaaaauaaaccggugacuguuuuucuucauaaaguucugcguuuggcaucuucacucuuuccaaaauguaucuguacaucagaaaugucacuauuccaagugucuuuuuaguguggcuuuaguauggcuuccuuuuaauauuguacauacauuguaucuuuguuuuaugguaauaaguaauaaaaauguagacuucauauuuuguacaaaauguccuauguacagaauaaaaaaguucauagaaacagcaaauauagguaaguggcacaauuauuuuucuuuagaaaauaucuguaacuuuaugcauuagugaaauguuaaguaccgacauauuuuuuaacauuuuguaauucaaaacuuuuuguuuugacauuguuuaugaagagaaacuucauacacuugccauuuaauaugcucuuuuaucuaauuuucaaaaacucuaaaaaacgguguaucauauggacuaaauaaagaacaugugaauuuuauugcucaucaugaa
